United States Patent 6,812,339 (POLYMORPHISMS IN KNOWN GENES ASSOCIATED WITH HUMAN DISEASE, METHODS OF DETECTION AND USES THEREOF) - sequence listing, part 49

SEQ ID NO: 14837 - DNA, 86380 bp, Human
  misc_feature (1)...(86380): n = A,T,C or G
tagatcaaatgcactgtaattggatttcactgttccttcccttgggttcccattgaactttgcataattgtctgtcttctcacctagactggaactacttgaggaaagggacctactccttcccttagtgcggtgtcaaagtcaacaaacactccaatgattgctgaattaatataattattattaattactttgagacagggtttcgctctgtcatccaggctggtgtgtagtggtgcattcacggctcactgcagcctcaactttctggggtcaaactatcctcccacctcagcctcctgagtagctgggactacaggtgcaggccaccatgatgcccaggctgatctcgaactcctgggctcaagcgatccacctgcctcggcctcccaaattgctaagatgacaggcgtgagccaccgggccccccatgattgctgaattaaatagttggtgcttagtgtgtacttcacgtggcgctgatatgctgccttgcgttttggtcttttcatgtgcatgaggtgtgaccaagccttgatatgattcattatttaacaagaataccacaattcatctattcaaatgagggctgcgtcttcaacgccttcaccttgcaggactggatgcttagctcagtcattgcttgaaacacttttggaatacctctcttggaaacaactttggcatcgatagcactttcctttcaatatcttccacggtagcaattgtttttcatttatgcagcatttatcatgcacttccctatcccaggcaccaggctggatctgtgtgaaagataagataaatcagacattactctgtcttcaaggaagtttctgtttggcaagggagataagatctagacaaccacccaacacaaggctaagtgataatgccccagaaaaggttggatttgatttttggaaaaagccaaaagtcctttggtttcagtctcctggccaggtagatgatggcgctgcctgccagcacactgctttaagcccgtttgtcctaagcgtctccaaacaaggagcccagcgtgtttccagcacctcctgccccaataagagactcctgggcatgtgtgtctgaagtccagactctcaccgatggcagtatacaccgaggcctccccagctaaactctgagctctttgagggcaggtgctgacggctgatcctgatcttcacagtatctggactcatcacacatcttagatgaatattcattgagtcactgagcccagaaggcgtcccatggcatgccacatggacttcaaatcgagtgccctttctcccatgtggtttactcgtagtggcggttttacagatgcccaaggggcaggagagaaaaacggaaagagctaaagccggggagggcaagcgagggggcactggcagcggatctgggaatggagcccgcgagttcctgcttcctggttccccggagcaagtgtcctttggtgggagccgcaggaagggagcagcccttcctgcgcgccgggagcccgccccttccccggcctcccagggactcgtgcggagggacgccgggtggcggggcgggagtctgggccccgtccacccccccgcccccgggacagccccaccccggcgaagaggaaggctctcggctcctgggaaagggagtcgggaccccgccaggaggggagggcgcggggcgcgcaacgagcagccaaacagtcggagcggagagatcgaagggctagtgggcgtgggggccgcagccgaggcccgggtggaggggtccccgccgtccctcggccccctcccccgccgcccgccccggcccggcccggccccgccccgccccggcggcccggcccctcgcccgcccgcgcgcggcgcagtctcctccccgaggtgccggtggccccgccgccactccctccggctccctccctcccgccgcggcgcgcatctcattccagccctcattccgcgcattccagcgtcctcctcgcacactcgaggccagggggcgggagggccgcagctccggcgccgccgcgtcccgccaggtgagaggcgcccgcgcccgccgcacccgccggcgccctcacgggccgcgcgccccacgccgccgcagccgaccgctcgcgccgcgtgctcggctgctcttttctttccgccgcccgcgttcccgccttggacctctgcgctccgacgcgctccgtcccgacctctggcttccctccgcgctccggcgctgctcgctgcccctctcccgcttccctcctgtccgccccgcgctcccctcctcgctcccggttgactcactcctccaggaatagggatccccgtgttttcccgtcagtcccattctgggaaaactcctccctccgcgcgctccgctccgctccgctgggcgcaccggggccggtcggcgcggggtgggcttggccccgcggccccgccttcactgcgccgcccgtcggccccggccggagcccggctctgcgcgctgacgccctgtcgtccccgcagaacgatcgccgcggccggaagagttggcgctcggggcggactccttggaactggcttagcgcacccatcccaccttcccgcaccctgggaccggtaaggctggggcgcggggacttggtaggactttgccggagggcaggagtctgcgcggtgcgtgcggagctccctcccgggacgagactgggaagagcgaggcacgtggaggcggcgcgactgaggctgctggaggcgaagcggctccaggggcgggtaaggggggtggacactcgggactttgggggaaagggaggccggtgtggaaaggaccggagaggcagaaccgagaccatcggcaacagaagagacccagcacccatgcctcttttctgctgggcccttttcgagcctggaagggagagacctggaggtaagcggactgcctgttttaagtgcaaaggcgatgcgaaagtcgggggacccctgcaaaaggtcctacacctcagggcttgggaagctgctgtgtttcctgatggggactagtggatcgatccagggagcagaactttcaaaccccaaagtgaacatttcccccgttgtgctgaggcacttgaggccccgcggactgactgcgtctgtgctgagtctgtgtgacacctgactgcgagtccccctcgctttgagtctctgtgtgggtgatgtctgttcacgtgtggctcaccttggcttccagtgggcgtatttgtttgtgttgaacgtgagtgacagagtgtgtgtatatgtctgcgtgagaaggggctgtctgaaagtgagtatctctgagtaggtgtgtgatgccacgtctcttgagtatgtgtttctcttcgaggatgttggttctggctaggactgttcttcctccctacatagccgtgggcaagagtcagtgtctctggttgcctgagtgcagggataatttgactgtggttttggagtgtgtggcctccaggctccgtttcccctggaccgggcagagctggaaggaagctggctccacctgcctcttggagccaggaggctgactttctcagggcgagggtcttgtgcttgcctggaataggtcaaaaagctggtaggaggctgaaggaagttgagatctttgcctttgggggatgggatgggcgggtgagatttgggaaggtttgtcggggtggatccccgggaaaaggagacagttttgaatctggagacttgtgtaaatagtgcttttaagttgccctcaaggacaaacagggaggtataccagcctgaactacttttcctggtttaactctcctcggagctgaccaggtaacccagtagaagaatccctcattctttccaacttgccagacactcagcacttcctttgagaagaggaatgagtagcttgttgcatgagggcttcaacgtggatatcatgtgtagggcttcttggaaggaaggagccagaaactgtctcgggggttgggggttctcgtccttgctcctccatccatcctgaggatgtggatgttcttgtgggaaacacctcaccctctcacctcttcggcctggtgtgcgactggtctaaaagcagcactgatggagtggaaagggcacaggtttggggtcaggcagaccagggtacaaatcctgagtctctcactacctttaaggctctcaggctgtttcctggtgggtaatacgagcggagcttttctgtccagaaagtttcttgtgaaaagtcgatgtctgcagagcccccacccagcagcacagtgcctggcacatcccatggactccataggatagctgttgtatccagtgtttccttcgcttatttcagtaagaacccctttttcctagggattagtgttttttgaattagtgtttctctgagcaccatttgagaaaccttgccctgtctatcatgtttatttagcaaacatgaatcgagcatttactgtgagccaggccctacgctgtgttccgcgtccttaggaatccagggtcctagtggcccaggtcaggagggagggggacagacagggctttgtcaccagagaacagagtgccagcttctattttctgattccagttttgccttggccccagggtgagcttgctgaacattattagataccctaatgtcagcatctaagtcccccattttattttattttactttatttttattttattttattttatttatttttgagacggagtctcgctctgtcgcctaggcagtagtacagtggcatgatcttggctcactgcaacctccgcctcctgggttcaagcgattctcctgcctcagcctcccggccggctagtttcatatatatatatttatatatatttatttatatatataaatataaatatataaatatatatataaatatataaatatatatataaatatatatatatatatattttttttgagatggagtttcgctcttgttgcctaggctggagtgcgatggtgcgatctcggctcaccacaacctctgcctcccgggttcaagcgattctcctgcctcagcctcccaagtagctagaattataggcgtgcgccaccatgccccactaattttgtatttttagtggagacggagtttctccatgttggtcaggctggtctccaactcccaacctcaggtgatctgcccaccttggcctcctaaagtgctgagattataggcatgagccaccactcccagccgttttttgtatttttagtagaggcgggatttcgccatgtttgccatgctggtcttgaactcctgacctcaggtgatccgcctcggcctcccaaagtgctgggattacaggcgtgagccactgcgcctggcctaagtctcccattttaaagatggggaaactgatgctcctagagggacagtaacttgcttaatgccgcaaccctggtgagtggcagagcagggattagaacctatgctctccccttggcgttctgtctcctgccctgtggattgcagtgcttgtacaccccctactccccctagccgccttcatccaacaggcgcggaagctggagcagactgacttgggccatgccttgtcgctcagataaggttggtaggaggcagaaatactctgctccgacctggcagaaagcacatagctgttctggggaaggagccatctcactgtagaatctgtggagtcgggaaggggccctcgggtctttaaaacacaccctcctctccccttgatgagccggcaggtgaaggttctccctatctttttagatctcctgggttgcaaatgtcacaacctcctttgatttccactctggagtcttgccccggtgactgtcacaaagcaatgcctgttgccaaacctgtggctcctccttctccttcccagtggaagtggaggacgttggtccccagctttggaccttgcctttcctgcagttgaggtcagtccagtggcagttggaaattcagggcttgtgagggtggctttaccttgcctgtcttcctttgcccccatgaccctttgttggccggggttggacgacagctccctttaaagctctgaaattggagctgaacagctgctgtccagtaaaggggggtgagggggctgtcagcagccaggagggcccaggtggaggtgggggcagggctttgtcactggggagaacacggtctccagctcctatcttctaattccacttttgcctggacgctttctgagatgacggttcttcccttgcttttggtttttcccgctactatctgggagattctaatcacacctgtgtgatctggccctggggcccttagctggtggggactggatatttgggaaaatttccactagaactcaggtctccaagatctatgcccacgtcctcctgcatttaatacaggggggctcctggaagggccagaggatgggccaggctccctgtagcgggggctggctccttggcttggtgtgggcaggcgggcccccatgggtggggactctgcttcctttgacccaaacttcatgggaacaatagacttcagaggagtcaccaggggcaggaaatgggagctgtgcagagccaggggtgaccctcctgggggatgggattgcatatccggtagagggttgggggcagtgcagagggcgctggggaggggctgatgacacatagggtgggcctctggggtggggccctcctccaaagggggccgttgactcagtgtgaagctagagctccgtgccggttctgtgctgagctttcggctcttactagcacagggctcgtgtttgccagcctccgctcgtgccacgctcgcccctgccaggacttggtcttccccttcccctcaagcccctgagatgtctttgcgaatcatcctggctgggataaaaggctggtgttgttgctccctggctggtctccaccttggctgtgagccttgggcagttgtggctggaacggcgatcttgggttgtgggcaaagctctggacagggagtccccaggctggggtcgctggacaacgtgagggatttctttctttctttttttttttttttgagacggagttttgcttttgttgcccaggctggagtgcagcgctgcaatcttggcacaccacaacgtctgcctcctggattcaagcgattctcctgcctcagcctcctgagtagctgggattacaggtgcctgccaccacacctggctaattttttttttttttttttgtatttttaacagagacagggtatttccatgttggccaggctggtctcgaactcccaacctcaggtgatccacccgcctcggcctcccagagtgctgggattacaggcgtgaaccaccgtgcgcctggccatgggggatttctttagccgcaggcagagcgagacagtgggtggaacattctggaggcggaggactcttgtcttgcctcgatctttgtaagggtcgaccagactttgtgaggaggccacagcttaccctgagagaattgtgagtcaggccacacaagctgctttgcctgagttcaggttgccggattctcacagataggctttggggtcccaagagaaggtgtaggagtgaccccagaaccactgccaggacctggaaggagggtaggagtaggagagacaacacatgctgtcttgatttgtttcttcaaggaagcaagatggggaccctggaaatggcagactcctagaattgattccttgcccaattcttggttagattttgttttttaatgattttttattttttgagacagagactcactttgtcacccgggctggagttcagtggtgcaatcatggctcactccttgaactcctgggctcaagcaatcctcattgccttaacctgagtagctgggactacaggtatacgccaccacacctggctaatttgtaaagtttttttgtggaggtagggtctcgctttgttgtccaggcaggactcaaactcctgggctcaagcaatcctcctgccttggcctcgcaaagtgctagaactgcagatgtgagccatcataccctgccaatttaaaattttctagtagccaccttaaaaaaaaaaagtgaagttaatgttggtgttttcttaaaccctagtattatcaaaaataatttcagtgtaataatttttttttgagacggagtctcgctctttcgcccaggctggagggcagtggggtgatcttggctcactgcaagctccgcctcccgggttcactccattctcctgcctcagcctccccagtagctgggactacaggcacccgccacctaatttttttgtattttttagtagagacggggtttcaccatgttagccaggatggtcttgatctctcgaccttgtgatccacccatctcggcctcccaaagtgctgggattacaggcgtgagccaccgcgcccggccataaatttttttaaattatcattattattattatcgtagacagtgtcttgctctgtcacccaggatggagtgcagtgatgcggtcatggcttatgcagccttgacctcccaggatcaagcaatcctcccacctcagcctcctcagtagctgggactgcaggtgtacacggttgcactcagcctaggttagatttttgaacaaaaatatgtggagagtgtgaaaatgaagtgagatacctagtagccaacctgggttcactctaccaagtcttggagaaaacaactctaacttgggtggaggaatgttcagtaagccttttcagtctaatgatcttcttggtacaagagaaagcagtgtggtctggctgatacagcagggagatggatgtgtgactgcttgacccactacgctggatgctgactcctaactcctgagcttgtgttactgtgaagaggtccccgtgatgtgccgcagggctgtctttggcttagtcctctatgttttccatagatacgagcctctcccaggagcctgtgtggcctgtgtcttctgtttctcatttctttttctttctttttttttttttgagatgggtcttgctctgtcaccaggctggagtgcagtggcgtgatcttggctcactgcaacctctgcctcctgggttcaagcaattctcatgcctcagcctcccaagtagctgggattacaagcacacgccaccatgcccagctaatttttttgtatttttagtagaaacagggtttcaccatattggtcagactggtttcgaactcctgaccttgtgatctgcccgccttgacctcccagagtgttggtattacaggtgtgagccaccatgcccggcgtatttcttttttttgagatggagtctcgccctattgcctaggccggagtacagtggtgcgatctcggctcactgcaacctccgcctcctgggttcaagcgattctcctgcctcagcttcctgagtagctgggattacaggcacctgccaccacgcctggctaatttttgtatttttagtagaaatgtggtttcaccatgctggccaggctggtcttgaactcccgacctcaggcgatccacctgccttggcctcccaaagtgctgggattacaggagtgaaccaccgcacctgaccctgtttctcgtttttatgggcgttgagggtagcaaacattggctgatagaaccagggttcaaaatcatctcagttgactggaatgctgccattaagtagaaagatgaagtttaaaaatatttctctcttaaaattaatatatgtacattgtaggaaccctggaaaataaagaaaggcataaaggaaaaaaatgatacataatactataattcggggggctggtatttcggtgaatgtccttccaaatttgtgttcatgcaaatctatatattttaacataattgcaattatactctatcccgtttttttccctactgaatgctatctaatgggtaatagtgcatgtcataaaaaatacttaaaaccataattttaaggatccaagtaacattgcattctatgactatactatatttaactatgccctactgactttaaaacattgtttttagtttttagcttttaaaaattacttgacattgagcaatgttgaacatatacttatctcaagaagaaatgtaataggtctaagtgtaacatcctgcatttaagttcaaagcatcaattatgtaagtctagaatagagtgggacttactcttcattcatgttgagggaaaaggcttggggttttgggctgaaaaacgaaggaagagggaaatgaacattttaatgcctgttaggtgctagaccattattctagacatttctgccttcatcatctcatttcatcctctcagccctgtgagaaaggtttggtttgtttttgttttgtttttcaacctctactttacagaggggacactgtagaagttatactgcagttggagtttggacccaggtcaatctgactctcaaactgccccattaaaccataagcctgtgtgggccagtgctgtggtaaggtctgtgtcaagggaaacctttactcactaagctctgtgaccctctggccacattggaagccacatctggttttggaaagtttatatatcctgagctgttaagtattgagctcgccatttttatgggtcttcctctaccccccaccagtgatctgatctcaaacatgtgggtcttttttttttttttttttttgagacggagtttcgctcttgttgctcaggttggagtgcaatggcgtgatctcgactcaccgcagcctccaccttccgggttcaagcgattctcctgccacagcctcctgagtagctggaattacgggcatttgccaccatgcctggctaattttgtatttttagtaaagatagggtttttccatgttggccaggctggtctcgaactcccgacctcaggtgatctgcccacctcggcctcccaaggtgctgggattacaggtgtgagccaccgcgcccggccttttttttttttttttttttttttttttgggagacagggtcttaactctgtcacccaggctagagtgcagcgttgcaatcacagctcactgtggcctcaacctcccgcgcccaagtgatcctcccacctcagctttctcagctactcaggtctcagtagctgggaccacaggtgatgccatgcccgcctaacattttttttgttttaatttttatttttcatagagacaggatcttgctgtgtttcccaggctggtgttttttttgttttgttttgttttaatagataggatcttgctctgttgcccaggctggagtgcagtggtgtgatcatagctcactgtagcctcaaactcctgcactcagatggtcctcctgcctcagtctcccaagtagctgggatgacaggtttgtgccaccatgccctgccaatttttaaaactttttgtagaaacaaggtcttgctatctttattttgcccaggctggtcttaaactcctcgcctcaagcgatcctccagcttcagcctcccaaagtgctgggattacaggtatgagccactgtgctgggcctgtgagtgtcttaacagaggctggatgaggacttagaacctgccagcatctgggtgctgtcatttctcatttctagaaggtaggcaccctttacagcagtagcaggttaggtccatctgacctgaagtctattacttcattatgtaaaaccacataaaactagtgggccctctgtatctgtaggttccacatggattcgacccaccctggatcgacagtgttcaggggaaaacattccacagagttccagaaagcaaaacttgaatttgctgctcactgaatgctgcattgaatccatgcaaatgaagtgatgtgcatgcgttgtgttaggtatgataagttctctagaaatgatttaaagcacatgggaggatgtgcgtaagttatgtgcaaacactgtaccgttttatatgagggacttgagcatcctcgggtttcagtatccttagaggccttggaaccgatcacccacagataccaaaggactactgtacatagagtttcattatgtagaacttactagggatgctttggaggagtctctgccctgcatgggaaaggactaggtcacctccagggccactgcttcctcgaagattttgtggtcctgggcctcagtttctccacatatcagcatgcggggattccactagatgaaacacttcgggattcctgctacagggaggtagtacagcgaagctgcacctggagttggaggcaaggcttgggacgagggtgcagtgtctgagcagtcagaggaagcagaatggggagatgagggaattattgcgtggctgccatcgtctttgtccaaacaagcacggtgttaggaacaggcggaatctgggtcttgccctgaggctggagggtggggaagatgaccctccacaaccccagagagcagtggctatcagtgcagactccagagtggtgctgtccaatagaaataatatgtaagcctaggagttacatttaaaaagtaaaaagagctgggtgtggtggcttttgcccatggtcccagttactcaggaggctgaggcgggagagttgcttgagcccaggggtttgagaccagcctgggcaacatagcgagaaccctgcctctaaaaaaaagaaaggaaaacttaactggtaaaatgcattgtaataatatattctttaacctatgactacaatattatcattttaacgtaatcaatagtaaaaagtatcaatgagatagtttaccttctttccacacaaagcgctagaaccgtagtgtgtattgtacacttaacaacacgtctcaatttggactaacaacgtttcttgtgttcagtaaccacgtggggcgagtggtcgtggttggcacagtgtggctttccagccagcccgcctgggtttgaatctctgttctgccacttaacacctgggtgggataataaggttaatagaaccaacctcatacggtgtatgtgaagactaaatgagttaatatctgtaaagtgcttagttctttccccggcacataataaccactgtgtaagtgtttgtcaaataaatgacctataaatggttcttaaaaactgtcgaagctggaatttgtaagaggtagggggtcgatgatgtgtgtggaaaaacccaatcgtagagtggccctgtggagttactgatagtccacgtttgtactgtggtagttctccataatgaaatggacttcagatccgaagatcctaatctactctttgctgtgaagagcacctgccttctggaagtgagaaatgacagcatcctgatgacaagacaggttcccatccctcggcaggtgcatcctgagcatctgtctgcctggggcttgaactgtgccgggtggcatgcaggaagcaaaagcatcctcggaaatgctccgtcgtaaattgcatgacctcatgttggaatgagaggtggggtcacttccagcacttggaggttgaagcaatagttgctgcttatgcaagagaagaagtaagctgtaccagtgcctcccatacctcctcagggcactgccagcccagcacagccagctctcctctcttggcatcagctccctccgactgcacctgccctcacccaatccacagcagccacagcacccacggtgtgcccggcactgtgctaggtgcagcgggagtatggaacggaagccctggttcctgtcctcatggaacttgcagggaaatggactgtgaagctagcagtaacatactgcaagacgaaagaacgtgcacaagcagggtctgtggcagtgcctggtaaaggatgattgattctgtcccaagaggaggaggcagttgagctggctttgagagtgggtggggttctgacaagcgtgtatatgtgtaagagagagggaagcagacagagaggaagagaaacagaactatccttgagaagacagagaaaatgtgatttgagggctattgtcatgaagtgatgagaggaggggaggtaagtgggttttgttttttgcgggttttatttttatttttattttattttattttatcttatttatttttttgacagagtctcgctctgtcgcccaggctggagtgctgtggtgcgatctcggctcactgcaagctccgcctcccgggttcatgccattctcccgcctcagcctcctgagtagctgggactacaggcaccccccaccacacctggctaattttttgtatttttagtagagacggggtttcaccatgttagccaggatggtctcgatctcctgacctcatgatctgcccgccacggcctcccaaagtgctgggattacaggcatgagccaccccgcctggctgtgggttttatttttatatccttttttttttctttctttcttttttttttttttttgaggtgaagtttcactctatcacccaggctggagtgcagtggcgcgatcacagctcactgcaacctccgcctcccgggttcaagtgattctcctgcctcagcctcccaaatagttgagattacaggcacgtgtcatgatgcccggctattttttgcattttcagtagggatggggttttgccatgttggtcaggctggtctcgaactcctgacctcaagtgatcccctggcttcagcctcccaaagtgctgggattacaggcgtgagccacagagtctcactctgccacccaggctggagtgtggtggtgtgatcacagctcccttcagccttgagctcctgggttcaagcaatcctcctgcctcagcctcctgagtagctgggaccacagacatgtgccaccacacctggctaatttttaaaacattatttctagagataggatctcactgtgttgcccaggctggtctcaaactcctgggctcaagccatcctcccgtctcggaccctcaaagtgcttggattacgggtgtgagccaccatacccggccaagtgggttttatgaacagggtgggtttgagctaggccctctgggcaggataagaaggtcttattttacgttcattttttacgtttatttagactcaggcagcatgtctctttttttttttttttttttttttttgagacagagttttgcttttgttgcccaggctggagtgcaatggtgcaatctcggctcactgcaacctccgcctcctgggttcaagtaattctcctgcctcagcctcccaagtagctgggattacaggcatgcgccaccatactccgctaattttttgtatttttagtagagacagggtttctccatgttggtcaggttggtctcgaactcctgacctcaggtgatccgcccgcctcggcctcccaaagtgctgggattacaggcgtgagccaccgcgcctgtagaaaaacatctcatcctataaaatagagtgaatctttccctaaatttatttttaacatacatacagcaaaatacagtgtttttggtaagtagtagatgttgacaaatgcacagaatgtgttttcaccgccaccatcaaggtaaagactgttccatcccccaaacgattccatccatgcattggccccttggaggtcatccctcccccttcccctcttggcatcccctggccacgctgatctgttcattcctataattttgcctttcaagaatgtctcacaaatggaatcatgcagttacatagctctttgggtctttgcttctttcactcagcaaggtcatagctcactgcagccttgaccacccaggctcaagtgtccctcccacctcagcctcttgagtagtggagaccacaggcacacgccaccacgcccggctcatttttgtactttttgtagagatgaggtttcgccatgttgcctaggctggtcttgaactcctggctcaagcagtccacccgcctcgcctcccacagttgtgggtgtgtgccaccatgcccagctgttgttctgagagttctttcatattctggatacaggttctttgtcaggacagtcagatatgtgatttacagatgtttggaggaaattagtttatggagaaaatcttcacaagatgatgggagtgaggaactctgaaagtgaggtgagagtttggtgtcctgagctgtggcctttctcacagtgcaagatgggaccaggaatgaggagtggggtacacctagagaatgacatgaaaaagaggagtcacggggccttccaagaagctctgttcctggcgtagagcatggttcagaatgagaggcacaggtgggaattttggtttgccgggcatccttcctgcctggcgggctgcacctggtctgcagctaatggcctgctgggtcaggccgggctggccccatccagaaaaacaaatgttcatgtccagcctgcatttcaaccacttccatggccttgtttccaaaccggatgatcgtgccttctggaatgggaggcgcggtaactggcaggcctgcaggagtaaggtgctgggtgtgtggctggtgcaagacagaatcagtgggggtgagttttctgggtcagggtgggtcctctgggatggtaacctcagcctagggtctgagtgaaggcttccagctattgttttttcttttttcttttttctgagacggagtctcactctgtcgcccagaccggagtgtagtgtcacgatcttggctcactgcagcctctgtctcccaggttttcaaggtgccttagcctcccgagtagctggaattacaggcttgagccaccacgcctggctaatttttgtatttttagtagagatgggagtctcgccatgttggccaggttggtctcgaactgttgacctcaggtgatccacctgcctcggcctcccaaagtgctgggattacaggcgtaagccaccgtgcccggccagctttgagctgttaacagaatgtctgaaacatcataatcttccttcctatccctgaccaggcagggtggctctgggacagaagacttacatgaaaaatgaccaaggccaggatggatgccgcctcccacctcttgtccaagctcattctaaccccgcctgctcctatgtcctcagagccatggcccagtccagaggctcgggtcttcattcttccccctgggggtgcagatgcttttccggaggtgcttagggcgtagggctggagagtagggcagagctggagtcctactttcccggagctcctagtgccccactgcctccaggatgtcctgtggctccctgaggctctgggtcctggaaggcattccccggtgtggagactccctcttctgcctggctcctccttctcccagggcagggcgtgcaccgaggccccaccccagatgcccgtgctgcttggacacctggtttgggctgacccccgggttctgacagggtgggatcctcctgcctgactttgagagcagctgattgagggcaaacccacccccgaggctgaggaaacaagtgtgctggctttgacggaattccagggcaagtgcttctgttagtcactcccgggctaaatctattaatattttcagatctgcattttcctaggacacgcctccttaaagtgaagccaattggtttggttgagtacttttgcctctcaagtactgtattttcataatttttgctttttgctttatttcacttttaaaattttgtatttatttattttttagtatccctgtcatggcaacttttgctttattctagaaccctgaagaaaggccccgaggagaaaaagtctctcaacccttaaaacaaaaaacaaaaaaagactataattttgagtagtttggggtttatagaaaacttgagcagaaagtagacttcccgtagatacattcttgccccgcccccagtcagtttctcctagtcttaacatcttgcatttgttgcaattgatgtacatttgttgcaattaatgagtcaatatcggcacattattattattattattattattattattactagagacggagtcttgctcttgttgcccaggctggggtgcaatggtgtgatctcggctcatggcaacctctgcctcccagattcaagcaattttcctgcctcagcctctcaagtagctgggattacaggcatgcgccaccacacccagctaattttgtatttttagtagagacagggtttccccatgttggtcaggctggtcttgaactcctgacctcaggtgatctgcccacctcggcctcccaaagtgctgggattacaggcatgagccaccgtgcccagccagcacattattagagtccatagttcacattagggtcccttcttggtgttgtccactctgggttttggcacatgggtaataatgtgtacccaccattacagtatcatgcagaatagcatcaccgttccccaaatcctccaggttccgtttattcatccctccttcccacttctggcaaccattgatcttttgactgtccctgtagttttgccttttctagaatgtcatatggttggaatcatacactatgtggccttttcagattggcgtctctcactaagtaatacgcatttgagtttcctccatgtcttttcatagctcattttttttttttgagacaaagtcttgctctgtcacccaggctggagtgcagtggcatgatcttggctcactgcaacttctgcctcctgggttcaagtgattctcctgcctcagcctcccgagtagctgggactacaggcacgtgccaccatgcccggctaatttttatattgttagtagacacaccattttgtgtttcaccaagatgccgggctggtcttgaattcctgacctcagatgatctgcccacctcggcctcccagagtgctgggattacaggcgtgaacctccacacctggccagctcatttctttttttttttttctgaatagtattacaccctgccccaccccccaaccttttgtttttgcaaatggaggcactgaggcccagagaggggaagtgactggctcaagaggcaccacgaacctgtggcaaagctgcgcttggaggctaatttgccttcctctgggtacctgtttccaggggcctctgggccgggcgctgttctggaactacacctgtatcatcacagctttgtccagaggctgaggggaggccagggggcaaggcctctgttcaccacttgccttgacccacttcctgcatgtgttgggtggggcctgcatatacccacgcccctgacgcggaaggggttgggggtggggttcccagcttccacctccctgagagctgaggagatgggatgctgggtccaggctgagagctgaggagatgggatgctgggtccaggcaagtactcgccaccccattgccgcccgggcctgggggctgggtgggaagagactgcttgggttgggcctgggctggggcctgcagcatttaggaatcttatctccctctgttgctctctgagctgcccctcccactggagactcctcccagctggcctgcatcccaggccatctccatttacttaatttacctcccctcttgctagcctgcaggcctcctgctccttcctctctgtcccgccctccatcatccctcctgatgactacagggcaatgaccgtgaatcacgtgcaaggagcccctttttgggccaggctctgtgctcctgtctcatggacatgatggaattcaatcctcacagccgttatttggggagattgagattgcactggtgcctcttcagtggttgggaggacactgaggattagagtagcttgctcaggactcccaggtccctgtgaggctgggccaggatctgagctcaggcgtcttgagtccagagcccaaacgctaaatctctgccccaggcgtctctctctctctttctctttctccccttcctgctctctctccctttcccccttcccttctttttcctctctcttttgaccaggcattgctcaaggggtccagctctctgacttttgttccaacatctccttagcctgggaaggattgtggggcctccccccctctcacctgctccccgttccccatcctgtcctgaagccaggtgtgatgaaggcctcacaccaaaggatggccgggaaggtgctgccgtgcattgccttgcaggggctttacttgcttttctcaatcctcagtggctctgcaggcaggaatgctcatccccatttgacaggtgatgaaacagaagctttggggaggttcagtaagttgctgaacagctgtgcaacgtagctggtgagaggcaggtttcactcaggtcataggactctgaggcgtctttaacatgtcccggacttcacgtggcctttcccgagaacttgttgcatttcaggagaggaaggggcactgctcagcaagaggaaggcactccagtggtgggagctcaggccccgggacacctaggttttcttggtcttgttttctgagaagggcccttttttggcctccggcaggccctggcccttccgaaatcacaatgggatctgtttgtttctaactgagtacacagcctggcccggcccagcccaaccaaatccatttctctgctgggttctttccttctccaccaatccctttccttccatccctcgggactcacctgcctgtgacctggggactctcctgtccttctcttttcttttccagctgtaaccaggccctttcctttgctcctgtatttcgggcccaggtcccctgcagaccctcttttccttctctgccctcttctttttgtcttctatctcctggtgcgctttaaacaatttttttggtgaaatatatgtaacataaaatttgccatttgaactccaagtgtgcagtttggtggcattaaggacattcacaattgtgctgcagtctcctgcttccatctccagaactttttcatcttccgaaactgaaacgctgtacccgttaaacagtaagtgcctgttttttttttgtctttttgtttttttttgttttgttttgttttgagagggagtctcactttactcactttattgcccaggctggagtgcagtggtgcgatcttggctcgctgcctccggggttcaagtgatttttgtgcctcagcctcctaagtagctgggactataggcctgcgccaccgcccctggctaatttttgtattttttagtagagacaggtttcaccatgttggccaggctggtctcgaactcctgacctcaggtgatccacctgcctcggcctcccagagtgctgggattacgggtgtgaaccactgcgcctgacaatgactgttaatgttatgaatgaaactccccattcccccatccccaacccctgatagtctctcttcggctgtctctatggatttgcatattctcagtacttcatggaagtgaaataacatgagatttgtcctttcatgactggcttgtttcacttagtgcaatgtccttaaggttcatccatgttgtagcctatgtcagaatttcatgccttttttgtttgtttgttttggagatggagtctcactctgttgcccaggctggagtgcagtagtgtgatctcagctcactgcaacctccgcctccctggttcaagcgattcttgtgcctcaacctcccgagtagctgggattacaggcacctgccaccatgcccggctaatttttgtatttttagtagagacagggtttcacattgttggccaggctggtctcgagctcccgacctcaggtgatctgcctgcctcggcctcccaaagtgctgggattacaggcgtgagccaccgcgcccggtctcattcctttttaaggtcgaatcatcctccattacctggatgcaccacattttgtttatccattcctctattgatggacatttgggctgcttccccttttgactatcctggtgccttttgacattctgtgctcaggaacagcagacagcacttccgcactatgcttgggaccacttgaggcagcaaaagcacctgcaaaagtgcagaagtcacagcactaaatagacccagaacaagacacctgcaggagagctgacccaggtagacgaagtgcggcgttgccgacctcagctgggagcgtgcgcgtcaggcagtgagaatttgtggctgctcagtgcacgcatgtgtccacaaatgactgtgaagatactgggaatagtgatttgggggttagaaattttagcaagttggcaaacttgcaagtacaaaatctgtgactattctgtgattaatgaggattgactgtacttgcatcttcatagatgactctccctccttccctcctgagatgacagcattaatccattcagcaaggcccaatcacatcttaaaggctccatctcccaacattcttgtgttggggattaagtttttaacccacgaactttgaggggcacgttcataccagagcagcgcccaatgcctgtcatatagtacatgcccagtgaacagtgagtgaatgaagggcacaaggactgaagtacctgtgctgagttgttaggcatgagaatcagcagggagagatctttctggcaggggagcctgttcctctcctccctgggaagaagccctctcctgtgctcactgagaggcatccagtgatggtcatggaggttggaattgtgtggcagaaaagtgcaggcctgagatgtagttctagtcccagttttaacaggttttgtggtctttggcaagtcacttcacctctcagggccttagtctcctcacttatacattggagggcagttttctcccccgagattctttccacacaaaccctgggaaccctgcctctctccgctgggaccttcactggaggccgtaggaacagtggggtccatgcaacgaaagagaccaagaggtcttcgtgtctgcagagatgaacttctctagctcccttagcctgccaatccaggctacccctccctccaactctgcacatctaacttgcatccctcatgctgcagagtcagatcatcccccttcctattgtcaacagaagcgtttgcaaaataggctggatgtggtggcttacgcctgtaatcccagcactttgggaggccgagacgggcggatcacttgaggacaggagctcgagaccagtctggccaacatggtgaaaccccacctctactaaaaaaacaaaaattagctgggcatggtggtgcacgcctgtaattccagctactcaggaggctgaggcaggagaatctcttgaacctaggaggctgagattgcagtgagtccatatcgctccactgtactccagcctgggtgacagagcaagactctgtctcaattaaaaaaaaaaaaagttggcaaaataggtcaaagaagcatcatggccaggcgcagtgactcacgcctgtaatcccagcagtttgggagggcgaggcgggcagatgtctgaggtcaagagcgaaactccatctcaagaaaaaagcagcatcatgatgggcaggaggcagcttgcagtggggaagggcttcagagctgcagtctgagccttgtctcttactggctttgggctgggacacagcacttcaccttaggagcctcagcatcttcacctgccaaatggggcagtgcagctacctcaaggggatgggggcaggattggaggaagatgtagtcaagtgctttgcccagtgcctgatgcagagtgggcatttgaaactggcacctcctagtgttaaagtagtaaaacgtgtgtccctcagtgtccagggcacctctttgacactcagccctcccacaagtgctgggctgcctgtatccgtcctgcagggtcgcctgcccagtgcacaggggcttgcactgtgtgaggaggcagcacagcccacccggcactacctgcaggataggttcttctttcccgcccaggtcccctggcctcctccctttgtcttccagctcctgagtttccaagcttagttagcgtggaagacagcagacaactgactggccagagtagcacagcacattcaggcaatcagtgtagcagctcaggggcctctgggaactggggctcagggaacccttcagggtagagggggcctctcactgcacccgcttgtgccctgtacctacctccacccaagcctctgacactccatagcacttacctgtttgcatgtctgtctagtctcccatccccatctgaagtctgagccccatgaaggtctggacccttttctctagagtttagtccaagaacaggtacttcaagtaaagagttagttgatggactgttggcaggaattaaattagtactgaggcccaccctaagcagggaagcagtatgaacagacttggggctcaggagatggtgagaagcccaggggtgctggagggtagtggggatgcacctggaagaaggctggggtctgctgctcctctttcacctgtctcattttaagagatgatttctcttaaaatgaagagacttctccatttcttattttgagagatgaagcccagtgacccccaaaatcagggtgttttcttctgaattctctgtctcagctctagaggctggaggagttgtgaggggcttagggatcacagtggctgcagaaggctctgaaaggagggctctgggagcgtgagatggatcggactagggagaggacgtcaggttggcctggggtctggttctgccttttctcggggcaggtcctttgccctccctgaggcttggcctctccatttggaacttagcatcctgattcccttcctgtcctgaaagtgtttttggaggagcttactgttctgagtattagggagatcttaataaaagcccatacattcctgatccttctggaaattcctgagtaattagcacctgtgggccctaggatggagcaacctgctgtcttctggggttgccctgggggctaccctgtagcttttggttggggctgaggcagagtagaggctcctgggctgggccctgagaaccaagtctgggattatttttactcttctgttcacagcgcatggcccagctccacgatgccatctgtcccccgcctccagctctcccctggcaggccctcctgggtcactgtggtgcacttggggaaggaggaggaggctggtgctggcttaccccattccatgagccgcagggcagggcggtgcgtgggagttttgcctggtggcaggaggcagctgccagccccgggatgtgggccgcgggcagataggagaagctcgccagtgacggctgtgaacctggagcaccagggacacgtggggctgggagcaaccccatttcggtaacaaaccctgtggcccagggccttggatgacctgctgccctgcttttcctgggacagacccaatcctagggacatggagtgcaggtcctcagaaaaccccactcgtggggcagggtctggcattaggagtctttggttctccccaggtgtgtgttctgctgggctgccctaggcccaacttctgcagggactgatggtgctcacttcaccaggccagtccagctcagcttgggtgaaggaaggggaattctgaggaggagcagggcccagagaccatagaaggggtcaggtggggtaagggaggtggcggccctcctttccgtctcctgacatcctggcctccaccgcaccctccacctgactcagggcatccatctgtacttagtgtcaggtccagaagaaaatctaggctacaaccaggacttaagaggcctcaggtattaaaatgattaattaattaagtattaatattaggcattagggcttcagactttctacttggcattgtttatggcttagtaacaatgaagacaataagaaatagctcttatgagcactgactgtgtcaggccctacgctagatgacatctcactatgtcatctctcctgcgggacagccttccgggatggatcagttccccagccttctgagcagagccacacatgaaagtctgcaaggtacttctagaggccactggagacttctgggatctggggagggagtgtgaaccacagatactgctagcacagaaaggaccctggatcccaaggagggcatccttcttgttttacagataagcaaaatgaggcccagaaaaatgagaggtggtttgtctgtggttgtgtagttggtggtagaactggaaccaaagccaggctcttgcttcccatacatcacacttccattctacaagcctccaaaataagccccaaagggatttatgcacaattcaagctctttttctggtatgccaaaatccagacatttcctgaggtttcttttgtttcccaaaactaagcacagagcaatctgttctccccacagagaaatcattattccacaataacacttaacaaatatcccttcgtttgttcattctgtgttcatcagctctgtgcagcgtgctgaggacttacagaggaagacagctgtccctgtccccatggtgtctaaagtgtggtggagaccagtccttactgggagatgggggctggatatggaaatgcaggaatctgctaaggttggagtcatcttcccagagggagtgacatatggctggaccttaaggctgagcaagagttggtccggtgaacaaggaatggaagggaagtttcaggtagcagcacctccaccaggagtggagaaagagcctagcatgttggggggtgatttggatggctgagtttggggcttggaggtgggttcaaagaaggaagtacagagggtggtgcctgtgtgcggaaggtatggccggagagcagggatcagcagatggaagcgctagaaaatcccatcatggagtgtgtagtgttatcttaagaacaaagaaaaggcattgaaaatttttaggtagcagaatcatgtgatcaggtttgcattttagaaaaatcactggctggggtgaagagattatggagcctgaatggggttgcaccaggtcatccagatgtgcatcgctggaagcttggattagggctgtgagatagagtagattcaggagacgtgtaggcgacagaaagacaggatgtggtcattagttagatgtgggagatattaataagagggaaaagtcaaaacagtcatgtgctgcttcacgaaggggatgcctcctgagaaatgtgtctcttggcgatttcatccttgtgcaaccataatagagggtccttacacaaacctagatggtatagcctacgacacacccaggctgtgtggtacaacctattgcttctgggctataaatctgtacagcatgtgactatactcagttctataggcaactataacacagtggtaactctaagtgttagtatttgtatatctcaacattcctaaacatagaaaaggtacagtgaaaataaaatataaaagataacaaatggcacacctgtatggggtacaccatgaatggagcttgcaggactggaagctgctctgggtgagtcagtgagtgaatggtgagtgaatgtatgctactgtaggcttgactgtacactactctacactaggacattactgatactactgtagactttataaaaacagatacttaggctacgctaaatgtatttaaaatgatttttcttcaagaatatattaacttggctttctgtaacttttttactttataaacttcttaattttttgattcttttataataacactttaaaacgcaaacacctcacgcctgtaatcccagcactttgggaggccgaggcgggtggatcacgaggtcaggaggtcgagaccatcctggctaacatggtgaaaccctgtctctactaaaaatacaaaaaaactagccagtcgtggtggcaggcacctgtagtcccagctgctcaggaggctgaggcaggagaatggcatgagcctgggaggtggagcttgcagtgagccgagattgcgccactgtactccagcctgggtgacagagcaagactctgtctcaaaaaaaacaaaaaacaaaaaacaaaacccaaaaacgcaaacacatcgtacagctgtacaaaaatattttcttaatttatatctttattctataagccttcttctgtttacaaaatcttttttttttttttttttttgagacggagtctcattctgtcccccaggctggagtgtagtggcacgatctcggctcactgcaacctccgcctcccgggtttaagcggttctcctggcctcagcctccctagtagctgggattataggtgcgcaccatcatgcctggctaatttttgtatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatagagaagggaggttggggggagaggaggggggtgagggtttacagggacgcgccgggtggagggaaagggagggggggggggcgatgggcagggggaggaggaagggtggaaggggggggggggggaggtaggggggggagagaggacggccgccccccggccgggggggaaaagaaggggggaagtggggtgtgggggggagggaggggggggggcgacggaatcaaaagaaggaaggtgtggggggcgggcggggagaagagaatgggggaggggagggggagggggcagggagggggggaagagggggggagagaaatcgggagcggcgggggcccagcctggaatcaggcatgttaagctgtgtggaaagcggtgtggaatttgtgaaaatcacaatttcagggccgggcgcggtggctcacacctgtaatcccagcactttgggaggctgaggaggaggatcacttgaggtcaggagttcaagaccagcctggccaacatggtgaaaccctgtctctactaaaaatataaaaattagccaggcgtgatggtggcacatgcctgtaatcccagctacttgggaggctgaggcaggagaatcacttgagcctgggaggtggaggttgcagtgagctgagatcacgccactgcactccagcctgggtgacagaacaagactccatctcaaaaaaacaaaaacaaaataaaataaaataaaaaatcacaatttcattgaatttatgatttatttggacagattcaacatcttcataatattgttttcccattcatgaacacagtttctctccatttatttaggtattatgacactgtgaaatacatactaggggtctggcgcggtggttcaggtctgtaatcccagcactttgggaggctgaggcgggtggatcacctgaggtcaggagttccagaccagcctggccaacatggcgaaaccccgtccctactaaaaatacaaatgcaaaaattagccgggtgaggtggcgggtgcctataatcccagctacttgggaggctgaggcaggagaatcgcttgaacctgggaggcagaggttgcagtgagccgagattgcgccactgcactccagcctgggcaaaaaaagctcaaaaaaaaaaaaaaaaaagatatattgggacttcattcagtgtcctgccatacaactcctaaaatccttgcaatcttcaaaacgatgtgtctttttgtatgctaatgagtcgatttagggcttgcagtccctaggtagcttcaggatgggaccagactccagaaagacaaagggcaggattagaggggtggaacttgcagccacaccctccaacctcagggaggcaagaggggctgaaggtcaagttgatcaccagtggccaatggtttaatcagtcatgcctatgtaatgaagccaccatagacacctagaaggactgtgttcgaggagcttccagaaagctgaacgggtggagggacctgaagggtggcgtacccaggagagaacatggaagcttctcgaaccgtcccacgtgccttgccctatgcgtctctatcctttgtgagatcctttagaataagctggtaaaggtagatagtgtttctctgagttctgtgagctactatggcaggttaattgatcctaaggagagggttctaggaaccccacctatagctggtgggtcagaagcacaggtaaaacaacccagggcatgggattggcatgggaagtcgggaggcagtcctgtggaaccgagcccccaccctgtgggatctcctggcttcaagcaaccctcctgcctctcggcctcccaaagtgctgagattataggtatgagccaccatgcccagccctgattttctcaatgaggctctttgattggtaaattctctattatttttgtctaaaaatgcctctatttaatcttcactcttgaatgattttttgtttgggttttaaattcaagattaacagatagtttcttttaacaatttggtgatgttatattgagtcttctagtgttactgttacgaagtttgctatcagtttgttgttattattgtttttgagacagaatctccttctgtcgcccaggctggagtgcaatggtgcaatatgggctcaccgcaacctctacctcctgggttcaagtgattctcatgcctcagcctcccaagtagctgggatgacaggcgcccaccaccacgcccagctaatttttgtatttttagtagagacaggggtctcactatgttgcccaggctggtctcaaactcctggcctcaagccatccacctgccttggcctcccaaagtgctgggattacaggcatgacccaccacaccagaaagaagttcaatatcagtttaatagtccttcctttctagataatctgccctttttcactcttcatgcttttaagatctctgttttgggtattctgcagtgtccctacgttatgtgttccttttatttgaatttatcctggttaggattcagcatggttcctgaattattggagtcatgtcttctattaatctggaaaattgcctgctgttttctcttcaaatgttgctctactgtatttattttctatgttctctttttctggaattctgatgttgaattgccttattctgttctccttgctctttactgtcatttaaaaaatacatctgggtaatttcctcagctctgtcttccagattgttacttctttatctagctgtatctaagttgttaatcccaaccattgagtttttaatttcagtgactaaaatgtttatttttaaatgtttgatgtagttctttttccagcctactttgtagttttgataatatcttattctttcccatatttacaattccttatttaggtcaataatcatttaaacataatctcttcagagattttcagcctgggaccactgtttatttttaagaattggctagaggttactaagcgatataaaattcaaatttcaaatccattaaagggtaggcccttggttacaaattcttttttttaagaattattttttatatctagaatttaggctaagacagataatctttttttttttttttttttttttttttgagatggagtctctgttgcctaggctggagtgcagtggcgtgatctcagctcactgcaactctgcctcccaggtacaagtcattctcttgcttcagcctcccgagtggctgggattacaggcgtgtgccaccatgccaagctaatttgtgtatttttagtagagaagaggttttgccatgttggccagactggtcttgaacagctgacctcaagtgatccgtctgtctcggcctcccaaagtactgggattacaggcatgagccacttcgcctggcccagagaacgcctggcccagagaatcttcgctgtcatattttgtcagtgttctactggttctctgaggatttaggtatagttcccagtttcagcttctctgcatctcttaggtctaaggtctcatctctgagcaaccattaaaacccagttgtgaccaggcatggtggctcactccatgggaggccaaggagggagaattgcttgaggctggaagttcaagaccagcctaggcaacctagtgagacctctgcagtaaatacataatctctacagtaaataaataattagccgggcatggtggtgcgtgactagagtcccagctactcaggaggttgaggcaggaggatctcttgaacccatgagttcagtgctgtactaagctatgatcttgccagtgcacttcagcctgggcaacagagcaagacactgtctctaaaaaataaaaaataataaaaatttaaagtgatgaaaaataaaaaaccagcttcctcattactaagggagctttgctcagtcgtttctaaatttatttatagagtgagagttttaaaatcatcttatctactatattgccagaaattaaagttggcaactcttttaagtagtttgtttcaggctgggcatgatggctcacgcctgtgatttcagcactttgggaggccgaggtggatggatcacctgaggtcaggaatttgagaccagcctggccaacgtggcgaaaccccgtctctactaaaaatacaaaaatcagctgggtgtggtgatgtgtgcctgtaatcccagctactcagtaggctgaggtgggagaattgcttgaacttgggaggcggaggttacagtgagccgagattgtaccattgcccaccagcctgagtgaaagagcaagactccgtccccccacaaaaaaaaagaagtttgttttggaagtatggaaaaatgttttcatgttcaggatagaatcaagaccagaatttctgatgagaataagctagtttattcccaaaaaagcgactctgcccccaaactctcatgaaaacttactttaacagccacagagacaacaggcaacacttgttacactaaaaaggccagtgactctgaagggctgagaacaagaccttgacctgcaccttggcctcactgcgcgaccttgggcttgtccttaggcctctgggcctcagtgcccttttcagcaagctgaaggagctgcttaggtttcctgtggtgggggttggggggggcggttcctgctttttttttttttttttgaggcggagtctcgctctgtcgcccaggctggaatgtagtggcaccatcttggcccactgcaacctctgcctcccgggttcaagtgattctctggcctcagcctcctgagtagctgggattacaggcacccgccaccatgcccggctaatttttttatttttagtagaggcggggtttcgccatgttggccagggtggtctcgaactcctgacctcaggggatccacccgcctcggcctcccaaagtgctgggattacaggtgtgagccactgcgcccggctggttcctgctttacgtgtcagtggctctaacctctttcccactgcatgtctgtgccagctgctttgccaagctccttttgacctctcctcctgggatgtgcctcccacacttagcccctccctcccctcgatcctcaccccctccctcacagtgcctctctgtgaaggaaattgtccttctcacaggccatgggtgggagatgaggggtttgagggtatggagggcaatgataagcgaggaatgctctgggaggtcccacttcagaggatccgaggtggaagtggtcgaactcaggggtttagacccccagcctgggtttgggctgctggactgcattgctcctcaaggctagtgggggagaagggacgggcaatgtgtgtgacgcggtgaggtcctcctttacaagtggactcggtggctgggatggggagaagttgggggctctgcgagggctgtgggaggtacgtggttcccagctggtactcataacccaaaaactgccttaagattactggtatgtcctgctccttcacaaacccctgagaactatgtttggaagcttacagcttggatggttggagccaagaggtcactggatttgtctcatgttaggggaaggtggggttgtgaccatgagcctccagaggcaccagaaagtcaatcctgccgttgctccagtgtgtgaggagctgccaagactgtttctttcagaaagagcctgagttgggaagggaacaggagaatagtgacctacattatattgtatatgcgtttttaaaaatttttcattgtggtaaaaaagaccacaaaatgtaccatcctaaccctcttgaagtatccaggttggtagtgttacgtatattcacaatgctgcgcagcaggtctccagaacttcttcatcgtgcaaaaccgaaactctgtacctgtcaagtcacaactctgtgtctttctcccacgagctcctggtaaccaccattctactctgtttctatttgtttgaccacttaagaacattttgtaaaaaaaatttttagtagagatgaagtcttgctaactcctggactcaaatgatcctcctgcctcagcctccctaagtgctgggattacaggtgtgagcctctgcaccctgccgactactttatttttattttattgtattcatttattttgagacagagccttgctctgtcacccaggctggagtgcagtggcgcaatcatggctaactgcagccttgacttcccaggctcaagtgattctctgccctcaccctccagagtagctgggactataggtgcgagccagcacacctggctaattttttttaaattaattttttgtagagatggggtctcccgatattgcctagactggtctgaaactcctgggctcaagggatcctcctgcctcagcctcccaaagtgctgggagtataggcatgagccactgtgcctggcctaatgtgactgcttagatacctcgtcagcggaatcatgcagtgtttgggttgttttgtaactggcgtgtttcactcagcataatgtcctaaaggtccgtctgtgctgcagcacgtgtcccggttgccttcctttttaaagctcctatttcgctgtaggtatacaccacattttgttcatccattcatccattgatggacacttggtttgcttctaccttttgactcttgtgaataatgctgccgcgagcatgagtgtacatatatatctttgagaccctgctttcagtttgtttgggtatatacccaggtattgggtcatatggtcttgctctgtcacccaggctggagtgtagtggcgggatctcggctcactgcaacctctgcttctcggattcaagcgattctccttgtctgagcctcccgagtagctgtgattacaggtgcccgccaccacacctggctaatttttgtatttttagtagaaacggggtttcaccatgttggccaggctggtctcgagttcctgacctcaagtgatctgcctgcctcagcctcccagagtgctgggattacaggcgtgagccacagcgcccggcctgtaccattttgcattcccaccaacagtacccaggattttgcatgctttttgcccagggtcgatttaatgtcagtgcatccccggcactgcatccttgtctcctacttttcagcccttgtctgggttccttgataccagggagtgcctaggtcattgtgctcattcgacagatgggaagatgagctctccagaggggatgggacctgttcaagaccccaggcctgattctcacagatctttcacttcacgctttgcttcctgagcaactgattcgggctctggcactccccggagtgccttcatcccgtggcccacgcagttcttccactgctcaccggggctgtggttcctgtccccacaggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtaaggagcccgtcgggttcagccctgtacctgaggctgaggcaaggggccgacaccagaaccttggggttcctgccgggccacagaaggggatgaccacttggggctttgtcgggtggacactgctttcttccctcctgggctcccaagggatgggggcatctgaggagaagcctgtgagggggtgtggagggtggggcccctggcggtgagcagagatgggagtgggaatcttggaaaaggcgaatctgggtggggtagaacatccccccagagcaggtggggagcaccccacaagctgtaccccagcaggtgcctgaccagcaggctgcccaccttggctgtgaaggatgctcactcatcccctctttccctcactcattcatgcaacaaacagatgccgagccttctgtgtgcctggtgtgggttagacgggtctagtcccagcctgtcatctggggtgagggtaatgtgagctcacagatacctgctctgcaaggcagcctggagagttcctaggagaggcagagtgctggagaccactcccctaggaaaggccccccccaacccagcagagggtcaccagaaatggcttgatctttgtgagtggctggggttgcagaacacagctgaaactgttcagcgatgcatgggaaggaccaagcagttggcatggggccacgatgacttttggatggaagagggggcatctggaaaaatgaagcaggggctgggcatggtggctcactcaagcctgtgattccagcactttgggaggccaaggtgggaggatcacttgaggccagcagtttgaaaccagcctgggcaacaaagcgagacaccatctggagtaaaaataaaaaaaattacccaggtttggtggtgccagcctgcagtcccagctactggggaggctgaggcagaaagatctcttgaggccaagaggtcaaggctgcattgagccatgagtgcactgttgcactcctgcctgggtgccagagtgaggccctgtttcaaaaaaaaaaaaaaaatgaagcaagaataaaaactgaatggctgttggaaggcccagataaggcttctgttcctgttggaaagtcctctaggaatcctagctcaaaacagtggtcttggggcaggagtgagagccctgagtgggtctctaaatggctgaagtcagtgacaacggggcccctgcctggcttccaacaggatggccccagaccagctgcccacccccacgggtttccattcatttctcccccacacccaacgctggtgccacccccaccattgttgcttggctcggcttccccagggtcgcccttacttctgggtcggccctctagactctccctgctttgaccacttcttgctctgatggttgcttattttttcctttttcttttctctctctctctttttttttttttgagatggagtttcactcttgttgcccaggctagagtgcaatgggcgcaatctcagctcaacgctacctctgcctcccgggttcaagcgattctcccacctcagcctgccgagtaagcttggattacaggcacgtgccaccactcctggctaattttgtatttttagtagagacagggtttttccatgttggtcaggctggtcttgaactccagacctcaggtgatccgcccaccttggcctcccaaagtgatgggattacaggtgtgagccaccgcacccagcttttcttttcttttcttttgtttttgagacagagtcttgctctgtcgcccaggctggagtgcagtggagcaatctcggctcactgcagcctccaccccgtgggttaaagtgattcttctgcttcaccctcccgagtagttgggtctacaggcgtgcgccaccacgctcggctgattttacaggtgtgagccaccatgcccggccttgcatctgtatttctaaataaaatacttgaatgtgtttgtggcagttaagataaaatttgtctttaacagatcccaaataacagtggcttacataagggaaatttccttctctctcctataaatgtctggagggtaggtagtccagggaaggtgtggcagctctgctccatgaagctctcagggacccaggatgcttccgtcttgtggctcatgagcatgccttccattgtgaatgttcccttaaggcccaagcagctgcttcagctccaggagttacattgcagctagcagacaggagaatgggatgaagaagagtgacctggatacatttaaggaagacactgggaaactaacccctgaaatatttactggccagaactcctgtgaagtcccttccacctctacttgtgaagttctgcttcttacttttagcgcctggggaagcgtcatgggggagacagctgtgtgtggagcacctgggggtgcctggtgtggtgttcggtgctttgcagaggttgttgccatttagccaggagggacgcagcctctgggaccccccgggctctgctttggtggaggaggggatgggtatagattgtagcttaggtgtgaaatgagaaagggcagggggagtgtagggaagggcaggtggcttggctggggagctgtggtgtatgtcctggacccttcacagggcaggtctgtgtgctctagagacagaggtgggccggaaaacgaaagtgtgcatgaggcatccagcaaggggcaagggcggagggcgctgtgggtgtctgggagggccccgtggagatgctagaatgcactaaatcaacagacatttgtggagttgagcacccctggggaccaagggctttgaggacttgctttttcggggggggggtgtgtgtgtgttaaaaaatacgtaacattttccattttaatcattatagtttttcagtttataatttgatggcattaaatatattcacattgatgtacagccattactaccacccatcgccagaaatatttcatttcaaagtgaaattctttaccttttaaacaataattccccattctcgccatcctccccgccctccagccctggcaactgccattctgctttctgtctttatgggtctgactcctttagttacctcatgtaagtggaatcatacaacatttgcccttttgtgactggctaatttcacttaacacaaggtcctcaacgtttatctgtattataacctaggtcagagtttccttcctttttaaggctgagtaatattccattgtatagaccacattctgtttatctgttcatctgccgacagacatttgggtggatgcttagttttatttagttgttataggtagatatttctgtccctgcttcacatataaagatactggggttaagagaccgtgaccaaccctggggaagcgccgggctgtggatctctggcaggacttgggttggaattctctttggcaggagggaagccactgactcagggaagcagactgaaaatggtttggcaaactgtcctggccgtgttggcatctcggatgctgctcctcccctgtgctgagacccagggaggggcatgggatggggacgctcgggagggcctggaggaagagtgaggagaggcagaggtgctgcttcactgtgcttcataacacgtcagcgctcccagcatcctgggcatctgtgatctttcggtcctttcaagggtcccttcaaggagggaggaatggcacctctgcttgcagatgcagaaatggaaattcagggaagccaagagtttctcccagtctctcaagttggaagtggagagtggggctttaacccagttctcctgcctccgagcttggcgttcctctgtcagctgaatggccttgctcctccactgcctggccctggctccaggtgggtcaggccctgggcagggccctggaggctgtactgcaggctctgacaaccgcccagcccccacagcacctgtcctgcatgagaataggttctgctgggatccagacacccgctcaccccgtctcttcttaccagtcccgggggccgagccaaggcaggactgcgtggggactgatggagggctctcagcaggcagtgctgaccagcccggctgggagctatagatagctctgagctcacccccagtgtgtgggatgggccctctgggaggcggaatgggaggccgagctgagagctgactcagacctcagctcaccgtggctgctcccctcctgtcttctcatcttcccttggggcatctgcgcttcccatcctctgtgtaccccagccccattctgagcccccagctgcttctagcatccccagagctctggtcttttctcccccctcacttccctgcatccaaaggccaccagcccctttccaagtgggccggcccggtggggtatggggtggggctaagaggatgattcccgacctggggacccggccttagctgtttgaggacaggggttaggcctgctccgagctccgcccacggaacatccagcataggacacgctgaccaaggccaggcagacatgcagatgacatgcaaagcagcacggcagattaacacctgctatttctgagctgagtctcccacgcttgttggctccggccctccccttgagcacctcttaccctcctgggccggctcccgagcccggggtgcttgccttctcctgctcacggccgctttcatttctgccctgtcactgtgtgaccctccccctggcacagccaacgctggccaccctgacctcctttggccaggctcacagtcggcctagcctagcgtgcaggtggtgggattcgaacaacttctcgcccccttctgcctgctccccgccttccccgctcctcacactcagtgctggccgggtgggctcgtgtcccgcctcctgctctctggagggctgtggctggctctggggttccctctgcattcatccctttctgcctcctgtgcttctcaccttcctgaggttgctcttgactttcccgagtcttcctgcctcttttccctgcctctctctctgcttctcccctcctgtgtcccaggtgggccatcctattagcagcccgtcagttctcattaagtgaccaccccacactgggcaggccgggctgaggccgtgtggtctctgctctccacaacttcatggtctaatgagaggggcaggaaaaacttctctggacagttagccacccaagcagacactggggttgtccacagccgatattaaccagatttatcttgggagttttcctgaaggaagcagagctgagggtgagtgcttgtcttggtctgttttctgttgttgataacagaatacctgaaactgggtaatttataaagaaggagtttattccttacagttacagagactgggaagtccaaggttgaggggctgcatctgtgagggccttcgtgctggagggaactctgcagagtcccgaggtggtgcaggcatcccgtagcgagggggccgagtgtgcttgttcaggccttttcttcctctgagacagcccccagtcccactcctgcgctctgttagcccgttaatccctgagtggattaatccatcgtgaaggcagtgccttcagggccatatcactccttaaaggcccacctgtccatactgccacatgggggattacatttcaacatgaattttggaggggactaatattcaaaccatagcagtgctccaggcaagggggtggagagattgtgagcatcagtctagaggtgagacttcacatggtgggtttgggggaccctggtggaggatctgggcaaagcactgttggttcgtcagactgtcagaggtgaagggattccctcgttttctggatgagtcacacagctaataagaggcagaaccgggaccagactcagcctgagtttgggactagatagagcatgtcgagggtcttttcacaaaggtgatgggacagaggtcacggagtttcacctgggctcctgccccccacttcttcaccatggcctcatttgcaggattctctgctcctctttgctttgttgccctgtgggtttccagctgctcctatgctcctccctgcggcctacaaccctgacttcaggtgcctggagacttgatgacgggagtgttcaaatctactctgtccctgagagctggcgtgaccttgggcaagttatttaacctccttgggcttcattttccttttgtaaagtggaggtcataatactactacctttgtgggaggtgttttggtttatttattttattgtgagaaaaatatacattatgtaaaattaaccatttaagccatttttatgtgtacaggtcagtggcattaagtacattcacctttttgtgcaaccatcatcaccatccatttccagaacttttccatcatctcaaatagaaattctgtacccattaaacaataattccccattcccctctgcccctatagccgctggtagcctgttctattttctgtctctatgatttgcctattctaggcatttcataaaggtggaatcaagccagccgcggtggctcacgcctgtaatcccagcactttgggaggccgaggcgggtgaatcaagaggtcaggagtttgagaccagcctggccaacatggtgaaaccctgtcactactaaaaatacaaaattacaaaattagccgggtgtggtggtgtgcatctgtagtcccagctacttcaggggctgaggcaggagaattgcttgaacccgggaggcggaggtttcagtgagccgagatcatgccactgcactccagcctgggcaacaaagcgagactctgtctcaaaaaaaaaaaaaagtggaatcaggccaggcgtgatggctcatgtggcttatgcctgtaatcctagcactttgggaggccaaggcgggcagatcactcgaggtcaggagttcgagaccagcctgaccaacacagtgaaacccgtctctactaaaaatacaaaattacaaaattagctgggtgtggtgtgcacctgtaattagctactcgggaggctgagccacgagaattgcttgaacctgagaggtggaggttgcagtgagctgagatcatgccactgcactccatcctggatgacagagtgagactccatctcaaaaagaaaaaaatgtaatcatacatatttccccttttatgtctggcttatttcagttggcataatgtccttaaggttcatccatgttgtagcgtgtttcagaatttccctcttttttaaggctgggtaatattccattgtatggagagactgcatcttgcttatctgttcacctgtggatagacatttgtattgcttctactttttgactactatgactaatactgcagtgaacattggtgtacaggtatcttgagtccctggtttcagttcttgtgggattggaattgctagctcatgtggtaattttatgtttgagtttttgaggaaccaccaaactgttttccacagcagctgtatcagtttacattcccgccagcaatgaacaaaggttctgatttcgcatatcctcatcagcgcttgttattttccattttttggatcatagccatcctagtgggtgtgaagcgctatctcatggtttttgatttgcatttccctgatgattagtgttgtggagcatctttccatgaggttattggaataagacattgccttctagtgttgtcgtagggatgagagcacacagtaggtgccaaatgcacagcacggggtgaggggaacacgtacctgccctcaaggaactcacagtgtggcgggggagcatgactaggacagacaccgaggcaggaatgggcatgccctcttgggtggggagcagtgcaagcttcttggggcttcctggagctgtggccttgaagcctggctgatttcaccagaagcctcagagccctccagggacaatggtaggaacagctcaaatgtcaggcccaattgctgccttctcaggcttcagtcagaagttccttctccacaaatagcctccttctccagccccaggtgtttatggcttcagttgatccctggatagctgcacccccaacacacacaccctggcccccgcttccaggccattggggattagggtggggcagcaaggatgtgcccagcctcctctccctgagccccaacctacaggggtgcagtgtggcacttgctcactccaccagaggcctacagtgaaccaaagatgtccacgcacacttccacccactcttggttggggaggcttgtgctctcagctcctcagtccttttcaagtttgaaagctaatagcattcgttataatagggcttcgttaacaatattaacagtaatcgctgaccttgctggccctctgctgagtggtgcgtgctttacttactccatgccatttaacagtttatggtctagggggtgggctgccatggagagaggggactcagcacagaggaaatgagatacagaaatgacctagcccaggcaggattttgcagctggggtaacgttttcagtggtgctatgtggcggaggtggccggcagggtgtgtgtgacgctgagtgtggggctaggagaaagcggagattcctcgtggatgctgcatcaggaatgctccaccctcagcctttaggccaaggctcctgtttctccacgggcagccttcgcccccggtggggtggggccgtgggtgtgagctgggggctgtcggacacatgtgctctgacagatggacagatgggcccacagtctggcaggggtgtccttcccatccccacccaggccggccctggggttggccgaggccacctgccacgttgcaatgcgcagctgcctgactggcctcctccttccccagcctgtgttctcagccaccagagggagaagcctgtggttatgcagctaggggcagagctgggacaaggacaaggacaagcccctcccaccgccaccacctcagctgggtgctttacaagtttctcactgccatggcccttctttgccggccttcactgtggttcccacgctctacctgtaggcccacgctccctactcccttcccctcttgcccctgactctgggggccttctggtgtctacatgatccaggatacgctggctcccaccagctgtgggtaccactgtccatgagtggtgggcaggacctcaggtccaagtagttggatctccctccgggaccttacctcatgcagagacttaggaatcggggggattgatccaaagggaaggagcagcatcgtcccttgcggaggaagctcagccctgtcgggggagcatatcctggggggaaatagccagcatgtaatactctcgaagcactggggcagccttggaaaacataccttctcgtggtgcctgggacactagcaagccatgagactgtgaataagtcatttcccctctctgggcttccatttcatcttcctcaggctaaacaggacctctagagtcacgtggtccagccctgcttctgagagaagtgacctccaattccctgttcattcggagtggtaccatgcagtagccacagatgggcactggcaccagactacatggacccgaatctcagccacatgcttgcctacgaccctgagaagatttctcaaccttgctgtttccctgtctgtagcgtggatgacagtaccaccctcatttagctgttgtgaggatcgaaagggtgaatgcagataaagctgtcacaggatacatatctgtatccgcacagatacttgtactgatgaggtatgcagcaagtgttcattgtcatcaagattttcacaggagtgacaggccacggcagctccctctgtgtgtaaagcctggattagatgccagctggcctggaggcagggagatggctgcgttgacctctagagcacccctggtggcaggaaggaagctgcttgggtccccttggctcacacacccacagacaccccacacttcactccctcacggggggttctcaactgccggcatcacccctgaccagcacaacgaggctggagggtctgagatgagccagcaagggagaggaggaggaagctccacagacagccagggaaaagcacaactttaacaaatacaaacctggaggacagtatgccaagtgaaatataccagacgcagaaggacaaatgccgagagggctcacttagaggtggaatctaaaacagtggtgctcacagcagcagagagtagaatggtggttactggaggctggggcgggcatgacggggagatgttggtcaaagaatatagtttcagttagatggggaaatgtttttggtttctagtttttgtttttccgttttgtttgttttagacaaggtcttactctccctccctggcagaagtgcagtggtgtgatcacagctcactgcagcctcaatctcctggactcaagtgaccctcctgcctcagcttcctgagtagttgggactacaggcatgtgctaccacgcctggctaattttttatttttatttttattatttttatttattttgtttgtttatttttttttgagacagagtctcgctctatcgcccaggctggagtgcaatggtgcaatctcggctcactgcaagctctgcctcctgggttcaagccattctcctgcctcagcctcccgagtagctgggactacaggcgcccgccaccatgcccggctatattttttttgtatttttagtagagacggggtttcattgtgttagccaagatggtctcaatctcctgacctcgtgatccgcctgccttgcccacccaaagtgctggaattataggcgtgagccaccgcacccagacttatttttatttttttgtagagatggagtgggtttcactatgttgcccaggctgatcttgaattcctgggcttgggcgatcttcctgcctcaggctcccaaagtgctggggttataggtgtgagtcatgacgcccagtcaaggaggaatgtttttggagacctattgcccagcatggtgactgtagcgaataataacgtattgcatttttcataagttgctaagaaagtaaatttcatgttctcatcatgaaaaatgataagtatttgaaatgatgggtatgttaattatttgattcaatcattgcagattatatacgtatatcataacatcactttgtaccccataaatacaggttgagcatcccaaatctgaaaattcaaaatctgaaatactccaaagttcgaaactttttgagatgtgtgcctcgaaggagatgctcgttggaccgttttggatttcggattttaggattagggatgctcagctggcaagtatatagtgcagatagcccccaaatttgaaaaaaaccccaaatctggaacacttctggttccaagcattttagataagggctagtcaaccagtatgtacagtttaaaaaaagaaagaaaagccaggcgtggtggttcacacctgtaatcccagcactttgggaggttgaggtgggcagatcacctgaggttgggagttcgagaccagcctgaccaacatggagaaaccttatctctactaaaactacaaaattagctgggcgttgcctgtaatcccaactacttgggaggctgaggcaggagaatcacttgaacctgggaggcggaggttgtggtgagccaagatcgcgccatttcactccagcctaggcaacagagcgaaactccgtctcaaaaaagtgaaaaataaaaataatcaaaaataaagaagaaagaaaaaaaatacaaagatgggccgggtgtggtggctgatgcctgtaatcccagcacttttggaggctgagatgggcagattacttgaggtcaggagttcgagaccagcctggccaacatggtaaaacctgtctctactaaaaataacaaaaattagccaggtgtggtggtgtgcgcctgtaatcccagctacttgggaggctgaggtgggagaatcactggaacccgggaggtggaggttgcggtaagccgagatcacaccagctgcacttcagcctgggcgacagcgagactccctctcaaaacaaaacaaaaaagaagacggctgagcttgccttagaccccttggtgtggctcctgtcccgccccattactagcctctcgccgggggctgagacggcctttctagcagcagagccctggaaccttgtggcagagggtgagggtagttgtggggtggtgggcaggggctccttgcagaggctgagtcctctgtgatgtttggggttagggtctcagctgatgggggccaaggcctccctactgcttctcaccacaggctgcagaggaagcagcactgttacggggcagtcctgcctgatgagaggaggttccattaactaagcatcctcgcttggccaggcctcgggccatattcaagcacctgagccaagagtcacacctgggcagttagtcctaggtctgctgtgggtgatctggtgcagttctctggcaaataggtataattacctgcccactgcagggaggaggtggatttactgtgaagttaatgaggtttacgcgttaggacccagcacttacatgggccccttccaagtccctaaacttaatttttgcttcattgaagtataactgacattacaacaaactgtacatgcttaaagtggccaagttgatacattttgacagatgtatgcacctgtgaagccatcaccaccatcaagataatgaatgtgtccattgcccccaagtttttaacctaattttgtatttttaaaattctttttcccaaagggagcctcccaattgctaaatgtcttaggcctcacaaaagtctgggtttgctcatgtacagaaaagttcaatgagaccaggataggacagcgccttaagagttacgtcggactaatcagaagtaaaaggttatttgcatgtatttaacttactcctttgtcttagaaggctaaaacagttacgggacatctgaccagcatcttagcattcattccctcatcattcaggcagcaagtatttattgagcgcctacaatgtgcaggcagttttctaggtggtgggtataaataagtgaataaatagaccaaaaatccctattcgcatggactgtggttctgacgggggtgagggcacagacagtactgaaataagttagattatgtattatgctagaaggtgctgtggaggaaagtaaaggcagtgggtgccagggtgggcgggtaggagtatgatttcagccctcagtggggtggtcagggaagagacagtggcacccaaggggtgcaggtggtgtgggactctggggcagagtgttccctggaggagaaacaggaagcacaaggaccatagtggggcaggtgtgggcctggtgtgtttcaggacagcaagaagtttaggatggatcgggtagactagatcagagaggtgactgaactggggtggccagatcctgcaggggtttccaggccgttgtaaggacttggacactgttaatctggggcagatggaagccattggagggcttttgaatttcgatagggtcgctgcagctgctgtgttgagcatagacttggagcagggaatacaggtggaaggtgatgatcctaatccaagtcagagatggcgggagcttggaccctggagggtgcggtggtgcacagtggctgtatgaattctggatatgttttggaggtagagccacaccagactcattcattcattcagtgagtaggtgccaggtactggagatgcagacttgaatggaggcatagtctcttcctctgagctgttgagagtctaacaaggaaagacagacatggataactgatgagcacacgatatcctgtgtgcaagggacgggccagaggagcaaccaagaaccgtatcccagatggtctgccatccccatccctcctgctacaccgtcacccacttcgcagctcttgggaacctctcttcttccctcatgcttttccttgcccgtagactagtctctgagctgggttacttacttgggcctagagcatgttcattttaccgaaaaggatactgagccacagagtgttctcactgagccagcgttgaggtctgtttcctacatctgtagaaatttggaagaatctgcgggaaaaaccttaaaggaactagatttaagaagagacggctgggctgggtgcagtggctcacgcctgtaatcccagcactttgggaggctgatgcgggtggatcacttgaggtcaggagttcgagaccagcctggccaacatggtgaaactctgcctctacttaaaatacaaaaaaattagctgggcatggtggtacgcacctgtaatcccagctacttgggaggctgaggcaggagaatcgcttgaacccgggaggcggaggttgcagtgagccgagatcgtgccattgcacgccagcctgggggacaagagcgagacttcgtctaaaaaaaataaaaaataaaaataaagaagaagagaaggctgagtgaaagtccttaaagggaagagacttaccgtgctcccaaagctcattggtggagctgccaggctctagcctggctcaccagctcccaggtctgtggccctacttcattcacccaccggtgatgacttagacccgagatgctgcatgggtggctttagttagacctggggtagaactgtcgaccgttcactggaccgccaaagcctttccctagaaagctttgagaggagacatcttgtggactcagggtttcaggtgcagatcagaccacagacagtgtccccagactccgattctccccccactccttcctctgacacagacgaggcagtggtcccaggccagcacaccttttctggcagacagtacctctggagagtagcctcgtaattcggccttggcattggggaaaggtcagctggggggtcagcttggccttggccgtgcactctggttacaacccaggtggcaggcagcccactcccctcacctccccgggcatcagcagctgcctcccacggacagccgcaagccctcccggttccgcagcacagggcgggctggcacctgctccctctgatccccccactcaaaccctcttgctctgcctctcctcatccgatgcttctccgtatggtttaacactagccaggggtgaagggccacccaagggcttgcctgaccacccagcccgaactggcccccggtcctctgaacacgtccctgtccgtagcacccctggattccattgtgtgggcacatgccgctcctgaactaggtaatgctttgaaataaggaacccctttccatcatctttttcaatactggaaaccatggatgctctggggttttccaggatgcttcaggcgtagcagcagtccctcgggggctgggcccatggagagtgctcaaccttccttgttgaggggtctgagtcagccatggggctgcacatgtgcactgactggcttttctttatgagcggacgggctcaggcctcctctccagggacactaagtgtctccagcagttgcaccccccatgcccgctgctgcctgcagacaggacaagaagtctggacgcttctactcgtttacagaggcggagggcacggtggcagtcacacagggcaaggccgagggccgggcagctccctggagcctcccaagtgtgaagaaggcccaggagaaagtgtggggagaggagaggaggccgccagcgctgggtgaggaacggtaccgggggtcaagggaggctctggaagttcctcaggctgtgcgtggttggtggccacgggccctgttaaccttgttctcgggtttcagtccccacagtgaggccttgtcttcctctcgctgctgggagatccctgtgatccagagagggaacccacagaatcctcaccccacaaatccgcttaggatgggcagagagtgagggcagggctcctccgcagaaggtaccccgcaccccctcactgcttccagccttttgtccttctctccactgagaggctgctggtgtctctgcaggtcggaacgagctgattgcccgctacatcaagctccggacagggaagacccgcaccaggaagcaggtgggcctcaagagacgggtaggggtcccgggggtggtaccccagcaccagtctgctcccaaggtgggccaggccctcccaggaccagacgcaggcttttgaggggcggcagctctggatgagttatccctgttgggcgtgtcacaggtggtccagttttctttttctttcttttttctgagacggggtttcactcatgttgcccagactggagtgcaatgacgtgatctcggctcaccgcaaccttctcctcctgggttcaagtgattctcctgcctcagcctaccgagtagctggggttatagtcacccgccacaatgcccggctaattttttgtatttttagtagagacggggtttcaccacattggccaggctggtctcgaattcctgacctcatgtaatccacccgccttggcctcccaaagtggtaggattataggcgtgagccaccacccccggccgggtggtccagttttcttggggtccctgctgccatcacttaggaggaaacccctcgcctctctggaaagtcatcagcccccatctcatccttctccaggacactaggacagacagtaaaacattggcactacttttcttttttgttgttgttgagacagagtcctgctctgttgcccaggctggagtgcagtggcgcaatctcaactcactgcaacctccgcttcccaggttcaagcgattctcctacctcagccttccgagtagctggaattacaggcatgcgccaccacacccagctaatttttgtatttttagtagaaatggagtttcactgtgttggccaggctggtctcgaactcctgacctcaagtgatccacctgccttggcctcccaaagtgttgggattacaggtgtgagccactgctccctgccggcactgcacttttgaaatactgccggtttctggattagctgggcaaggcaggactgagggcccaccagttgaccctttcattcattcattcatttggtccacagatgtgggttgagggctgtggagggcgagagtcaggaagccaggctggggaacacaggttgttgggaggtagagacaggagtcctctctccctgccacaggtctccagccacatccaggtgctggctcgtcgcaaagctcgcgagatccaggccaagctaaaggtaaggaaactgcagtgggggtgctggagtggccaggagtggtggccagcagcatatcttccctttggggtcagggcatcactgctggtgtgcaagtcagtgtgcttttctctctgttgaggagagccaggttgggcctgtaacctctctcccatccgcacaagagggccaagtgtgtggatgcctggctccccacaccctgggagctacaggccaggctcctgctgggatccccccttgctggctcctgcttagaggggctcacacggctcagagcagccggatcacccaccagccctcatttcttgagggcccctcagtgccctcgaccagagcatgcggagtggcaggggcatgggggggtgcctgctgtgggggtgggggtggcgtttatggtactgtgggagctggcaaattccttcctgcttcctgtcctgtgggactgggtgttccttcccttccctgggtcagccccgtcttgcagggcctctgctgataggtgatggctctggggggcctgatgttgctggcattcccctcggggtagccctgctccccacaggagtcaggcctctgggaccctggaaccaggggcctttgggtgaacactgggagggagtgagctctccatcagggaggtgatgacgacagaggctacacagcaagttggtgggaagatctgacatttgaggcattaagtctagaccatttataaacatttttatttatttatttttagagacaggatctgtctctgtcacccacgctcagtgcagtgacgcagtcatagctcactgcagtctcgacctcataagctccaatcacactcccacctcagcctcctgagtatctgggaccacaggcaagtgccactgcacggccatttttttctatttttttatagagatgaggtctccctattttgcctgagcgggtcataaacccctgggctcaagagatcttcctgccttggcctctcaaagtgctgaaattataggcatgagccactgggcctggcctggaaacatttttttttttttttttttagcaatgtagccccttttcttttcttcccccaacaaaatatcaccctgatgtgttatcagaggagccgttctggtcaaagctaggttggcaaagctcctctcctcccgcgcatcctttcccaccccatggaacttgaactctaggggacctcagaatccagtttaaaagctactgggaggccaggcgcggtggctcacgcctgtaagcactttgggaggccgagttgggcggatcacttgaggtcaggagttcaagaccagcctggccaacatggtgaaaccctgtctctactaaaaatataaaaattagccaggtgtggtggcacacagctgtaatcccagctactcgggaggctgaggcaggagaatcacttgaacctgggaagtggaggttgcagtgagccaagatagtgccactgcacaccagtctgggcaacagagtgagactccatctcaaaaaaagccactgggctagctgggcatgcacgcctgtaatcccaggtacttggaggttgaggccaggagttggaggctgcggtgggctgtgattgcacctgtgactggccacttcagcctgggcaacattgtgagaccccatctctgaaaatattttttatattaaagaaaagccactgaattagatgaccttgaaagtcccttctggccctggcagttcatgatcctgacactggaatctcagaacgagtgggtgggaaccacagacctttctgcctcctaggaagccacaccccactgcccactcagttccattcctcctgccatcagcccagctgttccccaagccccacagctgtggcctggcacctcgctcctttttccctgggacagctgaccagccctcagctgttgctcccgcctctcagcctcagcttccacagccatggaacccagccctgctccctgtttcccctctttcgtctgcctctgactcaccgggaccctgcagatgaccacggtgaacagacttcccactactgggtttagggcaatcccttgggggccggctgtgtggcccacatttgcttcagggaattgtacttgtccttgtccacaggttctgacctggggcccaaggacagccttcagtggatggctggacagacaccaaggggagccataaactccttaaaatatgcaaattttcatgtatatgtgagttgccttggagagattgctgtgaggattttgtcatattctcaaaggatctagaacccaaagtgattaagctctgggttggacagtgatccaatagaaatccctgagtgagaggctgggtcctaggcctggctctgccccgtggccgtgagtgcttgggcagagtcactgggacctcctggagctccagtttcctcatctgtaaagtgacaggcgagcaaggtgacatccaagttcccctcccggccccggttagtggctccctggctccattgcccggctactgctgtcactccccatcgggtccttcccacttcctctgacccctgccccaccctgcccaggtggcggtttcctgagccccagccgtttgtttagatcgagtatccaggaaggcaggcactgagtagatgcagccccggcctcgtgatggagttgttaagtgccgaggtcttcgggctcgcaggggtgcgcctgccaagtccctcatgccctcctgcggggagaggtcgggggctggcctgggcactttcctcctgaaaattccaagtgtcctgggaggagacacacacttagacttactagttagctccctctttggttatcagagacagcctctgagagcaaagcccaagtttggccccaaaaggacagtggggagggggccaaggggggccagggacaaacctcatctatttcactgctttgtccacatcgacaatgacccactactcggaacagttccctactccccaccgccctctatggtgcgtctcccccgaccccttggtttgcatggccccccgtgtgccagtctggtccaagctcacctggtcaccatcaccactctcagcaccctagtcacccaaattctcagagcctcagtttcttcatcttaatgatcctacaagtcctgtcagtctcacaggactcagtgaggttgtgttcttgaaaaccttccgtgggctgcctcatgccacatgggtgaaatggtcaccttgagaggatgagtggaagggcctgctgtgttctggcttcacacctgcacggcaccaggatggcgggggagcactgagcctctctgagcctccctgagcctccaggccgcggtgctgcccacctcatggagctgcgtgtggaccgcgtggaggcatccctcggaagagctggcgagctgcagggctcaccgttgcttctcaacttctgtttttagtttgtgttttagagactccactctgtcacccaggctggagtgcagtagtgctgtcacagctcactgcagcctcgacctcctgggctgaggccatcctcctgcctcagcctcccaagtagttgggaggttctcaacctttgtatcacttaagggagatccaggtctaccaagttaattattattagttattcaataatggttttatctttgtcattaaaaaaaaattcatgggtgggggcggtggctcatgcctataatccagcactgggaggtcgaggcaggaggatcacatgaagccaggcgtttgaggccagcctgggctaatgagatgctgtctgaaaaaataataatcatcataaagatatttatttatttatttagacagattcttgctccgttgcccaggctggagtgtagtggtgcaatctcagctcactgcagcccctgcttcccaggtttaagcaatcctcccacctcagctccttgagtagcttggcctgcaggcacacaccaccacacctggctaatttttgtattttttgtagagccagggtttcaccaagttgcccaggctggcctagaactcctgggctcaagcgatctaccaacctcagcctctccaggagctgggattacaggcatgaaccaccacttccggccaggtatcaaatttctaatcagagcccctgagttgactcagtcgagccatttagccccgataaagctgcagacagtgaataatacttgctgttccagcccgtgtgtgtgtggtcttattttggataatccctgctgggtacagtaacgcatgcccatggtcccagctactcaggaggctgagatgggtggatcatttgagcccaggagtttgaggctgtagtgagccatgattgtgcagtactctagcctgtgcgacagagtgagaccctgtctctggaaaaaaaaaaaaaaagaagaagaaaaagacacagtttccattaggcttcttgaaatagggaatgttgtgtcattggttttgaagacctttggaattcgggcactcaggatggaaaccactggcttatatgaatataacaaacgattactattgttacccgtgccatccaagtggctttccctgtgtgcttatttgttccgggcctattcagggtgaacccatcctctggggtcttggaacctttggagggcagacagtgggtatttacactctgacacatgaaagatgggtgagtcccaggtgcctacagtgcccagggagatccttagggcaggactgaggcaggaggggccacaggaggtggtctcttgcctccagacagcccgtgtggccagggatgatgcttcctgtgcactcgaggagggatccagcagatattcatgcatcgttttcacaagacaggtgctgagctaggcacctgtggtagagaggtgagcaaggcatagaaggtggccccgtaattaataaaatgacagataatgtctctgtaagctctgatgaaagaagcagggcaagtatcatgcccctttgacagatgagaaaactgaccagagaaaccagctgactttctcagttgcaaaacaagttaatagcacggcacagacttaacgcctggtcccccagctctggccactggcagcgagacagcttccctgacccgagggccggacctgcctggcctcagcctgactagtgaccctgctgaggtcctcccttgcaatgtctcccccaggaccaggcagctaaggacaaggccctgcagagcatggctgccatgtcgtctgcacagatcatctccgccacggccttccacagtagcatggccctcgcccggggccccggccgcccagcagtctcaggggtaagtgggctgccgagagctggaggccaggccagccctctcctcctccctcctccctgttcagaagagccagaagcattggccagcccagatttctctcacctgagtcctcttggccagggcagtcagggaaggagggaacaaggacccaagggccacacacatcccggcttggctggtattgggacggctttcttggggtcctcggcaatgactccacagacttcacaagggggaagggggagcttccaggagctgaccacctggtagctctgccatgttggcctaatttacagatgaggaagctgaagccaagggggctgagcggaagcctgagaccagcatgtacctgggcagctcgtgccacgcagcctcattcctgccctcctgccaggtggagagctggtgccccaaaaacaaacccctggtcagattttaactttcccagccatgaccatgttggccacactctcagaatgatccagaaaggccccttttcagagctgtctcctcacaggggctttcttggctccagggactaaatgagtcttcaaggcacctgcagcaccgccctaggcacgtggggaaggggcagtgccaggccacagcatttttcaaagtgcgtcccagagagcactagtccatctgcatgttaaacagataggacacagtggttctgtgagtaagtttgggacccttggcattaagtgggttcttggcactgggacttttctgagccttaggtctgcactgtgactctgcaggagttgccctgtgctgtgtggaccacacctgggtgcttttcccatggagcccctcctccacagggcctgagagccccctgaaactcactctgggggtgctgctgtggcctgttagcattcactagctaggcgaggcctcgggctccagcctctcctcccagtggaggccctgcccggtcctacccccacccccacgccacagggccccgggtgcacctggggccgtgctgattccatgccttttgcctcctcagttttggcaaggagctttgccaggccaagccggaacgtcccatgagtgagtatggcctctggtttctcttgccagttgctccctgaactgaacttgaacccataaactcatggcattaagcctgggccccagggtgtgctggggccgctgctggggtcggcctttcaggatggctctgagctcagggattgggctcttctactgtcagccatcactgggctcatctgtgatgtctacaccctagggtggtatttgccaaaactccagtctgtccagggtataggcagggccagagctggggtcccccaggggaggaggctgggaagcagacctctggctggcctgggaggaggagagggaggggtggatttcttcagcagacacgctgtgtctgtggacccgccacgaaacccaggggagtcggcaggggcgggagtaggaggccaaggcccatcgggaccactgaaatccagaccaccaggacctaccacacagaccactggacccagtgcagggatccggggcggtggcctgcccgaggctgacacctcccctcctctctctcccgcagtgtgaagcctttctctcagcaaacctatgctgtccagcctccgctgcctctgccaggtgggtgggcgctgcgtggccccctttctatcgcagccatgtggctcctgcctctgggtccaggcccccggcagccgaacgcctgcgtgtccctgttagatgctgccccgtcatgcacactgaccacacgtcctagtccctggccacaccccattcctttcccccagcatgcacacctcagccgtgtgccaagccccttcatgcccctcgggttgccttgctcctgtcccctcaaagctgtgctcagggcttgtggggcacgtgcagttccaagggcagtgcccgtgccctggcggctgccccacttggccggccttgttactgcagtgtgcctcacacacctggtcctgggagggccgaggggtgtctagctcaccagcctggagcccctcccgagaagagggacccttgtgggagaagacctggtggaggcagccagcggtgctgacaggagcccccaccccgccctctcactgacaggctctgctctgtcctcgtctctttctcaggaggggccctcaccacctcccactctgtaggacaagaccagctcctcactcttaaactgccctttctggtgtggagtctgcctgcccggccccttggctttccctgccaccaagagcagccctgctgccttctgtcccccaggtcctgaaggctgctttctctcgttcacacatcaaaacaaagtcacagcgtcaggtcccgtccaccctctgtctcatgccagtcttctgtccacactgaccatgtcttcactccaggcctgctggcttttgcctgcgttcctgcagcagcctctccaccggctcgctgtcccgtctcacctcctctcgtcaccctgtcactcaccagagcttcagtctcacggtgttgcttccaggtttatggtgccttcctggccccctggtgccttcaggacacgatctaaactacagtaggactggagtaggttcatctgttagcaacgctggattgagaggctcttctgggccaggccctgttctgggagcgggggagacacatgtgatgcaaacaggaaacgtccccgtctctccgggatgatgccatattgtaatagtggactcatctggttatttccccgactggaacagaagttgcttgagggcaggaacttaacagtgcctgttctggaagcctctcggtcctgcagggccccagctgccctccagaatccagtcttgctcggcgttccatgcagagtgctgagtggcccgagttgtaccaggcgagcccctccccaccagggcagctccaggatgccctggcccaagcctggcactccctccaccacctctgctaggaggtccatttagggagacaggcggtccccccaggcagcacgggtctgtccgaggaggcctggggtccttgcagagggtgcgggcagggcgggtgtccgtgaccaggttccatgtgcctttctcactttgtgcagggtttgagtctcctgcagggcccgccccatcgccctctgcgcccccggcacccccatggcagggccgcagcgtggccagctccaagctctggatgttggagttctctgccttcctggagcagcagcaggacccggacacggtaggtcctggcctctgcctgtccagctccctggtcaccccctctccctctgtttctgcttccggcagtcttgccccactccatgctggggcttaattcaagttccctgttcctttccgatcttcccttctgcccttccccccactcctcctttcctccttcacgtcacccctcttccctctttccctcctccctggcttcctttccgtgtcccagcgcccagtcagcgtcacgctcctccctccctgtcctgtgttcctcctcccctcctaacccaaccgacccttagtccaaggttgctctggtcccagccccacccctacactgtcccagcctctctctggttctgagaagcgggcaggaagctgaggagtctcctgtgtctgctccatatcctatgggataccagcctgtccccttcggtgtccagtgtcctgggtgaccagcgtcacctgcaaaggtcagagggggacctggaggaggccaaggtgacaggatgccagggcccttctcactctgacatcttcaaacttcttttttttttttttttttcttgagacagagcctcactctgtcacccaggctgggagtgcagtggcatgatctcagcttactgcaacttccacttcctgagttcaagcgactctcccgccttagcctccggagtagctgggattacaggtgcctgccaccacacctggctaatttttgtatttttagtagagactgggtttcaccatgttgtccaggctggtcttgaactcctgacctcaagtgatccacccacttcggcctcccaaagtgctgggattaccggtgtgagccgccgcgcccggctcagacttctttttagctgaggaacccatgaaccaaatagacctttacttagaagtccaggatgtaaaacaaaaggagtagacttttaccatctctattttactcatggggaaactatggcccagaaaggccaagcggcttgcaccaggtcacgtggtgggcgcgcagagccagggttgtctgtctgaccgtctggcctgtgctccgtctccctcagacccactctctccacagtacaacaagcacctgttcgtgcacattggccagtccagcccaagctacagcgacccctacctcgaagccgtggacatccgccaaatctatgacaaattcccggagaaaaagggtggactcaaggatctcttcgaacggggaccctccaatgccttttttcttgtgaagttctgggtaagcctgtgataaccccttccttcctgccaccagcgtgtccgtggtagtgaggacggggcgagagtgcccagagtgtgcccttgtcacagtagaaacttggggaggtggcaccagtgagaaggggagagtaagcccagcatggctatgggatggttggagctgagccgaggagcggggcggtgaccccagagagctggcctagtcgaacgaggccttgtctcacgggtggggatggcagctaagccgggctaacagtggagccctcaggaggtgaggaggtgtagttccagaaaaagacaaacgggaccctgcggggataagtgaagacatgactaggagcgcccttgtcacccaggtctttgaatgacaagtcctgcatgggtttccgggcctggagctggtccttcggtgctcgcgtccaaggcatgttgggctgaacagagcttggagaaggggagggtagtgttggatgggtcacccagctgactctgctccagggcgaggccaccccacaagaaacacccacccagcttctcagatagctcagcctgtagacttggcctctgctgccctcccacctcaccccgggcaggtattttgtgggtggaacctcctccattgaaacgtcttgtctgaggccgggaggtacagtagctgctctgggagcttagcttcctgggggcccagtgtgtgcagaaaaggggtgcgaggagagagtcagacaagtaagtgctaatgaagccagcggtgaggaagggcaggaaatcaggctctgtgactgaggcctccaatattctcaggacacggactgaggcttgggtggctctgcccgcatccctcttccccactccccttcagctctcctcacgctcttttcaatgcctcttgtgcagagattcttaccctttatttactgccagaccactttcataatctcaaagctttacttttcctagaaagaggcatattcacaccgaactttatatagacgttcagatggcttgccggctcccggtgagcagctcccagcctggctctcatccacagctgaacatgggggcaggctgtctccagaaggggcaagtgttggaactgagacctagggcccctgacctttaagacacttagcatttgcgctctgccagcggaatggaagttggaccctggcctgagggatgggcacatctattggcagagatgggaaaggctgttgcggcctgggagtgcatgagtagtaaaggcagaaggaagtgggctctggagtgaagttgaagccgtaggtaaagagggaataagaggagacaactgggagagtgagttaggttctggaaggtcttgatcatactaaagtttgagttttaacctgttctggaatgaaaaataagtagtattttattttacttggtcttctttttaaatcaatgcatgttcatggttaaaatgttaattaataccaggaggcttatttaacgaaagagaatgaagggccagttgcggtggctcatgcgtgtaatcccagcactttgggaggctgaggcgggcagatcacaaggccaggagttcaagaacagcttgactaacatggtgaaaccctatctctacttaaaaaaaaaaaaaaaaattagacaggcgtggtggcacacgcctgtaatcccagctactcaagaggctgaggcaggagtaatcgcttgaacgtgggaggcggaggttgcagtgagcagagatggcggccactgcattccagcctacaagagcgaaactcagtttaaaaaaataaaaaaaagaaagtaagatctatgctgctatggttttaatgtgtcccctgcaaaattcaggtgttgtcaatgtgatagtattaagaggtggggcctttaacaggtgattatatcataaggacttctcccctcatgaacaggattagtgcccttatgaaagaggcttcccatggctgttggcccttttgcccttctgccttctgccaagtgagggcagtgttcctcccctctggatgatgcagcttttccagccactattgtggaaacctaaaaatgggacccttcatcagacacagtatttgctgggaacttgattcttggactttccagcgtttaagaactgagagaagtaaatttttatttctcaatnnnnnnnnnnnnnnnnnnnnttataaagccaaagagagtgggctctagagtgaagtgaaacgttaggtaaagaggaataagaggagacaactgggagattgagtaaggcctggaaagttcttgatcatactaaagtttgagttataacctgttctgaaatgaaaaaattaagtagtattttattttacttggtctctttttaaatcaatgcatgttcatggttaaaatgttaattaataccaggagccttatttaacgaaagagaatgaagggccagttgcggtggctcatgcctgtaatcccagcactttgggaggctgaggcgggcagatcacaaggccaggagttcaagaacagcttgactaacatggtgaaaccctatctctacttaaaaaaaaaaaaaaaaattagacaggcgtggtggcacacgcctgtaatcccagctactcaagaggctgaggcaggagtaatcgcttgaacgtgggaggcggaggttgcagtgagcagagatggcggccactgcattccagcctgggcaacagagcgagactgtctcaaaaaaaaaaaaaaaagtgaaaagcatcatattcttgtcctactcctccccacacccaaatcccaatccccaaaggtagtcactgcaaatttcagctgtttattttgggctttatctctttagttctaagtaatatgcttatattgctgtatctcgatgtcaggattaagacattatattttcatttcattatggtagaaaaaattagctgtgttacatcacttttccccctcatcatcccaatgtaataatatccaataagttatttaatttagtaaaagtcataaaatgttcactttttttttttgagtctcgctctgccacccaggctagaggtgcagtggcgtgatcttggctcactgcaagctccgcctcccgggttcacgccattctcctgcctcagcctcccgagtagctgggactacaggcacccgccaccacgcctggctaattttttgtatttttttagtagagacagggtttcaccgtgttagccaggatggtctcgatctcctgacctcgtgatctgcccgcctcagcctcccaaagtaatgttcacattttttgacaatgtagattgaacaccaaagagccaagaacgggctgggtgtggtggttcatccctgtgatcccagcactttgggagcccaacgtgggcagattacttgagttcaagaccagcctgggcaacatgatgaaaccccatctatacaaaaagtagctgggtgtggtggtgtgtgcctgtggtctcagctactcaggaggctgaagtaggaggattgcttgagcctgggaggcagaggttgcagtgagccaaaatcgcaccattgcattccagccgggtgacagagcaagaccctgcctcaaaacaaaaagacaaaaaacaaaacaaaagtacaaagagtcaagaagggtattatgattacatttttacctcttgtacaacttttttttcctgcaaataaatggctcttgcatattttttaataagcctattcttaaaattttacaaattgctccatcagaaccaccatataaaattaaaatttttttcccccaaatattcaaaactgttagataatttatcaatttctcctttcttctggagatctttctcctggctgcctctgttctgctccagtttgaacgtgttattctttttttttttttttgagacagagtcttactctgtcgcccaggctagagtgtagtggcgcgatctcggctcactacaacctgtacctccctggttcaagcaattcccctgcctcagcctcccgagtagctgggattacaggcacccaccatcatggctggctaatttttgtctttttgtagagacaaggtttcaccgtgttggccagcctggtcttgaactcctgacctcaggcgatctgcccacctcagcctcccagtgctgggattacaggtgtgagccactgcgcccggcctgagcatgttattctctaggcttgccctatagttgtcatcctgagcctcccctatattgatacaatttcctagctcttgcatttctctctttattggtataacccctttattttgtgggaacacatcctctagtaccttctaagaaaagatgcatggtacataaatgaccttgcttctttgaaatgtcattatttttattatatccttatacttgactgattggtattagtagtctggataaagaatctagatcatacatcattttccctagaaaatgatgacttttttttttttgagacagggtcttgtttcgagatggagtttcgctctgttgcctaggctggagtgcagtggcgcaatcttggcttattgcaacctccacctcccaggttcaagcaattctcatgcctcacccttgcaggtagctgggattacagtcgtgtgccaccaggcctggctaatttttgtatttttaagagagatgggatttttcagtgttggccaggctggtcttgaactcctggtctcaagtgatcctcctgcctcggccttccaaattgctgggattacaggtatgagctatcgtgcctggcctagaaatgattttcgaggatcattctttagtgcatttgtcattatcttctgacataaatagtctgatagcattctaattccctatcctttattatgtaactttttttttttcctctggaagttgtaatgtttcttctttctccctaatggccagtttcacattggtgagctttgggatatgtgttgttttacttccccgtcttgagccaggtacttggtaggcacttttaactgtgagatgagtctttcagttttaggaaatttactcgtattatttctttgataatttatttccctctgttttctgttttcttttccaggaatctctgttatgatgttggaaccctctatgatgtttaccatttctttattttcttggacttatcctctacgatttttatcattcgttttcaatcttggtctgttttcttagcgatttccttaattttgtattctgactcttttctgaattagttaaggttgtgtccaagtgcatatcacacaaaccccaaagaaacagtggcataaatagtttttctttcacatcaaggaagtctggaggtaaagactgtccagtgctggcccagtgctcctgacatcatgagggacctggcttctctctatctgctgtcctcagtgtatgacttctgtactcagggtcatgactgctggagttccagccactgtagccatcttccaaccatcaaaagaagccagtttagctccctgtaaggggcctgctgggaagccccataattagttgtgtggctgcatcttgccgtaaggaaccagggaaaggtacttttttagttgggtaagttgctgttctgaataaaatcagagctgtaatactgtagaagaagctgcatacatccttttatggatgtatcttagttcagttgatgacattttgttttttctgggtagtttataaagtgtgcatcctacagttaagggtgaattagatgagtggaatacagcagcatctctgccacaccttctgttgaatatttaatttcggctctgacattttaattttccagagctccttcttgttctgtgattgcatcaagatgtttgatggatgtagtttttctcctctttttcttaaaggtatgaagtaagtgttacttcttaagttttctcctgctcctaaccctcccccaacccacgcccagactaagttttgctgtgttgcccaggttggagtgcagtggtgtgatctcggctcactgcaacctccgcctccctgttcaagcaattctcctgcctcagcctcccaagtagctgggattacaggtgcccgctaccacgcttggctaatttttgtatttttagtagagagaggggtttcgctatgttggccaggctggtctcgaactcctgacctcaagtgatagatttacaggcgtgagccaccacacccagcctcctgctcctttctttgtctttgtttctttttaattccgtttttctgtttgttttggtccttgtctttccagctggagggttttctttggtgtctttagttcttagctgcctgtctgtatttttttaacagctttcttgcaatgtaattaacttaccttacagttcacctacttaaaacatacaggccacgcacagtggctcacatcttaatcccagcagtttgggaggccgaagcagacagattgcttgagctcaggagtttgagaccagcctgggcacatgacaaaaacctgtctccacaaaaataatacaaaaattagtcaggcgtgatggcatgtgccagtaacccctacactttgggaggacgaggcgggtggattgcttgagtccatgagttggggaccagcttggccaacatggcaaaaccccatctctcctaaaaataccaaaattagccaggcatggtggtgcgtgcctgtaatccaagctactcaggtggctgagatgggaagatcgcttgagcctgggaggcagaggttgtagtaagctgagatcacaccactgcactgcagcctgggtgacagagcaagatcccatctcaaaaaataaagtatacaattccgagtttttaagtatattcacaaagttgtgcaaccatcaccacaatcaattttagaacattttcatcatcccgaaaataagccctgttccctttagctgtcactccccactcctaccccccagccctgtgcaataatctactttctgtctttgaagctttgcctattctggacattttgtataaaagggtttgtggaggatgtggtcttttgtgactggcttcttgaacttggcatagtgttttcaaggttcaaccatgttgtagcacgtacgttcctttttatggccaaatgtacggagagtccacattgtttatccattcatcagttcatgggcatttgggttgtctcctcttggctgttaggagtagtgctactgtgaacattacgtaccagtgtttgtgtggacattcattttcatttccatatgcttatgtctggaattactgggtcatatggcaactctctttcactttctgaggcactcccaagagtcttccgaagtggctgcaccgttttctgttcccacctgcagggtatgagggtatgaggatcctattttctccacatcctcaccaacacttgatattctctgattgtagccatcctagcaaatgtgaagtggtatctcattgtggtttttatctgcatttccctgatgactgatgatggtaagcatcttttcatgtgcttactggccattcgtatatcttctttgtagaaatgccaattcagaaatttaggtccattgcccttttttttttgagacagtctttctctgtcacctaggctggagtacagcggcgtaattttggctcactgcaacctctgcctcccaggttcaactgattctcgtacctcagccttctgagtagctggaattacaggcacgcaccaccatgcccagctcatttttgtatttttggtaaaggcggggttttaccatgttgtccaggctggtcttgaactcctgagctcaagcgattcgcctgcctcaacctcccaaagtgctgggattacacgtgtgagccgctgtccccaaccccattgcccatttttataataaattgggttattttttattattgaattatgagttcttagttctggatgaaagttccttatcagttatatgatttgtaattattatttcccattctgttgaatgtcttttcacattcttttttctttttttcttcagagacagggtcttgctgtgtcttccaggctggagtgcactggcatgattattgctcactgcaaccttgaacttgggctcaagtgatcctcccgcctcaacttcttgagtagctgggactagaggcatgcactactacgcctggccaatttttttttttttttttttttttgagatgaagtctcactctgtcacccaggccggagtgcagtggcatgatctcggctcactgcaagctccgcctcccgggttcacgccattcttgtgcctcagcctcccaagtagctgggacttcaggcgcccgccaccacgcccagctaatttttttgtatttttagtagagacggggtttcactgtgttagccaggatggtctcgatctcctgacctcgtgatccaccagcctcggcctcccaaagtgctgggattacaggcgtgagccaccgcgcccggcccaagtttttatttttatttaaattttttatagagggtgtcactatgttgcccaggctggtcttgaactcctggcctcaagtgatcctcctgcctcagccttccaaagtgctgggattacaggtgtgagccactgtgcctggccccttttcacattcctagtagtgtcctttgatgcacaaacgtttctagtgttgatgatgtccagtttatcaagttttccttttgttatttgttctggttatatttagtagtgactgggagctcttcgtgcaaggtaggacttgtcacctggtgggtttcgctttagggtgattgggcttggggagctagctgttttattggggaaatcaataaatatgtgtgtttactggacttttttttccccctgaggtgatttagtttctccagagacgattcatctaatttccctggaagggacatacttggtcacaagtgttctggtagtgggataaagggtcgggggtaggggccctgaccatttctgatgctggctttcacttaactctcctgttcttactccccctcttccctctcttttgaataagccctgtgtccctgagacccgttgccctcctgtttaatttctgaagatggtcaccctttggtcctctttaaaaagtttttttgtttgttggtgtgttttttaatttttaatttcatagagacagggtcttgctatgttgcccagactgattttaaactcctgggcttaagccattctcctgcctcagcctcccaaagtaatgggattacgggcaggagccaccatacccggctgaccctttgatcttctaccgatgcatgggaggggtgggcctgggggctggactgtccagtgtacagactttttgtcagttcctggggacaaatcctgttccctccagctctgagccacgcagctcagcttcttatctgtcacccctgaagatattggtaggttgtgactctttttgctttctctaccccgtggaatccagtgtggtcctaatcagctttgagtctccaaagcttgcccagctctcttgtcagctggtctctttgttttctttatctttgtggtgctgcatattgtttaaagttacttgctgttgtccttctagctgggtctctggaaggggaaaaaataaactggggtagtcagtctcccacctttagccaggtgtccaggatgatggggtgacctgtgtgccacttcgaaggggtcggcagtcgctgtttggagtgctgggctgagaaggctctagcagggaggagtgctgggtggacggtcatggccacgtgcgtagccagggaaatatttgttagcccttctccttaagcgatgaggagtcatttaaggttttcgaacagggcaggacgtggccagggttgtgcttagttggttaactctggcacccagactggaagcaggtgtgagactcctgcagtggagaccaggcaagacgcacgtgcctcctgaggacctcggccgagaggctggcttcagggtgtggcgtgggaggcaggatgctgtccactttttctcaggaggggcttaaatcatctcccagtctcccgtccagccccggtggtgggaattggaacctgtacagctggcagtggcgcttcccaaccctgctgtgagtctgagggggcccccagccccctggagaagccttcacccttgcttgagcactcaccgcccccggcctgtccaggctcagccctgactcagcggaaggagcttaggcgagctgatctgtggctctttcccggcatggctcaggaccctggggatacagttggggtcagagcggagacccagttggcagtggcaggaagcactcatgggaacactgccttggagcgggaggtggcatgtccgggaccctcttgcactagctcctgcctttagctattggtgatattctgtgttcttctagccaccctccagataaggaccatcctaggtctcttgtttcacaagtaggggaaactgaggcatggagtaagcagggcctggccctgagtcccccagccagggtgacctctgtcctgtgggcactcctgttggatacatgctgtgagatagatgggcccagatagactgagagagatgacagctgcactcttctcaccacgttacatacagtcacacgtctcatcctcaccacagccaagactggataacctcatctgcagaggggaaactgaggtacagacaggtagaatcacctgccaaaggttgcccagttcatagtaccagacccataccagaccacgggtccatacctgagcagcctgaccccagggtgtgtgcttggagccaccatactaaacagtcctccttgcgaagtcactggctgccctccatgcagcatcctggagcttctcctgctcccactggagaaggctctgaattgtctaaaacagatccccagccccctgaggaacagcaggcagtggcagcgtggggagagcagacttagctctgtgcagtcaatgtagagccagccccttgggcttcttgggcgttctcgacctcagatatcccttccagaaaatagggcagtggccctgcgtggagactaaggttgccaggaaggaaggaggacctagaaggtacttttccaaacttggtagtggcctgtgtcctctctttctttctgactcttaggggagtttggaggtgggggttgatgggagaagagagggttgggacagctggtgccaaggacatgggattcagcaggttcccttgtggaccgtgtgctccagccgtgtgctgtatggacccagcgcggccctcggcttccaggagctcgcactctggatgggaggatccagcgcgagtctcggggtcctgggacaggagccgctggacagggggctgtggtgtgccccccagcaaggcccttctgatgtgtcatggcagggcacggtgggcagcagttggccccagctggggcagagtctcagttctaccacttgagaactgtgtcctgggcaaatattggcttctctgtgcctctgcttctttgtgtgaatagtcagcagtttgatcttggggacctgccaggggctgtgtcgctgaagaccccgtgtatgtggccggctggtactgagtggggggctgtggcctgcccttgccccaccccttgcctgagccctctgagtgccagcggcctgggcagggtgagggagcgccggaggccagggcaccttggcggtcatctgctccctcctccgcatgtgtggggcgggcagaggcaccagaggaagacacatatgtgacggggaaaggtacatattcgtgtttgctgacaatgagactttgcgtcaatcgtgggtcctcacaggctgccccggctccccccgcatcgggaagctcctgtcttctgctccctggcctggtcccgccttccccctccatcagctggtgtgaacttggccacacacagttaggaaggaaaactgctcaggcaaggaaacggtgtcgcctctcccggagcctttcttttcctgcctggctgttttctcagtcctggctcccaggccctgaatgtgtgtgctggagaggcaatcagaacccccttggagtgggaggaggacttgtccgtctccagtccagcctccctgcctgtcccctgagttactgctcttactgagggcgctgtggtggtcattcatagactctcggactgctgggacacatttccagctagaagtggcatctgccagcctgaagggctgaggctgctagggctgtgcacagcctcagccctatctgctgagcgccacggggcccggagcgagggactgatgcgatgaagcccccttcctcccccagagccccgcaagtccagcagaggccacctgtctctggggccggtgagagggggcctttggtggcccttaacgccgctctgcccattggaaatgccaggcagagccgggctgcaccgtggaggcagcagagtaccccaggccttcctcccatctcagcctgctcttccctttcagtccctgacatttctcccaggcacataccagcacatgacaatgaatctgagcccctccaggcccccacacccgggctgcggctgtctctgctcatctgtcagtcacccgatcccccacacctgttccaggcacagctgcccacccgcacgcacagctatgaatagggcggagggagggttgcaagggggcactcacagggcaggggaccggggcagctctcattttttcttaggccaagaagcgtagcttgttttgggtgggtgctcagtgtggggggatatgagggtggacaggaaatgtcaggaaggagtatagctgcaggagaaggggtgaggctgtaattagaaggatccaggcactgaggacgagtcgaggtgctctggggcggttcgtccgcgtcgccggctggtgtgttccgggtttatgcagtgtgaacatgagttctggggctgattgtgggatctctctttctccccctgacccattgctcaaccctagcacttgcattctatttgttctcccgattataaattccctgagagcagaaacaatgtctcaacctctctgggcccccctgcctctagcactgctggcctgggctggacaaatgggcacctgagcgatgggaagagccagggagtgggagctgatgacagaagagtgtatctgagatgggggtggagctggggcgcagaactctcagggtgagcaggacagggtaggttcctgcttgcgcctgagggaccttgctcttcccactggtgccacccggaggtgagagggtgaacagccgcctgcaaccttgattgaaggcccaccctactaaggccctgggagagcttagttcttgcctccagggagcatcgtatctggaagggggcaaggacatctggacagattatgacaagcagggtaatagagggggatctgccaattgctcctgggggctgggggcagccgctgcctctgtgtgtctggaagagctgggaggtgtggatgccagtccttcccagcttggcacactggattcttctaagatggcacgtgaatatgcatttttttaaatagttaagtagttgcccaggctcagtggctcattcttgtaatccccccactttgggaagctgaggcaggaggatcacttgagcccaggagttcgagaccagcctgggcaacatggcgaagccctatccctgtgttttaaaataactttatttgaaaatatggaaaatagttataggccagacgcggtggctcacgcctataatcccaacactttgggaggccgaggcaggtggatcacttgaggccaggagttcgtgaccagcctggccgatatggtgaaaccccacctctactaaaaaaaaaaaatacaaaaactagccgagcgtggtggtgggcacctgtaatctcagctactcaggaggctgaggcagaagaatcacttgaacccgggaggcgaaggttgcagtgagctgagattgcaccaccacactccagcccaggcgacagagcgagattccgtctcaaaaaataaaattaaaaaaaatagttatatagttattttcatatatattagaaagaatagaatccttgatttcatggatttattgcttagaatggaattaaggaataaaagtgagttgatttcaaagaatcaggatgtgtcgtagatggcacatgaatgtggcattgatcagagggaccatgcgcggttaaaatctgagggtcaccaccattgatgcctggcctcacctcttggtgttccccaccatgtccagtgcatccttcccaggcagctgggcttcctgccagcggcatttcaggcattgttcacatttttgccctgtgcttccagctacagaatatgtcctgagcacacaaactgtcccccaggccctttttaggaacagtctgacaaagtcagtctcctaggaggagcaggtgacttcgagaaaataggagacaggccaggtgcagtggttcacacctgcaatcccaacactttgggaggccaaggtgagaggatcacttgaggtcaagagtttgagaccagcctaggaaacagcgagaccctgcctctacaaaaaatttaaaaattagccaggtgtggtggcacatgcctataatcctggctactcaggaggctgaggtgggaagactgcttgaatccaggagttcgaggctgcagtgagccgtgatcataccactgtactccagcctgagtgacagaacaagattctgtctttaacaaaaaaaaaaaaaaaaaaagaagaagaagaaaacaggagcccgaaagcctgggttctggtcccattcaccttatatttgcctgtaagaccttcggccagtcacagccacagttaaatctagtccggcagaggcctcagccacctctgccatgccaccctgggcaccctgcctacaatgtgtcatcccctccctcccagcatcacagatggagacagagtggggagactgaggccagctcaggggtggtagtggagggtgtttaggataaatgctgctgtctgtttcagaggctgagcattgacacgaatgctttttttccctaaaggcctcatcaaagccgaggcaggtgcactgaaccatatgccattctgtttcagcatgaaaacagcctttttttcctcatcataaacgtaatccaccctcattctgctccgtagcctgctttcccactcagtgtgtttgtagtcatccatgataataaatgcaggtccttctcagcgtttttttgtggctacataatgtttctattgtgctatagacaatcaacaccccccgccagtctagagaaaggtcctgctctgggaaaacttctccaaaggagagaaaaataacgattgagtgtcccctcatggccagtagtagaattgcttggtgcctggctctgaatctgaccaaaaccttcctggggttctagggatccccttatctttgcacagaagagtccttggtgtcagaaccttgaccaaggcctgacgctttactgcattcgtagggctgcgctctgggcacagcttgcagtgatttcagaccggggtgtgggtgggaggagcggcctcccctgagaataagcctttgtaatgtgcctgtgcgttgtttctgagtcttgacttgttctcttagcacccctggctcagatggggtgatttgatgtggggctggagttctgggcatggggacccctaaggcgtagggcttcaggaatacaattcctgcctcagagtccccaaagcaccaaattgtctcatctggtgccttcctttcttcgctgtggcactctgctggtttgggacaagtattggggttggaggctgaagacctggggtctttcacttactagttggatggtgttgggcaaggctaacagtcaggacccctcatggataaaaccgaggccgtggttttaggtgtgagatcagcacagagtcttactccgccttttctagaagggaagtttcagatcagccccacatccagcaggaggccccctgggctctgttttcatcaggggaaggaagagcagcctgtctgaggcaaggtgagaagctgacctagaggaccagtgtctgggcctgtgaagggccttgtgagccaggccggggaccaagactcctgtcccttgtggctaaatggctcaatgagacggtgaagtgacttgacttctgaagagattcccggggcagttaagagaatgaaccaaagggagggacagctggtgctggggagattgctctggaggctgaagcagagatgtcaaaagatccaaggtgacgggacccagcagtgcctagagggggaagaggccagccccagagccgtttctgagggagcatcgatcaggtctctggcgagacaagaggatgagacaggagcagcattcaccccttccaccctccccactgccggtctcttgccctggttttctgttctcatgcttcctgcactatcaaaattgactctggaataattctgatagacgcattcaaactaaaatagagctgactggtagagattcaaacctttgcagtttaacaagaacaaagtcttagactatgaaacttgaaatcttaaagatggaatctggggctcccacctgctgggtgtgttaatatctgggcaggcagcagtggcctgaaactgtgtgggtcccagtgtcctcttttcccatgatttaggcaacacgacctgattttgtaccaggcagagatgtagaggaatgtggaagctttctggcgtcctactgtctaccctcagtctgatttcttcccagccctagagccgggaccgggaccctgaggtctccttgatgctcccgtctgacatggcacctgctgacactccctcgccttcccactgtctccctccaggcagacctcaacaccaacatcgaggatgaaggcagctccttctatggggtctccagccagtatgagagccccgagaacatgatcatcacctgctccacgaaggtctgctctttcggcaagcaggtggtggagaaagttgaggtaggaggccaccctggcgggtgagggccggtggcagtggtctgtgtttgctgggcatggcttccatttgctttcaggaggaatgccctccgttagggagccaggataatcccttgttgccttccctgtctgctgtcagtgctgtgtgcctcccacactccccttggcaccagtgtcctgcccagctcaccagagccattgctgccctttcaggatcttccaagcacgtccttgcaggcacccccggtcctctccaagagcagagccgcagcacaggcagagccctgggcatctacctagtccagccctctggcttcacagtggaggcccagagagagcggaggcctcccaccaatcgcccgcacatggtcacacagctcattagtgcagaagcagggctaagatctctgtcccctgctcactttgaactccatgaatgcctaaaactgttccttccctgattttctgcttatgggtaccctggagaccctgctctaatggaagttacagaaaattcaggcctgccttttatggtttctcccactctgctaaacccccggccaagggcagtgcagggcagtggtgaggagcataagcgcaggtgaatccccacccagccaccctgctttccggtgcgtgtctggggggttgtgataaaatcctctgtattttggccctaaacaagggccaagttatcttcactgtccgtgacacggtctcctgcagcaccctgtgttctgggcctgctgcgtagtggcagtgacaaggagctgggactgaaggcctccaacccaaagcacctgtggactctgagagtccggggccctgtgccgcccacacacttgttaaacctcctcaccgtgcaggccagtcttcgtccctctcctcaccccttccccagattggtctgaattaatgaagtcctactctcacagtctgtcagttattgatagccttcctcatgccaaatgcagccagatgcccggccagcaccagggaggagacattactccacacagtgcttctccgcctggctgcaccttgcagtctcctgggagctttggaaacacaccagtgcctgaaacccattcatcacccctcagtctctagggtagagtccaggcattagtggtttttaaaaagttcctcaaattatttatttctaattaaacttgtaaaacttttgagataatggtggatccacttgggctcataatcccatgtgcgctttacccagctcttgccctggccatatcttgcataactagagtgtaaagtggacaaccaggaaattgacgttgatgcagtccaccaagctggttcagatttcaccagttttatcggcactcctatgtgcgcttgcatgcgtgtgtgtagacagggaaatttgcatgatcaccaccagactcccaggggtccctgtgtgcccctcatggtgtcctcatgtacagccaggattgagaggctcctaccactgctcctgtgtctccttaagctcccctcctgccatccccggttcctgctggccacccatggagaaaggaggtcttgtttaatgtccaccaacctaagagggtgactttctttttgtctttttgtgagacagtctcactctgtcgcccaggctggaatgcagtggtacgatctcagctcactgcaacctccgcctcccgggttcaagcgattctcctgcctcagcctccagagtagctgggattacaggcactcgccaccgtgcctggctaatttttgtattttaatagtaacaaggtttcaccatgttggccaggctggtcttgaactcctgacctcaggtgatccgcctgccttggcctcccaaagtgttgggattacaggtgtgagccactgcccctggctgggggtgactcttttcttaagggcccccaggctttctgcctttccttcccgtggagttgggtctgggctggaggtggtcagaatgggattctaagcccctgctctccccgggtcctgcagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtgtgcggcgggtgctgcgggtgtggctggagtctgtgtgtgggtagcagccatggcgtgccccttctggggccttattaacccttgtctttttctctcccacaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggcagccccctgaagtgccaagagagctgagaggagcagttgtgactctacccaggaacaaactgtgcctgaacctgaggtgcccaaccccaaataaacccaagatgctgtgtattttcagaggacctggtctggctgtgtgagcctcgggagggactgggggagcaagggggccgtctgggaggcaggccggaagcagtgctcagagacgtaccccgggcagttctgaagccagcgtcccaatggactcagccaggaacatcgccggaccctggaactgaagatgtgacagtccctgtgctacctctcaagcccctgcactgtggtgctggccacgccgtgaggcccgatgaatgcatgggccacgcacccacagccacgtgcgcccctgctgcactcccaggacggttcacacagagaggccccatcccctggggggtgggttttaggtgtggcagtgacagttgttggacggggacactgtcagaactctctggatagtttccgtccatctcaatggatgtggattccatgaccatcttccgtgaccacgttgggggcactggtttcaaatcaaaggaccctgaagcggggagggcaggaggcggcagggctgaggccggcctgaggagtctcggcgggaggttgggtgcaccagtgtcctcttggctgtggccaggaggttgatgagaggtctctggtgctccgctggtccccgagagccattggtgcttgtgaggcttgttcaaactctgtcccagccagggtgcctgttaggtggaggcctcctcagagccagcctgcaccatctaacttcttccctgaggggtagtttctgtgctccccgggggtggaggaggggagtggaccccaccctgagcctagacttagatatgcagctgaaggggttcctgggtttatttctcctgagaactggcatgggctctgagttttgccattcctggcttcggtcctagcattctaagctgcctgaccttgggcatttgtcaacctgtctgaaccttagtatcctttcctctctgtagagtgggaagagatggagtctgtgaagcgcctggtgcaagctgtactaatacacctaacaatgagctcctccctccctccctccctcgcctccttgcctccctgcctccctccctcccatggggaggccagaatctggctgcttgctgccacctagtggctctttggggtcatcttccctcataggaaccacagatccagtagcctagagcagaaagggaaggaagattcaaccaaggggtgtttatgtttaccgtgtgtctggcactcggggagatagtgcatgggactacataagtaagacagcatcgaagaggtgtcttggagtgtggttaggagcgagggctctggagtcagacaagctacagactagctgagtgaccttggggcaagttatttcatttcactgtgcctcagtttccccatctgtaaaatttgtataacgataacctacctcgcgtatctacagtgcctagcatagtgccccacataaatgtgttcactaaatgtacgtcgttattaatcataggagcttgcagtctcactagggccgactggaaaactattaagtgatcctcaaagccacaggcgctcagagactggagagatcaaggtgcagaagactcagggaagggtagtcttgagggcagctgcccttaaagggtgggcagcatttagtgaagcagatggagggaagttgaccagcatcccagatgtggggaagaggccagcagcctagtctcctccacggcccagcccccactgtcttaccaaagaacagctttaaccaaacccctctgggcatcaggaccaccgctacacctcttgccaggctgcagagctatgcagtctggaggcccagctctcgtcagaagctggggcatgggctctaggggaacctggggtcggatgagcccctgagcaggtggcaggtgcctacatgtcccagtgtgggttcgtgtttgtgtaaggctctcctgcccccacccccaggcaccagcacagcctttgccttcactctctcccctcccctgtccctgggggattgaataagggaagctggggttggccgtccttctag

SEQ ID NO: 14838 - DNA, 12640 bp, Human
ctgctcatagaacagtgcctgtcctaacataaatgagcataagaattcaacaatcactcattaaacacctacagtatacatggagctaggtatagttgatgatataaatgaaatttaagaacatccctgactagaaatttccagtagaaattaggagactgatctctacactaaatatagagggcgacaaaagggaacagacccaaaaccacaggagagatgctagcatgacagggatgcagagacataaagcacaacagtgagatggagttaatatacctccacgagggtgaccttgtcctgcatctcaaattttgggtaggatttgaatgggccagagggacagaaaagaagagaaagagcatgatgagcaagggcttgaatgttaaatagattcctctttgggggaccagggagatacaagcttctaaagcacatacgccctgtattggagaatggggaggagtagatagatgagaaggttgaagccatattacgaagccttgaatgctgaacatcagatctggggctatattcttaccttgatacatttcagaagcaactgaaatcgtaggaccttccttgcttctctattgggtgaatgtttctcagtcttggtgtgagtctcagtgcctacgtagttaaagcttactgaaatgttccctttacaattctagagagatatgtcctttatgttgacatgttcatgctgacagactgcatctgattaaacagctgcctgtgcaatgcctccaagtgtggataaaagaaaaattaaactcataatcttggacagccatgtgtagactagttacattgatcaaagggcaatagaaatgatccagtgaggatttgtctgaatttcccacaattatttaaaatctacctcaaatacctgttcatctataatgcctcccctgaggccttcattctgaatagtacctctgtctctgtccccaaagcactaactgatccctgtgatagcgcacttcccagccaggctgatatgtagacttggctgcctgtgtatcttttccccatagactgtgagcttccttttatgaataataattgtagctagcatttagtagggtgctcctacctgttaaactctatgatgagtgctttacatagattatatcatttattcactaaacagtcctttaaaatggtgctatattcactaaacagtcctttaaaatggtgctatattcactaaacagtcatttaaaatggtattattcttcttcatcttacaggtaaacaaactaaggcaaaaaaaaaagtgaaataataagtgccagtacacagagctagtaaggaatagggtctgccaggtcccaaaaagcatgccatcacctttgccccatactgcctctggtacagatagaggtaatgtcttatttatcactgccatccactggacccagcttagtgcctgacacacagaggggctcagtcaatgctgattggtttgaggtggagcaaaaatgcttagcagggtgagcacctttgctgtgattgagtatctgattctctatgaagagaaggggagtcctgagccaaacacattcctctggctcctggctgtcatctttatttgcccggcttctttgctcttcctccttcctaactgcaccgtttggattcaaagctggagcttaatgcagataaagggaaaacagaactttgaatgaccactgtgggactaagagaggagaaacaagaaatttgacagatgaggaataaagtgaggagaagagaaaatgattaagctttatcactttaacttaatatttaacctaatgaaaacaaaatcttatttgaaattggaaaaatcaatgtattgattgctggttcattgccctcttctttatgatttgacagtctgtgaataatctaatgggtgtggcttaaagacctagatcatgtgtggaactggaatcgggtgttattcaagcaaaaaaaataaataaatacctatgcaatacacctgctttatgcacttgagcagggaagaaatccacaaggactcaccagtctcctggtctgcagagaagacagaatcaacatgagcacagcaggaaaagtaagcaaaaaatatattactgttggaactatattctcatcaatataacaaagaaagtaatacagtatttgatgaatcatttaaaattcatatctaaattagaaatgatacactgaaatatgatatgcaatatatgctataatatgtaatgtatactgaactacagtggaaataagctattcctaaataccttcaaaaagaatgtatagaatctgtatctatgaagtgtttatttcccacattaaagacatttgcggtaaagcgataatttattccaagctaatcatgattaatttgtaaagccaaagttagaaatgtctttcatcaagaagttttctttatattaaggtaccataatttaaatgtattactatttgtatttatattttttgtgaatacaagaaagttaagtctgatgaaagttttatgagaggatttgatttagaagactttgaaatacccttttaaccttaacataaaatagtttacaaaatgctcattggtctcacagcattagaatcatcaaggttaatcaagacaacatcaacattcaaattctgatttaaaagggtctagtaggacacaattcaggcaatttccagagtaatcctatggaacagtatcttccccatataaaagtcaatatggttttacagaaaattaataatacaatttgaatcacttattagcactaggaacacagatatttggttttgccttccataaatatcttaattgttcaatgtgtttataggtgcacaaaaatacatgtggtaatacaatataatcaattgatattttaattgcctaattacaaaaatttgtgcaactatttccagtccttttttgtgttaggagtgtattacacagtaaaatatctcactatgataactcagtttaaaggctctgaggcttctctatacactctgtgacaaaacaggttcatatcaataagactggttggaaatcacatgggtggcccattgttactgttcttattccacctcactttactttcattcattactgattaatatgtacattccacatagaaaacaattagcaaaaaaattaaatttaccaaactcaacttaaaagaaataatgagttcctacagcaaaagtataaaccaatcatattaatgaaaataataactgatgaaatagacaattgcctcccctcttgggcacaacatcaataacttagcttgttgtcagcatttcatttatgtttatacatcctgcattatattttcctcaaatgctaaatagtgacaatactaacatctatttcataaagtagttgtgttgtgataattcaataaatgaatactataaagaacttaaaattgtatttgggatgtagaaataagtcaataactattagccactattattattgttgctatttaactttttgctaactttttactgacaccgagtagtgaaaacataaggctagattcatctttattctctggaaagccagctttgagactttagagaaattagttaatcactgagtcaatggatcctcaattatttcagctgtaaaataaagccaataattcaatagtactgtcctggtagcatccttatgagattttaaaataatgcatgttgtttatagcagcacaatttgcaattacaaaatacagaactgacctaaatgcccatcgacaaacgagtagataaagaaaatatggtgtgcatataccatggaatactactcagccattaaacagaataaaataaaataatggcctttgcagcaacttggatggagctggagaccattattctaagtaattcagaaatggagaaccaaacatcatatgttctcatttataagagagagttaggctatgaggatgcaaaggcatgagaatgatatcatgaactttgggaactcgagggggaaggttgaaaggggaggtgagggataaaagactacatattgggtgcaatgtacactgcttgagtgaagggtgcaccaaaatctcagaaatcaccactaaagaacttacccaggtaaccagaaaacacctgcaccccaaaaactattgaaattaaaaataaattttataaataaatataatgcaaataactcaccgagcacaggccacaatgtgcctgtcacatcataggcacctgataatcaggaactcctactattagtactttacttccaagtattctgatatttatttggcattgatcatgttgaacatcctgcaaagttgaataatttgacaaataaataatgacaacgaattatcagaagaacaaatttcaattgaatttttatcataattgcaattttgttgattctctctggaaagagttttgtgaattgtacatgcttaaccacaatgaagacagatattacagttcactgccaagcactggaaattatgtgtacatcttttatttttaagaacatctatggataagatctgctagctagaaattcaaacacacagtgtctccaattttgaaatatgtatgtgtaggtctgagtgtatacacacacacacatacacacacacacacacacacacccaactctaacctttgtaatttggggctcaaatcaaagctggaaggagtctctacacatagatcagataacagtacagcctctcaaagctaagttgcaaatgggtgttggaacaagtaacacacagaagtggtggagagagaaaattaaaagaggagaataggaaaagagagagaaagagatgtcatcccaggcaggaaggtaaatatatccttataaactcagatccttttggcctaagcagaaaattgagaaagaaaacagtgtattttatgtgaacagacactgactctgtcagcaaaatgaaggtgacttagaatttgatgtaccagccaataattgtgggtgaagagacattttcagcatagcattaggaaatgtcaggattaaacaactttggagaaaaacaacaacaacataaggatggccttaatgaatatattccattttatctcagtgtgttgttatagttaactgtttatctttccttatgttattgcttttttaaaatatatttttttctctttataaatcagaggtgatcatttctatagagcacttgttaggtaccagacatgggattagatgttgtatgtacaaagatgaaatgacacaatatctgactgcaagcgtgggagaacactggtgccatctctctgtttgcttttctaggtaatcaaatgcaaagcagctgtgctatgggagttaaagaaacccttttccattgaggaggtggaggttgcacctcctaaggcccatgaagttcgtattaaggtgaaatacatttttccatttgtatttaagttttaaaaactcagaaaagttaaaaaacggaaacaaccaaatttttatatgatcatccagaaaatagaatatacttgttgtcaaggaaaggtataaatataaatttttaaattttaaaaaagtgcacacagtgtaattccagtaaaatacaaaagaatttatgtgtttgtacagaaagaaaatttcaaagtgatatatatcaagacttcaaaatcaattagcattagatatttttatgtattaatttgcaacttctacttctattttttaaaggcatgcattcttttatattatttaagacttaactatttcaggatcagttacttcacagattattctaaactgtttacttcaagaatggaaggtagaggagggtttcagcctggtcaaccttgaggataaactgaatctttcatacttgggatagtagggattattagcaaaacccttgaaaacattttggaagcgcaatttcagggaactgggatttttaaattcacctgagactcacaatcttttataaacatcttctcttcactctgtagatggtggctgtaggaatctgtggcacagatgaccacgtggttagtggtaccatggtgaccccacttcctgtgattttaggccatgaggcagccggcatcgtggagagtgttggagaaggggtgactacagtcaaaccaggtacaggattcacattcaggaaacatgatggttcaccatcctaagatttcccagcctgaatgaggaaacagaggcaaagagggacgaaagggcttgaccaaggtcaccgcgcagccaggacttcagggatttcctctttccctctcttcctgcctgactcaagcatgtatgtctttaggcacgcatgtattctacccttcaacaattatgtactgagcatctgctagatgccagtcaccaggttggagcctggagatatgtgaggatcaaaagggacacagtgcctactagtgtggcattcataatctagtaacttccgtgttagtgttggtgaacacggtcttctgtcagggcccagacacctagaaatgggaggagggaaaaaacataagtatggacattgttctgtgctgagttcacaaaatggaggctacatggctacggctgaatgagcatgaccttttcttaggtgacctatgcagccccttcaccaatttcctcttgcaacgtggtctctcttcctgagcaaggaatcaatgaagcagactaggtgaaaggaaatgaaagaaacatagaaagagccatccaccatcaacaatgtctgccttattactttcagccatgcttaaatgtaactggttacggattactaattataaagggagaataactaggacacttccatactatcattttcacataaattttacctataaaatgttatgggccaaccatttttcttggtcttgtggaatagacagcataggtaatttaaaataaaaattatgtttaattctaaaaaaatcacttttttttttttttttttttgagacggagtctcgctctgtcgcccaggctggagtgcagtggcgcgatctcagctcactgcaacctccacctcccgggttcacgccattctcctgcctcagcctaccgggtatctggggccacaggtgcccgccaccacacccagctaattttttctgtttttagtagagacagggtttcaccatattagccaggatggtctcgatctcctgacctcgtgatctgcctgcctcggcctcccaaagtgctgggattacagtctaaaaaatcactttaggcactagattggacctgccactttaccaaatacttatttgaactgtgaacagaaaaataaaatgaactgtccaatttgggtttcagctcctactaatttctttagtagtaataaattaataactactgaataataactaataactactaaactactaataataactactaaataatactaataataactaattagttagtaataagttaataacaaaatgacacccttactttttacccatgctccctccactgtaacaggaaaagtagataattcacaaattatcagctaaaaacatttcaaagtcagttcttatcctaaaagtgcctaacttattgtggagggttgaaatttccagaggaatttctggaattgttctttgtcccatttttgatagttttcctcaaaaaaagaactgagatcattttaaaagcattcatttcataataaagataaacctagttactttgaaaagaattagttcaaaattctcatttttattgtaaatcaaactataacaaaaaacaggtcttaccaacatctagtggaactattataccctactttcaactaaaatttatatttatacttacagtaagatttatatagttaaggattaaattaaatgtttgtaaagcctccaggagaaattggtacaccacatgaaagtaactgttaatacagtggaagcaatttttctaatccatgttgtttcccatatttgcatgtcctctttaggaatcttcaggcacttataaacccaaactggaaacaaggctgtggcaggcaatgacaaatgacatatttgtgattggactgtatttcttggagacttttaaagacacatgtttctaatgttttaaagacatgtgagctttatgtttttgctctattaatacctggatagaaattgtaaaagaatttgttttatccctctccaggtgataaagtcatcccactcgctattcctcagtgtggaaaatgcagaatttgtaaaaacccggagagcaactactgcttgaaaaacgagtaggtttctgatgctctccctgcgcagacattgagtttgcacattagttatggtcctgtctcatgcctttgtgtgtctttgtattgcactgtccagtgtaagcaatcctcaggggaccctgcaggatggcaccagcaggttcacctgcaggaggaagcccatccaccacttccttggcatcagcaccttctcacagtacacagtggtggatgaaaatgcagtagccaaaattgatgcagcctcgcctctagagaaagtctgtctcattggctgtggattttcaactggttatgggtctgcagtcaatgttgccaaggtaagaatggcaatgggtgataaaaacagttacacgcagactgtcaggaacccaaagggaaggaatgtctcacaagaatcgaagattatttttgtagattttgaatgtcgactaagaatagaaacacaatccagaaagaattgagagcacatgctagaagtttcacctgtttatcagattaaaaagttgttgagagtttagaaaatgtaaagatttcattttcaataattactcttctgtatttgctctttatgagctcatgaaatattaggcctgagaactcatttagtaattcattctacaattagagagcacctacacatgcttcaggcaccataggttctgctaggctctgacagcaaaagtaaatgaaatgaagcgtttgcccttgaggagcagctagtctgtggatcctctactcccagaattaggatcaacaacagtagagtccaaaaccttacctgatgcacctccaaaccaaggctcacccactctgtggattcttagactgaaagtaatgacgcttcagtgatgcgtaattcactcattatgacatttcactgctaaaactaactcccctggcatgaacacacacatatattcagaagtggtaaatttcaagcagaaattctttaaaggcttcttatctgagtaggctgaaaatctagtagtatgctttattttatgaaaccgaggcccagagatataaagatatttgcccaaagtctcactgctggttaatatgagagctgagactaaaatatcttttactaatctcctgctgaatcttagatcatgatacataattattagcacttttaaatcacagtcacaagccttgtatttttctaagtaagttagaaaatggtgttgtcccccatagtattgcataccacttggtgaatgaatgaatgaatgaatgaatagacacccttaagggaatataagaatgagattatttggaacaggaagagcatgttacgcaaaatgaaggcggactatgggagactaggtttaataaatatcccctggccaattaaaaaaatgtagatggcatcttttccaaatttctgtgactttagctcttagtcccttgttcaattgcctcgtctattttaacaggtgatctaagtgagcctacccaagaacagaagatgaggatactcataacaatagattttattattaaaatatagactaatgtttcattactgtgttattcactagtgtattttttaaagcagggatatactggtcatgactactgaacataaatgaaccaaggagttcattactgagggtttaagtggaatatttttcagtctcctggagtagccttttccacttattttgttttccaaatattgcctttgtgtatatatgagttactgaagctggctatcaagggatttcagcaatcgagagtcccttcaagattgtaatcactgccatctggatctcaaagatcatccagtcgcctggttcccagcctgaccttcccattggagtcacctggggactaagttccacctgcagagcttctcatttaattggcatgggctgtgacctggacagtgggatatttttaaacctgcccagatgaatccaatatgcagcagtttgagaaccactcaactagttcaactccatgaatttaaaaataaagcaactgaagccaaaagaggttttgataacagattgaacagaagagtttgagcagcttttgataaacactaagcatggcactttataaagtttttataatccatttttgcattttctgaaaacacaggtcaccccaggctctacctgtgctgtgtttggcctgggaggggtcggcctatctgctattatgggctgtaaagcagctggggcagccagaatcattgcggtggacatcaacaaggacaaatttgcaaaggccaaagagttgggtgccactgaatgcatcaaccctcaagactacaagaaacccatccaggaggtgctaaaggaaatgactgatggaggtgtggatttttcatttgaagtcatcggtcggcttgacaccatggtatgtaccatgacatgccctgagatttctgcctctacaacttggaggatgcatttaggctgcagaatatatgttttctgtataaaggatatttttaatgatgaatggaaatttcccatcatctgtttgttacctggcttgtttaatttattgttatgaggaatcttttattctatcaactatgcaaacgtgtctcaagtcatatttcctctagaggaaaagcaaagggcttgtttttcttaactgagtgataatagattactttgttaatttttagttaaaaactgtaagttaaagtaaacataaataatacaagttctgttctcaaattggaatgttttatttttctgccacattcttaacaaaaatgatttaataattttgcatatgttcttaataaattccaatttttttaaacatattagtatttggccaaaagaagtaagcaattttaggccaactattgttttattaacaaaaacatgccctaaggaaagtgaagctcaaatgcattactatattttatcacagaaactggacagtacctggcacaaaactagagcccaatactagtaggactgaatactttgaaaagtcaacagatttttatcaccccccaaatttcaaagctatatactcatggcattgtttatagattgcatgagacaatgcatgtaatatacttagcacagtgcagcctgtcatatggtaagctcccaataaatgtcttctttttatttgagacagggtctcactctgtcacttaggctgaagtacagtggcataattataactcactacagcctcaacctcctgggctcaagcaaatctcctacctcaccctccaaaaatgctgagaatataggaacgagctaccacgcccggcctcagttggcgttattgatatgaaatactatttccaatcttgcagtacttacatcatctttggcttattacatgatattgctttcaaacagttacaaatatcaaaggcaatgggaaacacatctctagctatatttcacctacccagaattctctagaatcctactgaaaaagtctccagagaccaacacgtttccattgccgagattttctagaaggtccagcagtgtgggtaatggggagcagcaccctgagatcaatgctctcagcagccttgccctgggacaaatgccacagatgaatgaagtgtcaagagattccactttttccagggctatagcttttctcctaatgttcttttcctgtatcttcctccattttctcatgtggaacgggagtgtaccttatctcaagataccaaatatctgacagccacatgttctgaggatgtctggtctcccaaaggtcagaatccaaaatcaaagaactaatcattacatatcttggggcaatcctaaaccattttctaactatagaacatgttcagaaagctcactggaaaagactttctgaacggtcttttgaggttccctaataatcagggtattttaatgtaaaacctatatatatttggggagataaaaacaatgtttaaaacatgtccatttgagaaatggacagtagaacaggaatccattacaaaaggagaccatcaagtggacaagagactactttggtgatataatcatttatcttgtttcccattaaaatatgtggttgaaagtaatgggttcaaaatacctatgtaataaatcaatgaaaaatgaattaaccaactcacagattgcctaagaattatgtgatgatgaaattgtatgcttatataaggaactggacttaatatatatttgtgatgatatctaccactttattcctttattaggaaaaattaagtgcactccaatttattcatccattctttcattaaaaaaccgttttctgggcatttcctaaatccacagcactatcccgtgcaaaaaaggggactgaaggagcaaaagacataatctcttccctctacacactcacaatccagttaagcctattacatgata

SEQ ID NO: 14839 - DNA, 52636 bp, Human
  misc_feature (1)...(52636): n = A,T,C or G
ttaaaatatcttgtagtaactctttaaaatgtatgtaagtaaatggctgcagaaagtttttttagagaatcctgcttccatcagtaatacagcaatattaccccatccactaatggtctttgtttccttaaccactactcattaatccttaatcacctcattcaaactaattcattctgcatttttgagtaccaactcttgtcaggctcagtggcagcttctacgacctgatggatggaaaaaaatcaaactctgtgactctatggttgactgccacctctgcaaccttgactcatctgctgaaaaggcaagaagaagaaagggcagcaagccctgttttagggactacataagatgaggggagataagggggacatagatgagttctttaggattgcgtgtgttttgagtttttgtttctaactgaagaaatctgtcaatattaaatagggtgggaaaatggtttcttagaataactgttcaactgtgtgtaaataaggaaagttttcaatgagtattacttattgtaattaatgcagaaggacttccccagtcaaccgaatgtctcggccttttactcagacaagtagcatctcattaaacccattcatttagcattcattcagctggacctactgtgtcaggtccagccccaactagatcaagcagggattactgtatattttacagatgggagtttgatgcagagaatgaaccatgcacaggtcacacagtgagtgcacgctgacccaggcagtgtaacggtccactctcagcgtgtgcctcctaaagtactaacttgtaggttcaaaaccaatgtggaaacaactttgaccttagaacgccataaagccatttgtgcagtgacttgtcaggactcaggatgttttgtagggactataatgtgcatgtcggtagggagaaagggactgacatttggggacgggatttattggagacaagagtacacatttagacaggggctctcacggtgggctatggatgtttgaggaaggcccacaggaggtagaaaggtagatggaaagagtctccaggacgggcccacgcctgtaatcccagcactttcggaggctgaggcgggtggatcatttgaggtcgggagttaagaggccagtctggccaacatggtgaaaccctatctctactaaaaatacgaaaaatagccaggcagtagtggcccctgcctgtaatcccagctactccacaggctgaggcaggagaatcgcttgagcctgggaggcggaggttgcggtgagctgagaccgggccactgcactgcagtctgggcgagagagaaaccctgtctcaaaaaattaaagtctctggattccctcgtgtgctttaggggagtctgtagagcaggtctaggaatgacctaaaagcttgggctggagtaggggaagcttaagttctgtgcagttgaagttcaaggccagcctatggaagatgcgtttcactgggagtgactgatggagtggagagggtaccagagggggtccacgaaggccgctggtatcagggcaggggccagaatgggaagcggcagaggtctgtacatcctcacagggcagacctcgggaagcgctctgggtgggctcggtaaaaatggcgggggtgcgaggagccgttgcgtgcgtggcggttggtgcggtataggagactcctctgaccggactcgcctgctggccgcgcggcgggcgaggcccaggcaaaaacaaagtcttcccgctcagtaccggccccgcgaggcgctccagaggaccaagccttagctcgcgtcaccccacccccgcgcaggcgcgtttaactcccgctcgcctcccgccccttagcaaccctcccgcatcgttgggccccggcaatagccaatgagacaggagccacgagaacacggaccaatcggcggcggcgacagtgtggaacgcggttgccaggaggcgggacgcggcggcgtgccagcctagccactctagcgacggcggggaagagtgtgtacgtggtgggggcttcctcggtggcgggcatggaggcttcgcgctgccggctcagtcccagcggcgacaggtcagacagggccgtggcaggtctcctcctgagcgaggcggaggggcgaagcgagaaggcggaggtcctctccgggagccctgcggggagagggcgggactcgggacttggcgactcagggagggactggtttcggcggcgggaggcgaccccctcgccctactcccgtgtggggacccctttctcaagtggagcggcggcactacatcccgcgccgtgggcagagacctttggttcaggtccctgctcaggaacttctggagttttcgtgacgggctccctcggcccctctgggcctcgggtttccctcgggggagaggcgctggccccgctcagctcccactgcccggcggtgtcacagccgagaagggacccagcccctcccgggaggcggtgcgggtgatgtttagtagcttgttctgacgccgctgcttcggacgggtaaagctgaattctggagcagagtccaaggagcggaaacgcgaaacttctttttcctctctgctttccagtgtttgtccctgattcgggatggtctgactgatttgccagtgggccacaccccttgtttgtgcgcctctttctctgccagagggagagcctcggaaaaaaaaggatccaaaatctcagcgtgtcactttcttgttcgctaggttaatgagaagttaatgggaagccgtttgaaatcattggttagaaactttggcgtcatctgaggatttaagtcctacacgccaactgtataccccgctttttattccattaccaagacaaagatttggggccaggcgccttggaacacgtctattatccccagcactttgggaggccaaggcaggaggatcgcttggtctgaggagttcgagaccagcctggacaagatagcgagacccccatctctagaaaaaaataaaataaaataaaataaatcagtcaatcaattaaaatttggccggacacggtggtgcgcgcctgtagttccagcgactcgagagactgaggagggaggattccttgagcccaggagttccaaactcctgtgttgggccactgagctcgctagcctgggcaacgcagtgacatcctgtcaccttaaaaaaaaaaatgatttgacatgtaaggatttagtttgatatttccactagtagatatttaaacaattttaaaccatttttaaaaattgtcacaaaattgttgggggtaaagaacatgtattttcctttttcgtcaagttctattgaggtgatagctgcactctgaaatttgttcactgtgcttttttttttcccaagtcgaggaagaaaactacatttacaggtgtaagtggtagaggagataaggttagtattcagcatctctggttgaattcagaaaatatttgttcagttgtgggcgctcagttttaattccatgaatttaaagtagtaaatttcatgagtaccagatgtttgatatgactcagatttttgggggaaaaaaaacgggatgcgggattgactttgaaattgggaccaagaggcttttccttccttttttttttctgagacggagtctctctctggcgccaggcggtagtgcagtggtgcgatctcggctcactgcagcctccgcttcccgggttcaagtgattctcctgcctcagcctcctgagtagctgggactataggcacgcgccaccacgcccagctaatttttgtatttttagtagagacggggcttcaccatgttggccaagatggtctcgatttcttgacctcatgatctccccacctcggcctcccaaagtgctgggattacaggcgtgagccactgcgcctggccccctccttgttcttccgaaagaaactagctctttaaattttattttcttttcttttaattttaattttttttttttttttgagacagggtctcactctgtcgcccaggctaggatgtggtgggcgatcccaactaatttcaacctcttccccaggttaagcgatcctcccacctcagcatccctagtagctgggaccacaggtgcgtggcaccacctggctaatttcttgtattttttgtagaggtggggtttcgtcatgttgctcaggctggtgtcgaagtgagctcaagtgatctgcctgcctcggcctccaaaacttctgggattacaggcctgagccactgcacttggccctaaattgtaaaattgacatcaaaggggaatgtgtgagtcaccaaatgtttctcctgccctctgtaatgttagtgcaacttctgtcagtgtttaactcatttgttactaagagggagtctcttgcttttttctctttttgggcttcaggttgtgtgtttaatgtggtttttttttttttttttccaaacggagtttcgctctcgtcgcccgggctggagtgcagtggcgccatcttggcttacttgcctcctgggttccagtgattctccagcctcagcctcctgagtagctgggattacaggcatgcgccaccatgcccggctaatttttatatttttagtagagagggggtttcaccatgttggtcaggctggtcttgaactcccgacctcaggggattcgcccgcctcggcctcccaaagtgctgggattacaggcgtgagccccccaaccctgcctggctgtttaatgtttttgatgaaatacattgatagaattttctgtattactgcctttcaatgtaaggataacaaccaacttttaggttttctgtgtttttttttttcttggaattatgtaacttttatcatgaagcagatttattttcaacaaaatagagaaattattaactacaaatattttttttaatttttttttttttgtagagacaaggtctcactatgttgcccaggctggtcttgaagtcctggtctcaagtgatcctcctgcctcagcctcccaaagtgctgggattacaggtgtgagcgaccaggcttggcctattttcttatatcagaaatgtttagtgaaaattggaggtgaaatttgaaacaacactcaggacctttgttgaggctaggcattttataatatagattccctggagatgacgggggttggctggtgctggaacttgagccctatctggccttttgtaagtgatagagaattgagaattgaaggcgtgcttcccactgtggtgtgaccttgtgagctggagtcatctaagaaatcccagtcggtagtttgtccatataccatgatttctctttagaaatataaacagtaggctgggcatggtggctcacacttgtaatcccagcaccatgggaggccgagatggcgggggggtggggcggggggggaatcacctgaggtcacgagttcaagaccagcctgaccaacatggagaaaccctatctctactaaaaatgcaaaacttagccaggcatggtggcaggtgcctataatcttagctactcaggagctgaggtaggagaatcgcttgaaccagggaggtggaggttgcagtgagccaagactgtgccactgcactctagcctgggtgacagagcaagactccgtctcaaaaacacacacacacacacacacacacacgcacgcacacaaaaaagagatctgtcaagataaaaagctcaataataggctaggtgcagtggctcatgcctgtaatcccagtactttgggaggcggaggtgggcagatcacgaggtcaggagttcgagaccagcccaaccaacatggcgaaaccctgtctctactaaagatacaaaaattagccagttatggtggtgtgtgcgtatagtcccagctactccggaaactgaggcagaagaattgtttgaacctgggaggcggaggttgcggtgagccgagatcacaccactgcactccagcctgggcgacaagagcaaaactccatttgaaaaataaaataaaatgaaataaaaataagaaatagtgaaaataaataacattcccgaagagagaaaatataacccctgagaagggagaattgggcaaaagttaaaacgaacttaagttctgagtaatgtctgtttgaatctacaagtaataaatgcattcttttaacttctggattaaatcatacatcttaaatagcctttttgtttagttcactcaaaagaatgctttttgcttttgctgtgtggtacttgcaaaatcaggaggggtttactctaaaatagttttccctgcagcattctttggggctatgggaatgctcaaatcagcggccagcctttgcttctcattgcctccctctccccaggcagttctccctgctctgattgtgtctctactaaatgggcctcctaggaaatggatgttcattccctggcttcaattaagttagctccagattgtggccgtctttcaagtagaggacagctgagcttagaatactaacatttctccctagatgaggaaggatagatgtcaaaggaattcttttctgacacttctcatatgacctttatgtgtcttttctcagaagcaatattttgttcaagccagatgtgttcttggtgtgtcagtatgtgtaaaaacatggccttcgaatattgacatttaggatttggacaaggtgaacctatttgtcaattgagttaggaaacatactttgttaatagctctttccacaattatctgaaattgttatcagtttgaacatgatgaaatctgatgactcactctatacagttatttgccacttaatgatggggatgcattctgagaaatgtgtcattagtggattttgttgtgtgaacgtcatagtgtacacaaaccttgatgggatatcctactacctacctaggccctgtggtacagtctgttgctcctaggctgcaaagctatacggcctgttactgtactgaatattgtaggcaattggaacacactggtaagtattagcgtatctaaacatctaaacatagcaaaggtacagtgagaatacttttttttttttttttgagacggagtcgcatctttgttactcaggctggagtgcaatggcatgatctcggctcactgcaatctctgcctcccaggttcaagtgattctcctgcctcagcctcccaagtagttgggattacaggcgtgcaccaccatgcccagctaattttgtatttttagtagaaacggggttttaccatgttggtcaaactggtcttgaactcctgacctcaagtgatccacccgcctctgcctcccaaagtgctgggattataggcgtgagccactgtgcctggctgacaatgtggtgttatcatcttaggggacccctgttgtatatgcagtatggttgacctaaatgtcgttattcagggcactcctccccagggctgcttaaaaatccattcactggcttggaagttctacctaaaaatagcaagtcagctggcatttttaatgaacatattgaaataccagagaatgaaattcctgtctctgctgaccattttaatacacgtgttcagtcgtgtggtttaacacattcaggtagattgggagtgagacttgtgattgaattcgggctctttcgctgatcagctgtttgacctttagaatatgaactatagttgtaagtttaaaattgctttcctgtgatgtgtagaaaataaggctgtaacaaagcaagaaatatttttcaaatatgctcctggaaaaataaaattattgctatttagcttttcaggaagaaacttcaataaatctacaaggtaggtgctataatctcattttacagagagatatgaaactcatatgaaaggagttcacctcctttctcccgaaattcatttagagcatctatgagtttcatatctgtctgtaaaatgagattatagtgcctactttgtcaaggttatcgtgaaaattatcacacatcatatgtgaaaaataatatatatttaatataattcctggcaggcagtattaaatattcactaagtagaactgtacttaagtgcaactagcagagtgacaacacattttaacaatgtttcaataacaatacaattttggacttttaaattttttttttggagcctcgctctgtcgcctaggctggagtgcagtggcaggatctcggctcatggcaacctccacctcctgggttcaagcagttctccctgcctcagcctcctgagtaggtaggattacaggtgcctgccaccacccctggctaatttttgtatttttagtagggacagggtttcaccatgttggccaggctggtctcgaactccttacctcaggtgatgcacctgcctcggcctcctaaagtactgggattacaggcatgagccactacgcccagcctaaagatttttttaatacaggggaaattattagaaatttctgggtttccaacattcgaaagcttttgaaaggtgataaagtattatgatgaaatcattagtcttctcactgaagtgaagattaaggtaacacattcatttgtagtattaagaagtattgtaaaacaaaaatcttcccaggcacagtggttcaggcctataatgctagcacttagggaggctgaggcaggaggaaggagatcacttgaggccagtagctcaagaccagcctgggcaacatagtgagaccccctgtctgtctgttggtctgtcatgttcgtttgttctctctctcaagagatagggtcttgctgtattgcccaggctagtcttgaactcgggcctcaagtgattctcccacctcggcctcccaaaatgctggaaaggcatgagccactctgcctggcccgagaccctgtctcttaaaaaaaaaaaaaaaaaaaaaaaattctaggcccagtgcggtggctcatgcctgtaatcccagcactttgggagggcaaggcaggcagatcacctgaggttaggagttagagaccagcctgggcagcatggtgaaaccctgtctctactaaaaatacaaaattagccaggtgtggtggcgcatgcctgtgatcccagctacttgggaggctgaggcatgagaatcacttgaacatgggaggcagaggttatagtgagccaagatcgcgccattgcactccagcctgggcaacaagagcggaaactagatctcaaaaaaaaaaaaaaaaaaaaaagatataatagcagttgcagtttgagtgcttactatgagccaagtttcatttaatcttcacaataaccttctgagttaagtgtcattgtcctcactttgtaaattaggaaacttgaggctttactaggttaagttgtactgggaactgtgctgtaaccacatagcacacgtctctaaatggggacttacaattagtttgaactaatataggccaagccaggggtcagcagacctttttaattattttttttcagatggggtcttgctttgttgcccaagctggtcttgaactgctggacttaagccatcttcccgcctcagcctccctagcagcggggactataggcatgcaccatcacccctggccagtagtccttttctgcgaaggtcttaaccaaacgtttttggttttgtgggccatacagtctctgtcccagttgctcattactcagttttgctgttgtagcacaaaagcagccatagataataggtaagtgaatgaatgtgtctatttcaataagactttatggacactggaatttgaagacttttttctttttattcattacttcctgcacagtgataatttcttttgggctggggggacaggttctcactatgtgcccaggctgagtgcagtggtgcagtcgtagcccacaacagccttgaactcctgggttcaagcagtcctccttcctctgcctcctgagtagctgggattacaggtgtgcaccaccacacctggctaatttttaaattttttgtagagacaggggtctcactatgttgcccaggctggtctcaaactcctggcctcaagcagtctgcccacgtaggcctcgcaaagtgctgggatgacaggcatgagtcactgcacctggctggaatttgaatttaatataatttttacatgtctcaaaatattattcttcagatatttttaaccttttaaaaatgtgaaattcataggctgggcacagtggctcacgcctgtaatcccagcactttgagaggctcatgcgggtgggtcacctgaggtcaggagttagagaccagcctgaccaacatggagaaaccatgtatctactaaaaatacaaaattagccgggcatggtggcccatgcctgtaatcccagctactcgggaggctgaggcaggagaatcgcttgaacccaggaggctgaggttgtggtgagctgagatcacgccattgcaatccagcctgggcaacaagagcgaaacgacgtctcaaaaaaaaaaaaaaaaaaaaaacagcgaaattcattcttagctcaaaggcagtataaaaactgacggcaggccagatttggcccacacgctatagtttgcagcccctgtgctaaatcataaaagtattttttcctggaaggtcatagttattcatactgtgaatattatttaagagagcattgaagattgtttttatattaaaatggaacccgttaccttatggaataaaacccagaatttaattttcaagataaaacttggaggcgggggccgggcgtggtggctcacgcctgtaatcccagcactttgggaggccaaggtgggcggatcacgaggtcagaagttcgagaccatcctggctaacacagtgaaaccctgtctctactaaaaatacaaaaaattagccgggtgtggtggcaggtgcctgtagtcttagttactcgggaggctgaggcaggagaatggcatgaacccaggaggcggagcttgcagtgagcagagctcatgccactgcactccagcctgggcgacagagcgagactccgtctcaaaaaaaaaacaaacaaaaaaaaaaacaaaaaaaacttggagacggctgtggtggctcacatctgtaatcccagcactttgggaggttgaggcaggcgcgtcacctgagatcacgagttcgagactagcctggccaatgtgttggaaccccgtctctactaaaaatacaaaaaaaaataaaaaattaaccaggcgtggtcgcactcctgtgttcccagctacaggggaggctgaggcaggagaatagcttgaacctgggaggaagaggttgtagtgagccgagatcgcggcactgtactccagcctagcgacagagcaagactctgtctcagaaacaaaaacaaaaaaacttggattctaaagatacgttgttctgtagatggtctctggaccgtactttcctcctttctcctcaatttcatttagagcataaaagcactttcttaggctgtttgaagcacttggattggaaatgttgcctacagtaacctgtataaacatcaatatatcaataacagattattagtgcaaaatttaaatgtccaaaaactgaaagggaataatgatcggtgactgggtctatgaaattacaaaagtaaagcctaagggagatggcaagctttcctattctgctacccttgtcagctgatgtcttggtagaattaataaagtactctttttaaactcaaaaacatctgttttgaataatacttttttttttttaacaccctacctttgaggtaactattgttaatagtttgtgtatatccttctggaattcttctattcctgtagaccttgcagatacttttttttttctacttgcagttatttttattttttgttttttgagagtgtcttgctctctcaccctggctggagtgtggcggtgtgacgatagctcaacctcctgggctcaagcaatcctcccacctcagcctcccaagtagctggaactataggcatgcgcaaccaagccgaaatacttttttttttttttttgtagagacggtttcaccatgttgcccaggctggtcttgagctcctgggctcacgcgatcctcttgcctcttaaagtgctgggattacaggcgtgagctactgtgcctggccatgttgtggtttcagtacacacttacctaatgactaaccatattggatatcttttcatgtgcttattacccattcggaaaagttcttttgtgaatattttgggccccctccccccacctcttttttttgagaaagggtctccgttccccaggctggagtgcagtggcacaatcacggcttactgcagccttgaccttcctgactcaggcaatcctcctgcctcattctcctcaagtagctgggaccaccggagcgctccaccacacctggctaatttgattttttttttctttctttctttctttctttttttttttttttttggtagagacagggcctccttatattgcctaggctttttgcccaatttttattttgttttattttattttttgagacagagtatcactctgttgcccaggctggagtgcagtggcgtgatctcagctcactgcaacttccgcctcccgggttcaagcgattctcctgcctcagcctcttgagtagccaggaatacaggcaagcacaaccacacctggcttattttttgtatttttagtagagatgggatttcaccatgttggccaggctggtctccagctcctggcctcaagttatatgcccgtctcagcctcccgaagtgctgggattacaggcgtgagctaccgtgcctggctccaatttttagttaggttgtttgtcttaatctgtaagagttctttagattctaaatattaattttttgttggatatatgtttcacaaatattttccctagtttgtggcttgccttctaattttcataacagtatctttgcagaacaaaaatttttcattttgatgaagtccaacttgctgatttttaagtatgtgaatttaagtaaaagtcataatcatacctacagtttttcttctaaaggatgttagtcaatcttcaaataagcatgaataactagatttaagaataaaaaattgttttttgtagttgttttcttgaggtaaaccttttatttcctttatctttcctgtgtaatatctttgcagtaattccttgtctcacacatactatgtttatttctgataggttgagttgaaccaaatttttgtaaattatatttattttagcttcatgcagcagctgattactaaatatttacaattatgaatttctctaaattgccaagttgtcctctttatcactgcacactggcacttgttgcattaatgagagaagataactatatctaatttctaagtctaaaaaacatcaatttgtgatgttctgaagcaatactgtagtcagtaaaggaagccttcactcaagttactatcaggaaaagcaacgggctgctcacaggctttatttttgcaagtcttatcctgctgctttcctggcaaggatggtgtttactctctccagtaccacagaaggagcctgtttagcctcctgcatcagtggccaaattgcagttgagtgctgattacagcatccttatctggcatagtgtaggaagcagcaagaaacactcttgattgtttagtggcaatagattttgtgttactggcagctcgaaaaatttacacttaacaggctgagagaagttgacaggaacattgagagtcccgaataatcatagattcttgagggtcattagtaacattattcagtgcttcaaagtacttggcagtgtggtctgttgggtatagcactagactagcaatggagagtaacgttttaaagtatgctcaaagtttctctgttacttatctttagcaaatttcttcattgttcataccatcttcattccctagaaatactgtgtgagcataatttaggtgctagattaaagggcaatgggatttttttttttttttttgagacagagtctcgcgctgttgcccaggctagagtgtcatggcgtgatcccagctcactgcaaccttcacctcctgggttcaagtgattgtcctgcctcagcctccagagtagctgggactacaggcacggaccacaacgcctggctaatttttgtatttttagtagagatggggtttcaccatgttggtcaggctggtctcgaactcctgacctcaagtgatctccccacgttagcctcccaaagttctggaattacaggcataagccactgcacctggtagcagtgggatttttaaaggtagccagtccacaacaatgaaaaaaaaattaccaaaatgtatattttctttttttctctttgaaaatgtatattttctttttttctattttgaaaaatttggccgggcacggtggctcatgcctgtaatcccagcactttgggaggctgaggcgggtggatcacctgaggtcgggagttcaagtccaaccagaccaacagggagaaactccgtctccactaaaaatacaaaattagccaggcgtggtggtgcatgcctttaatcccagctacttgggaggctgaggcaggagaattgcttgaacccgggaggcggaggttgcggcgagccgagatcacgccactgcactgcagcctgggcaacgagcgcgagactctatctcaaaaaaaaaaaagaaaaaagaaaaaaatgaaatttgctgaaaagttgcaagaaagcacagttgataaacctatgcccttcacctagattcatcactaatattttttatacctgattttaaaaaatctttttagacttacagaaaatttgcaaaaatattagagaatccctctatacctttcaccaagtttcccctaatgttaacatcttcttttttgtttgtttgttttttttgagatgaagcctagctctgttgcccaggctggagtgcagtcagtggcacgatcttggctcactgcaacctccgcctcccgggttcaagcgattctgtagcctcagcctcctgagtagctgggattacaggcgcccaccaccacgcccagctaatttttgtatctttagcagagatggggtttcactgtgttggccggggtggtcttgaactcctgacctcgtgatccgcctgccttggcctcccaaagtgctgggattacaagcgtgagccaccgtgcctggcctaatgttaacatcttatataaccatagccacattatcaaaatcaggaaattaatatagaatcagtactgttaactgattcacagtccttatttgaattttgtcagttttcccactaatgtctctttcctagtctaggtttttttggtgtccgtaaataaaggttcaccacattgtcagaaaattctctttctgtacactgtgcagtgttgtaaggccttgtagttatcttcagttagtttttattttatctgtctgtctcacctatatctatctgagatggaatctcgctctgttgctcaggctgctgtgcagggtcacagtcacagctcactgcacccttgaactcttgggctcaagcactcctcctacctcagcctcctgagtagctgggaccacaggctcatggcaccatgcccagcaggtatcttcagtttagcctttactggttggtaaatggagaatagttcaagagaatggtgttctatgggcattctcctctgccacgcttgagtgtttctgtgtttcttcaagatgtgtgtttagggtttcccctgtttgtaccaagaaaataggaaattttctttgagaaaaatgagaggaaaaagaattactccacttttttttttcctgtagaaattctttctgttttgtgttgatttattaaccaggcttggttatggttaggcttactattcaataactaagttaaaatgaaggaaagagaatattaacacaggccgggcatggtggctcatgcctgtatcccagcactttgggaggccgaggtggtcagatcatctttacctgaagtcaggagtttgagacgaacctggccaacatggcgaaaccccgtctccactaaaaatatggcaggcacctgttatcccagctgcttgggaggctgacgcaggagaatcgcttgaatccgggaggtggaggttgcagtgagctgagatcgtgccactgcactccagcctggacgacagagtgagactctgtctcaaaaaaaaaagaatattaaatcagaaaaatgtaaatttattaagatgatattccagattagactagaaattttagttcagattgaatatgtctataaaatatcttttttttttttcctttgagacagagtctcgctctcttgccaggctggagtgcagtggcgtgatcttggctcactgcaacctccacctcccaggttcaagcaattctcttgcctaagcctcccgagtagctgggacaacaggcatgtaccaccacgcccagctaatttttgtatttttagtagagacggggtttcaccatgttggccaggatggtctcgatctcttgaccttgggatccacctgcctccgcctcccaaagtgttgggattacaggcgtgagccaccgcacccggccttataaaatgtctttataggttataatttaactaaaggtataactttttaaattataatttatttaaacttagaactcggagaaagtgtgacttttgatatataggagacttgtaaatgttacagttacttaacatgtatttattgtctcttctgttcaggtcaaaatgctttgattataccctatttattcagattgtctgttcagcttgcccaggcttgatgaaaggaatcaagtggtgtctagatgtactgtcagagacacacctgtttttttcactatttgaggccttaagagaaacgtttgaaaactttagtcatatgccagaacttagcatttttgaggaagttttagcatggatggggaatgatttgttttcccccatgccagaagtcatcacacctttggtttagtgttgagaacagagtgcagatttgtagcagcagctgtttgaaaatactagttcatggtggagattgcagtgagccaagatcatgccactgcactctagcccaggcgacagagccagaccctgtgtaaaaaaaaaaaaattttttttttttttttgagagagagtcttgcactgtcacctgggctagagtgcagtgacgccatcttgggtcactgcaacctccgcctcccaggttcacacgattctcctgcctcagtctcctaagtagctgggattacaggtgcccaccaccatacccggctaattttttgtatttttagtagagatggggtttcaccatgttggccagactgctcttgaactcctgacctcgtgatccgctggcctcggcctccaaaagtgctgggaatacaggcgtgagccactggccctttcttttttcttttttttgagacggagtcccgctctgtcatcctggctagagtggtgcagtggcgcaatcttggctcactgaatcctccgcctcctgggttcaagtgattctcctgcctcagcctcctgagtagctgggattacaggtgcatgccgccatgcccagctaattttttgtattttagtagagacggagtttcaccatgttggccaggctggtctcgaacttctgggctcaggcaatccacccaccttggcctcccaaagttctgggattacaggcatgagccactgcgtctggcctaattttttttaattaaaaaaaaatggctgtaatctcagcacttttggaggccgaggtgggtggatcacctgaggtcaggagtttgagaccagcctggccaacatgatgaaaccccgtctctactaaaaatacaaaaattagccgggcgtggtggcacacgcctgtaatcccagctgctgaggaggctgaggcaggagaatcgcttgaatctgggaagcggaggttgcagcgagccaagatcacgtcattgtactccagcctgggcaagaagagtgaacccttcatctcaaaataagtaaataaataaataataaattttaaaaaatgaaactactagtccataacagtggacttttttctccaagttttccttttgctatataatgtcattttatgcagaactttaaaaaatttatactgatacacggccaggtgcagtggctcacgcctgtaatcccagcactttgggaagccgaggtgggcagatcacttgaggtcaggagttcaagaccagcctggccaacatggcaaaaccccatctctactaaaaatacaaaaattggccgggtacgatgcctcacacctgtaatcccagcacttggggagactgaggtgggcatatcacgaggtcaaggtcaggagatcgagaccatcctgtctgactggtgaaaccccgtctactaaaaatacaaaaaattagcccggtgtagcaacgtgcacctatagtcccaggtacttggaaaattgaggcaggagaatcgcttgaacctgggaggcagaggttgcagtgagccgagattgtgccactgcactccagcctgggcgacagagtgagactccgtctccaaaaaaaaaaaaaaatacaaaaattagctgggcatgatggtgcatgcctgtagttctagctactcaggaggctgaggcacgagaatggcttgaacccgggaggcggaggttgcagtgagatgagttcaagccactgcactccagcttgggcaggagagagagactctgtctcaaaaaaaaaaaatttttttttattcttatacacactgaacacctgtaatgttctagcactctagttttgtttttgttttatcttttttttgtcacactatattaatgaacgatttttaaatttgggatttaaaaatacatgactgcagataaaaaacattaaagaaacataggaacatatgtaggtgaaacatggggggcacaaagtcaaggccagaggctgttgtatctgacatttttgtttatttgttcctctttggagctgggagaaaagagatttattgagcacccggtgtttttttatttgttttttaaacatgaaggtcatgagtgaattaatagagaggcatgtcagaaaatcacaaagcacctgcacgtctgtgtgagggttgttaaacgtgcctcccaggtgatgaagaggaagaatctttgagacagcatgcaaattgaagttgctatgcattagtaagatgcatagaaccttctaaaatgtaggaatatagtggcacaccattaagccatacataaatgctttggtatatttgccccaaatgtagcaaaaaccatgtttctctttgtggtaatggaatttgtcttcttaaatagcaccttgtagttccagtttttctggcgctaagttcccagtaaacatttatcatccaaataattgagaaccatttatgccttatttcatacttcacactttccaagaatgccgagtcacaaaataaaagtcttaaattaggaaattgtcaaaaatagaaaaggcttcagagagaggttttttgtttttttctgtttgtttgttttgagccatagtctcaccctgtcgcccaggctggagtgcaatggtgtgatctcgctcttctccacctccccggttcaagcgattctcctgcctcagttcctgaatagctggaattacaggtgtggccaccacacctggctaattttttgtatcttagtagagacagggtttcactatgttggacaggctggtctcgaactcctgaccttgtgatccacctgccttgacctcccaaagtgctgggattacaggtgtgagccaccatgtgcctggcccaaaaagtttttaaatgttcagaagggcttggtttatcagctgaagactggttttattccatttttattgtttttttccttcttcaagcaaatctgtctctcagtggcaataaatgtcatctgttcatccatacttaacagtcctcctctcctttgatgactggcatagtaagtgttattaatgacagacttgagtaagtttagtgaaatgcccagatcttcaggaattcagtaggctctagtaagatgctatacacagtgaaatttttcccgtcttagaactaactccaaaaaataaataaatatatttgatttttcagatgtaatttagatgccagaaggagaccagaattggggtctgtttctgctgtttagccttacacatgactcttcaagtctgtttcttcatcttcaaagtgtaaaaaataatggtacctagttcctagggctgtttgaaagaataaacagaataataccatgtaaaatgcctaccactgtgttcagagcataatgcgtacctaagacattgtttaaaacaaaaggaaatccctgcatgcatggggtctgtgttttcatctttttcttgtccttggagtatttcagtctcctcaggtcctctggaataagtgtggtgttaagggtgggaagtcctcctgtagccagtgtgggtagcctctagaagctgatgccttctatgaggcagaatcgattggttccaaatagcccaaaagagtacatacataaaaagatgaaattgacaaggcgttttctttttatatacttgctttatttttttttttttaacagtgtcttccatgaagaaatgatgaagatgcgacaggctaagctggattatcaggtgagcagagtctcctcttttgaaataggtggccaactatactgaccgtgatgctgatggtcttggctctgaagcctttggcagggctatggaaagaagactggaaaggagaaggctcgggtggttacctgtgaagcagtgtctggagttagtggttgctgaaccaaggctctggctatggcaagaccaaagtgctttgaggatgtcagcaacaagactggccttggatttacaatcaccaaaaattccttggcgcctttctttctgaggaattagaagagtgttaacattgtatttctgtgtagtaatttggttctgctaccttaagtacctctctacgatgtcatttcacttaactgcaagatggtgttcttatgcgaaaatgcatatccgagcttgctgccgtgctgctttcaaatctccatcgcagggccgggcgcagtggctcacgcctgtcatcccagcactgtgggaggccgaggcaggcagatcacgaggtcaggagatcgagaccatcctggctaacacggtgaaacccagtctctactaaaaaatacaaaaaattagccgggcatggtggcgggcacctctagtcccagctactcaggaggctgaggcaggagaatggcgtgaacccaggaggcggagcttgcagtgaggcgcagcttgcagtgagcagagcaagactccgtctcaaagaaaaaaaaaatctccatcgcatagagaataattttcttcatagagctgctggcacatttagtttgttttctccattacactaagctctgtgagaacagagccaagcatgttttggataaccattatatcagaagttctcagcacagtgctggacatgtagtaatccttcattaggtatttgaacaaaggaaggactaaatgaacggttttgtgttgttacatgctgtgatcatcatattcaggtagcttagaacgtatacccaacatacattgcatttatattcgcttttttctatgaatctattctaattcagcaaattctgtagctaggatcgttaacagtcaagatgtctggattcaataggtgactaaaagtctctaaagttttgtcttctcttctttatgtggttggtggaactaataatgggacttctagcctaataaattattttaaaggtggaattactgaaaactaagaaacaaactaatttactgtgatcttggagaaaattctgttacacacacacacatatacatacacacttatccctctgcccgcagagatcacagtaattgtgatgagccctttattttcttcattctgttgcagagcaaattgtatttagggagaagtgggcacaaaaatgtagatctttgatttatttttattcatttttattcttaggcatcctagtatcgtaaggcccaattgtacctactttgttaacattagataaaatctatggttcatctatggatcatgttctaagacatcaaactttaaattttgtatatagatacattttctgagtttttttttttaaggtggccctaatattttgtaattgtattcttttcattgaaaatgctacatgtgataataaatgttgtaacttttgtaagcctttttgtagcacaattttttttaaattatgtttttacataggtaataaaaacataagaattcaaataatataagatagatgtttgatgaaaacatctctctctgcttggctcagttctttatcagtggctatcactgacttttaatatatcttccagagatagtcagtgaattttttttttttttgagacggagtctcactctgtcgcccagactggagtgcagtggcgcaatcttgcctcactgcaagctccaactcccgggttcacgccattctcctgcctcagcctcccgagtagctaggactacaggcgcctgccaccacgccaggctaatttattttttatttttttttaatttttactagagatggggtttcactgtgttagccaggatggtctcgaactcctgacctcatgatccgcccgccttagcctcccaaagtgctgggattacaggcgtgagccactgcgcccagcctttttttttttttttttttttttttttttttttttttttttttgagtcagtgaatttagagacataaaattttataggagttttttttacatgcctaggagtttcaaaggaatattttaaaattaaaaaatctctttggatcagatgtatacattctggtgttaaataacgtacgagaagctggcatggtagtgtgcacctgtagttccagctgcctgggaggctgaggaggaaggatcccttgacctcaagtgttttagttcagtctgggcaacacagcaagacaccaccctccatctcttaaaaaaaaaaagtgtatgagaatgttgttagagccatgaaatgccaatatgtgcttaagaaggaagtcactcagtagggggtaagggaatttccacaaatgcaagctgagctttcaaatggtgtataacagcaacaaaggcagcaccacataatgaagaaaacattgggctgggaatcagaaggctttggtctagttctggctctgccattattcagctgtgtgattttaggtaaagttcttaaagtcagttggcctcagtcatttcatctgtagagtgaagttagactggataaaataatagaatgttagaaagaatcttaagcgtgtctaagttagagccaagatggaggcatattgaggaagggcaggctacagctcagcccaggcatcccaggtgggcagtatcttggtgcgagcttcacagtccagagtaggccagcctgcccaagggatacagtgcacacccatcagtgacggtggcacatcctagcagttaccctcaatggaggtggcagaggctggggaagccctgcccagatgtacattagattagactcaggaattctgctatggcagtgtccctttggttaagtgtcactggtcatgagctctgtaggataagaaacagctaaaagcaaccaaagttaatcagtctcccgaggattggtttgtattagccagtctcgtaagtgatgaatctgaatctgagaatcactttctagtgaactgtgttcgagaattagctggtcattacattcccagtagaaatatctgtgggaagtttgcgatcgggacatagcttggtatattcgaaatcagagcaggtagagtttgtaaaatgctatttatagtgacacattaaaatatgatagtaggattaattcacctcttctgaagggatatacctacccaaggaaggagattcgcatgtgcccaggacattctccctgccttagtgctagagacatagggtagatcttgttctttcccttaacacgttctttttttttttcttcttcttcttttgagacagtctccctctgtcgccaggctggagtgcagtggcacgatctcggctcactgcaacctctgcctctgtgcccagccagtttttccacattcttaccaacacttgttattgtctgtctgtgatttagagccattctagtgggtgtgaagtggtatctcattgtagttttgatttgcattaccctaatgactaattatgttgagtttgtgtgtgtgtgtgtgtgtgtgtgtgtgtgtgtgtggtggccttttatttttttttatttttttgagataggttctcactctgtcacccaggctggagtgcagtgatacggtcatagctcactgaagtcttgacctcctgggctcaagcgatcctcccaccccagcctcccaagtagctgagactacaggcatgcacgaccacacttggctaatttttcttttttcttttcttcttcctgtatttagagatgggatcttgcagtgttgcccaggctggtctcaaacttgtgacttcaagtgatcctccttcctctgcctcccaaagtgctaggattataggcatgagccatcatgcctggtcaagttttatagttttagcttttacactttccgtggtttatttatttttatttatttattttttctgagatgcagtatttctctgtcccccaggctggagtgcagtggcacaatctcagctcactgcaacctccgcctcccgggttcaagcaattctcctgcctcagcctcctgagtagctgggattacaggcgtgcgccaccacacctggctaatttttgtatttttagtagagactgggttacaccatattggtcaggctgatctcgaactcctaacctcatgatccgcctgcctcggcctcccaaagtgctgggattacaggcatgagccactgtgcccggcctctgtggtttacttctaaaactgacgtataataattgtacatatttatggggtacacatgatatttgatatttgatacatgcacacaacgtgtaatgatcaaattattgtaatgatcatgttatttaaggtatccatcacctcaaacatttgtcatttctttgtgttgggaacatttcaaatcttctagctattttgaaatatacaataaataattctttttttttttttttttttgagacggagttttgctcttgtcgcccaggctggagtacaatggcgcaatcttggctcactgcaacctctgcctcccaggttcaagcagttctcctgcctcagcctcctgagtagctgggattataggcatgtgccaccacgcccagctaattttgtatttgtagtagagacagggtttctccatgttggttaggctggtctcgaactcccgacctcaggtgatctgctcgcctcagcctcccaaagtgctgggattacaggcatgagctaccactcccagccaataaattattcttaactatagtcaccctcttgtgctattgaacactagaacatatttcttctgtctaactgtatgtttgaattaattgctgtgtatagcgtgaaacagagattcagcttcattcagatatccagctttcccaacaccatttatcgaaatactttcctgttgagtatatcttgcttttatttttaccagtttcactaggatactctttcttgtttttgaggagaagtctttctctgttgcccaggttggagtgtagtggcgcaatcttggctcactgcaacctctgcctcacagattcacgtgatttttgtgcctcagcctccagagtagctgggattagaggagtgcaccaccacgcctggctaatttttgtatttttcgtagagatggagtttcaccatgttggctaggctggtcttgaactcctggcctcaagtgatccagccaccttggtctcccaaagtgctgggattacaggtgtgagccaccatacctggcaagatactcgttttcagggtatgtgggcaccttagcaagctgcagaatggattttcttttcttttcttttttttgagacaagagtgtagccctgttgcccaggctggagtgtagtggcatgatcttggctcactgcaacctctgcctctcgggttcaagcgattcttatgcctcagcctctcgagtagctaggactacaggcagacgccaccatgcctggctaattttttgtatttttagtagagacagggttttgccatgtttgtcaggctggtttcaaactcctggcctcaagtgatccacccatctcggcctcccaaaatgctgggattacaggcgtgagccactgcgcccagcccagaatggattttctgattcttgctgtgatatttctgacatggatgcatattaggtagagtacatttatttcgtctgatgaaaatggattaaagtacaacatagttcctttgagccaagttgctcatctatttgtatgatgagaggtcatcactgcactgaatgatattttaagaagtctagtttaaaaattttagtcttaccttcctatgatcttgctttgtgggcggggagattaagttagtttttttattttgtttttttttttttgaaacagagtctcgttctgtcgccaggctggagtgcagtggtgcaatctcagctcaggctcactgcaacctccacctcccaggttcaagcgattctcctccctcagccttctgagtagctgggactacaggcgcatgcctccacgcccagctaatttttttaatttttagtagagatgggatttcaccatgttggccaggatggtttcaatcctttgacctcgtgatctgcccgcctcagcctcccaaagtgctgcgattacaggcgtgagccaccgtgcccggccgagatttttaaacaaactgatagactgcagacaactagcctgatgctggttgtactctgtggttggtcagtctgttggaaaactgtcatagtgtaaccttagcccatcacctctagggtgactccttgtctaggaaaattgagaattagttaaactatcattaatttaaatgaagttttatttattttgagatggttgctctgttgcccaggctggagtgcaatggcgcgatcttggctcactgcaacctttgcctcccgggttcaagcaattctcctgcctcagcctcccaagtagctggatttacaggcttgtgccaccacatccagctaatttttgcatttttagtagagatggggtttccggcatgttggcctcgaattcctgacctcaagagatcggcccacctcagcctcccaaagtgctgggattacaggcgtgagccactgcgccggtcagagctttattattttattggataaagttatttcatggaaatttccacctatctgatctcctttaatttcttactgtttattttgacatcaccattcaatattttagccccaggcagtatagtaagacagaccactaaattcttgggaagatagattcttttacagttcaattcccaagataattaggaaatttaaaagtgattaaattttagtttatatgacacttaaaatcacgaaggcagtgtgttttaattgcatttagggcatctaaccatcagctctggctttcttcctggctccctgacttactctatcttggtaatgagtccttcattgatgtagcctcgtttaaagcacttttaggttttcagggaagtaaaatatagatggaataggaattgacattgttacattcaaacacaagtagcacttctctcctcccccatccaaactgcatgacggttttcaccaagatggcagcttgcacatatatgtttaatggtatttttcttatttgtaaacttggacagtagtaagatcattcaatactgaggtatagtagctgtggccctgattacagtttgagtctacagttgtttttttcttaagtcattggtctaaatgagtttgatttgtctgtaagtagatagagagaggcttccccagataccttggcaggaacactgtggtcaggggtctagtctccccttaacaagtgagagcttagtttgtcagtgaactggatataaccaggtcctttggcacaaattcacgctagttaaacccacaccagtaagttttaaaaccagaaccccaagttattaatttataaagggagctctactctttcagtgtgtattcatgtctactgttcataatactcttttcctgggaatacgatacctaagaagttaaacttcaaattagaaggcttattggtgagcaaggaatcagagggaatgaggtcaggagtttgagaccagcctggtcaacatggtgaaactccatctctactaaaagtttaaaaatcagctgggcatggtggggtgcacctgtaatccccgctactccgggaggctgaggcaggaaaattgcatgaacccgtgaggcagaggttgcagtgagccgagatcgcaccactgcactccagcctgggcaacacagcgagactctgtctcaaaaaaaaaaaaagatacttctctttcttggacaaacctgataaccctatcaaattctagctctttggcctcccttttctagaccacagcagaaaactccttttctatagaaaatattttccttggccaggtacggtggctcatgcctgtaatcccagcactttaggaggccaaggcgggcggatcatgaggtcaggagatcgagaccatcctggccaacacggtgaaacctcatctttactaaaaatacaaaaaattagccgggcgcggtgccggacgcctgtagtcccagctcctcgggaggctgaggcaggagaatggcgtgaacccgggaggcggagcttgcagtgagccgagatcgcgccactgcactccagcctgtgtgacagtgcaagactctgtctcaaaaaaaaaaagaaaatattttccttgcatgtgaaccccatctctactaaaaatacaaaaaaaattagctgggtgtggtggcaggtgcctgttatcctagctactccggaggctgagtcaggagaattgcttgaacccaggaggcagagattgcaagtgagttgaggttgcaccattgcactccagcctgggcagcaagagtgaaactccgtctcaaaaaatagctacagcattcatttttgtttttgtttttgttttgagacagtctcgctctgtcgcccaggctggagtgtagtggtccaatctcggctcacggcaacctctgcctcccaggttcaagtgattctcctgcctcagcctcccaagtagccgggattacaggcgcttgccaccacgcctggctaattttattttttaatagagacggggtttcaccatgttggcccggctggtctcaaactcctgacctcaggtaatccgcccacctcgacctcccaaactgctgggattacaggcgtgagccaccgcgcccagcctacagtatgtgattttgtttcatcgatcatttcacagactatgtatgagatgaaatagctgtggccacatagataagatatggcagtttcttatgatttcagtacttcatatttaccaccttttcaggcaagttacttttttttttgaaatggagttttgctgttgttgcacaggctggagtgcaggggcataatctcagctcgccgcaacctccgcctcccaggctcaagtgattctcccgcctcagcctccgagtagctgggattacaggcatgcgccgccacatccggctaatttttgtgtttttagtagagacggggtttctccatgttggtcaggctggctttgaactcccgacctcaggtgatccgtccgcctcagcctcccaaagtgctgggattacaggcatgagccactgtgcccggccagcaagttactttttatccattatacaagacctcttggttgctagaagaattttttttttttttgagacagagtctcgagtcttgctctgtcacccaggctggagtgtagtggcatgatctcagctcaccacaacctctacctcctgggttcaagtgattctcctgcctcagcctcctgagtagctgggattacaggcatgcgccatgacgcaggccaatttttgtatttttcatagagacggggtttcaccatgttggccagggtggtctcaaactcctgacctcaagtgatccacctgactctgcctcccaaagtgttgggattacaggcgtgagccactgcgcccggctgctagaagaatctcagtggccaattctgtttggtggaagtcattatagcctcctgtgtatttagtgttcctgggttaatgtccttctattcatggtaattcatgaaatctcaaaataatctccaaacaacttagtccttgctctaacacctattcattcttgatggtatattctgtattggcacgttatcttaactccccaatcttttccctctatatgcaagctattgaattaatcagtgtgctctcatcagcccagttcaggaaaaacacacttccttttttgatagtctcaccccttggagtgactcttcttcctggaggcacttttctaaaacagtatcgatggaaaaaagtaaacagatggcttcttttgcctgaaaaacagtagtaagtgggttataatatatttgttttttaatcatgtctttattttttagcatggggcttaacatttttcctactctgagttatcccagatcaataataatttctatatattataaacccttatttgccaaaaggtactagtactatgtgctagtaccttcctttccatttcattggtttttttttctcatagtctgtcatgcttgtttcctgacttttcttgctaccatagtctttatcttgcttttattcatagagttgactgctttctatttgatatgttccaactgccatttttttcttctcacccttgatccaaatttgatttctaattatataagataaacaagaatgccaaacttactgccctttgactaattagaacatggaaataatttgagttttagagaataataaagtttttttcttccatttacaaaagtaagaaaacttaaaaaaaaaaaaagactagaaaagagaaaacaatcatgccatagtctgccacctgaagaaaccacccttgctgtgttcctccatctgtcctccgtgcatgtgtgtttgtatgttttgagcttgtggtcacatttgataatgctatgatgattcccatacatctttagtagacttggttacaaatgcactgtgtgggacaggtgcagtggctcacgcctgtaatcccaacactttgggaggccaaggcaagcagactgcttgagctcaggagtttgagaccagcctgggcaatgtcgggaaaccctgtctctacaaaaatacaaaaaatagctgggcgtggtagcacacacctgtagtcccagctcttcaggaggctgaggcagaaggattgggcgcgccttggaggtcaaggctgcagtgagctgtgatggtgccactgcactcagcctgggcaactgagtgagactctatctcaaaaaaaagaaaaaaaaaagcatcatctgattttaaatagatctttataggtgttaggtgttcaaaagtatttgttaaatgaaatgattgaatccttactcctctctgtgcctcagttttcccatttcttaaatggggaaaaaataatttacaagatgttttgtgaggatcagtgaaaaacaaactgggcatgttggaaatggttaggtcatgtcaaaactctccttgctggctgtcatatcgcttttttcccagaggctactacttgagaagaggcaaaggaaaaagcgccttgagccatttatggtgcagcccaatccagaagccaggctacgtcgggcaaagccaagggccagtgatgagcagactcccttggtgaactgtcatactccccacagcaatgtcatcttacatggtgtgtatttaggcagcatcacttcctagtggggtacaattttcacaaacctagaaggcacgaggattgtcagacggaccaaagggacaatattattagcaccattactaggtaccttcataaatctttataatcacatttggggtctttgaggagaataaaagcaatgatataatcagtggaagatgccttaaggtttgcgtccattttagaactgttgttttcttttttttgagacggagttttgcttttgtcgcccaggctggagtgcaatggcgcgatcttggctcactgccaacctcctcctcccaggttcaagtgattctcctgcctcaacttcccgagtagctgggtttacaggcgcctgccaccatgcccggctaatttttttatacttttagtagagacggggttttactatgttggccaggcttgtctcgaactcctgacccaggtgatccacccgccttggcctcccaaagtgctgggattacaggcttgagccaccatgcccggcaagaactgttgttttctagatgccagatgaatgagtttagaatgacctatttgaggagctcttgattgttaaatcgtggcagaggtgaatcatgaagccgggaataggtagagagcgtccgttcttccaacagatagttgaaaggatcatctgagatggggaggggcggaggaagaataagattgtaagtgcctctaaatcaagccactggagctattggcttgtacaggatctgtactatggaggacctactttgttttcttggtctcattcttaagtttctgaagtacatattacttcagttactgaagtacaagtacatatgactttagtaacagagcatgttaataaaatgaacaccaggctgggcgtggtggcttatacctgtgatcccagcactttgggaggccagaaaggcagatcacttaaggccaggtgtttgagactagcctgggcaacataacaagactccatctctacaaaaaaattaacaattagccaggtgtagtagcacacacctgtagtcccagctactcgggggactgaagtgggaggatcgtttgagcctaggaagtcgaggctacagtgagctgtgattacaccactgctctccagcctgggtgacagagtgagatcctgtctcagaaaaaaagaacaccagttctgaccttctctcttaacaaatgttcttatggatgttaagaaaggagggcagataaaatgatttggtagttcttaattctgatcacatacgccaaatctacccaactagtgaataatactttgctccttttttaaaattcattttattttggcccttaggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatggtgaggactggtaatgattttaaggcaatttgtctccttactcaattgtaatcttttcctttcttttcattgtgggtaacaatctacatgactgaaaatgactcatggcttagggcctcacagaggtgacagtgtttagcatcttttacatctgaatgttggtaattgtcagcaatggtagtatttatactgttgcctgagaaaaagaagataattaaatataaaatactagctgccatagatggccatagatgactgtttgtctctttttgactattttcagttcccaccctcttcttctgacagagttgtcactcaacccctctactccacctccatttcatagttggtgatgattgatagcctttcttctagttggagctctcatttccataaatattcccatacatttcaaaggtcccttgtagtcttctttcctttttagaaaaataattttttttttttttttttttgagacaaagtctcactctgtcgcgctggctggagtgcagtgacgcgatctcggctcactgcaagctccgcctcccgggttcacgccattctcctgcctcagcctcctgagtagctgggactacaggcgcccgccaccacgcctggctaattttttgtatttttttagtagagacggggtttcacggtgttagccaggatggtatcaatctcctgacctggtgatccgcccgcctcggcctcccaaagtgctagctaggattataggcgtgagccaccacgcccagccgaaaaataattttataatgagaagggattaagcatcccctttgcagatgagaaaactgaagcccaataatgaatatgtattgggtacctactttgcattaggcaaacattgctaggtcctggcatatatgaatcaggagattctaccacggaatggcataataaatgaacgtttaaacaaatttgtatattcacttatttagaaagtatgttttggccaggcttagtggctcacgcctataattccagcactttgggaggccaaggtgggtggatcacctgaaggtctagagtttgagaccagcacatggtgaaacccttctctactaaaaatataaaaaaagtagccaagcatggtggtgggtgcctattaatcccagctactctggaggctgaggcaggagaattgcttgaacttgggaggcagaggttgcagtgagccaagattgcaccattgcactccagcctgggcaacaagagtgaaacttctcaaaaaaaaaaaaaaagaaaagaaaaagaaagtatgttttgagtccaggcatggtggctcatgcctataatcctaacactctgggaggctgaggcgggcagatcacttgagtccaagggttcaagaccagcctgggcaacatggagaaaccttgtctctacaaaaaatgcaaaaaaaaaaaaattgtctgggtgcagtggcgcacacctgtagtcccagctacttggggggctgaggcaggaggatggcttgagcctgggaagtggaggttgcactaagcttgcaattgcaccactgcactccagcctgggttacagagcaggaccccgtctcaacaacaacaacaacagaagtaaagtaagaaaatatgtttgagtacataccatatctgaggcaacattctaggtacttaggatacatgagtaagcatggttcctgccctcatggagcgcttattctaattgaagcttcatgcacttaaataggctagagctagaaaatcaaggtgctgagagagcctgacgcctcactccacttggacactttcccagagaaagtgatatttgagctagtgcctgactcaggaagaggtgctggccagttcagaatggcagcagctcagggcgtgtgatcatagggtaggaagggggatgtagagagatgagccaggagagggaagtgggctctaattatatgggacctaatagaccatgtcaggaattgggactttatctaaggagtaatagaaggctggacatggtggctcacatgtgtaatcccagcactttaagaggctgaggtgggagtattgcttgaagttaggtgttcaggaccagccagggcaacatagcaagacccagtctctaacaaaaaaaaatttttaattagctgggtgtggtggtacacactggtagtcccagctacttgagaggttgtgctaggaggattgctcgagcccaggttattgaggatgcagtgagctatgatcatgccacagcactccagcctgggtgacagaatgaaaccatgtctttaaaaatttaaaaaaaaaaaaaattgggttgggtggagtggctcatgcctataaccccagcactttgggaggctgaggtgggaggattgcttgagccccagagttcgaggctgcagtgagccaagattgtgctgctgcattccagcctgtgtgtagagtgagaccctgtctcaaaaaataaaaattaaaaataaaaattaattaaaaaaaaatagggctgggcgctatggcttatgcctgtaatcccagcactttgggaggccgacacgggcggatcacaaggtcaggagatcaagaccatcctggctaacacggtgaaaccctgtctctactaaaaattagccaggtgtggtggcgggcgcctgtagtcccagctactcgggaggttgaggcacgagaatggcgtgaacccgggaggcggagcttgcagtgagccgagatcacgccactacactccagcctgggcgacggagcaagactccgtccgtctcaaaaaaaaaaagagcagtaagaacctgtgaggaattttaagctgaacaatgatatgatcacagttgagctgtggaaaaattactgtgtaccagaaagaaggaattgaagggggaagtccagaaacaggaaagctatttaggagatcgtttgattgatgatggcctgacctccagttccaatatagtgtggtgtttgcaaaagcacaggcaggggagatgcagaattgctctgctagggcaatgagaagagacaagagaggtaccaggaggaagggagggggtgattccgctgaacaaagaaggatgtgtgtctgcctacgtgctaggggagcagggaagtagctggagcctgacattgtgagtgtccatcatgtgtcaggcacttgacatgtactacctcatctgatttaatagttgtaatagtgccttgggggtttgtaaagacagttttcctgtctttaacatgaaggtgaccatggtactttcctattattttactaccactatttttacaacaaaagaaagtgaaagatatgcgttggacagataggatgagtcggagcaaaaataattttctatttaaccaaagctaaattactcaccctgagtcaactagctgaaaagtggcagatttagattttctgattcttagtctggttctttatccctgactgtaaacaccacactgtctccttgtgcactgctctatgaaatggctgttcgttttcagaattggccttccagtgccaggtgagttaacgccttttcatgtctcaacaggttgcatcttgactataaaacccattaagtgctgttttgattaaattctaagaagtgtcagtttggcagattatgtccctgtaagtgggtccaatttgcttgtcttaaaagtttcagagagatctttgatctctcaagacagattcacgggaactgagttcttggtattaaaatggcatttgaaagcatagtaataggtgaagatagccatacgatagtgatatctcaggagtttctgcctttctgctaccaataaaaagggggggtgccaggtgtggtggctcatgcctgtaatcccagcactttgggaagccgaggtgggcggatcgcttgagcccaggagtttgagatcagtctgggcaacttggtgaaaccccatctctacaaaaaaattacctggacatggtgtagtcctatgtactcaggaggctgaggtgggaggatcacttgagtccgggaagttgaggctgcactgagcagctgtgatttggccactgcactcccacctgggcaacagagtgaaaccctgtctcaaaaaataataagttaatattttagacagcagaaggaaaaagtgtcctttgcaaagcaaataatttttttaagtaacaactcttttgagatataaattacagaccatactcctcatccatttcaagtaaacaataggccaggcatggtggctcacgccggtaattccagcactttgggaggcagaggcaggcagatacctgacatcaggagttcgagaccagcctggccaacgtggtgaaactccgtttccactaaaaattcaaaaaaaagtagccaggtgtggtggtgggcagctgtaattccagctactcgggaggctgaggcagcagaatcgattgaacgttgtgggtggaagttgcagtgaacagacatcgcgccattgcactccagtctgggctacaagagctagactctgtctttaaataaataaacaataaattggttttcagtacagagttctacaaccattttcacaatcaattttacaaaattttcatcacccccaaaagaaacctcataaccttcaacagtcatttcccatttccctccaatcccctcagccctaggcagccaccagtctacttgctgtctctgtggatttgcctgttctggacatttcatattgatagaatcatacactatttgtctttttgtgtctagtgttttacttgcataatgttttcagggttccttcatgttataacaagtgtccgtactccattctttttattgttggataacactccattgtatggataaaccacattttgttgatcagctgatggacgtttgattgttcccactttccctgttaggaataatgttgttatcaacactcataagtttttgtatggacctatgttttcagttgagactgattttttttttttttttttgagaccaagtcttgctctgtcgcccaggctagagtgcagtgatgtgatctcggctcactgcaacctctgcttcctgggttcaagggattctcttgcctcagcctcctgagtagctgggactacaggtgcctggctaatttttgcatttttagtagagacagggtttcaccttattggccaggctgatctcgaatttctgaccttgtgatccacccatttcggcctcccaaagtgctgggattacaggcatgagccactgcgcccggcctgagattgatttttttaaaactgacctttgtcttatccttgtgttcttcagtaaagctaataccaatctatgtatgtaccgtataaaaatagatcatttttctttccgagatgttgaatgtgcacaaaaagtggttcagagaaaaaagccacacttgttaattccatctgtaaatctatgattcaaggaccatttcagtgaggggtaacttcaccccgcagatactagacacaagggaatttagtttaggtcttgctctgcctctttctcttggagaaatgattcttcctgagcctgtactcccacatataaatctgaggctcgtcactctttcataacacacattgatcacactttattttacatctgcattcctctccagattatatactccatgaacaagaaacaatagaaaacaaaaagactatcagtatctcctcctctaactcaaatgtaagaataaaatgaaaaaatagtttttcatccagcagttttaaatttcctataaaagatgctccataaatccaaagtactagtatttcaaacattcctagttagatttagttaactagacagagattaagaaaatgccggggggccagccatggtggctcacgcctataatcccagcactttgggaggcttaggcggacagatcacctgaggttgggagttcgaggccagcctgaccaacatggagaaaccccgtctctactaaaaataaaaaattaaccggatgtggtggcacatgcctgtaatcccagctactcgagaagctgaggcaggagaatcgcttgaacctaggaggcggaggttgcggtgagcccagattgcaccattgcactccaccctgggcaacgagagcgaaactccatctcaaaaaaaaaaaataaataaaataaaaagaaaatgctgaggggaataaaactgctgtaaagaataatgcatcattgaattttttttttactgtggtaaaatatgcatcgtaacatagaagttaccagtgttggcctggcatgttggctcacacctgtaatcccagcactttgtgaggccaaggtgggcagatcacctgaggtcaggagtttgagaccagcctgaccaacatggtgaaacccagtctctactaaaaatacaaaaaaattagctgggcttcgtggcgcacacctgtaatcccagctaccggggaggctgagacaagagaattgcttgaacccaggagacggaggttgcagtgagctgagatggtgccactgcactccagcctgggcaacagagtgagactccatctcaaaaaatcataataatttaccagtgctgcagctctttttagaatttgtctagcaagttttcctgtttttactgaagccttcccttcccttccaaataacaaaaagtacacttttttttttttaagagttcgggtgggccgagacgggcggatcacgaggtcaggagatagagaccatcctggctgacacggtgaaaccccgtctctactaaaaatacaaaaattagccgggcatggtggcgcgcgcctgtagtcccagctacttgggaggctgaggcaggagagtggcgtgaacccgggaggcggagcttgcagtgagtcgagatcgcgccactgcgctccagcctgggcgacagagcgagactccgtctcaaaaaaaaaaagagttcgggtgtaattctgtcacccaggctggggtgcagtggcacaagcatagctcactttagcctcaaaatcctgggcttaagtgatccaaccacctcagctagctaggactacagacacacaggtaccatcgtgaccagctaatttttttaaaaaaactttttatggagacaggtctcaaactggtggcctcaagcagtccttctgcctcagcctcccaaagtgctaggagttcaagcacgagccactgtgccctgcctaaattttttttgttttgtttttttgagacagagtctctgtctcccaggctatagtacagtggcacagtctcggctcgctgcaagctccgcctcccaggttcaagtgattctcctgcctcagcctcctgagtagctgggactacaggtgcgtgccaccacacctggctaattttttgtattttagtagagatggggtttcaccatgttagccaggatggtctcaatctcctgacttcgtgatctgcccacctcagcctcccaaagtgctgggattacaggcatgagccaccgcgcccagcctgccctgcctaaaatttacaactttaatcaattttaagtgtgagattcagtgacattaagtgtattaacaatgttgtgcaaccatcactaccatccatctccagaactttttcatcatcccagagacttcacacccattcaagataattcctcattctcccctgcccccagcccctagtaacctctattctactttctgtctctatgaatttgcctgttttatgtatttggacaaaatagttgtgtttacggtcagaatagttaggaatgttttaagcaagaaaattaaaactatctttgtttcaaagaccttttttaaacagtgttggcagtgctaacagttcttccttttctgctagatatctctgaaagtgtgaacttcgatgaggagactgatggaatatcccagtcagcatgtttagaaagacccaattctgcatcaagccagaattcaaccgtatgtagttctgaaacttcttccattagagctaatttgactctttctcaaacatatcttcagtatttatttatttattattattatgtattttttgaggtggagtctcgctctgtcacccaggctggagtgcagtggcatgatctcagctcactgcaaactccgcctcccgggttcacgccattctcctgcctcaatctcccgagtagctgggactacaggcgcccgccatgacacccggctaattttttgtatttttagtagagacagggtttcaccatgtttgccaggatggtctcgatctcctgacctcgtgatccgcccgcctcagcctcccaaagtgctgggattacaggcatgagccacagtgcccagccctcaaacatatcttcagtatttaaataccattactgagtgagggttccttcagaagtgtaagctcaaatttagtttatgatctaattttttctgtctcaggtcagctattgtgaggctttgtcccattttgatacttactcttcattactctcaatattcatatacttaatttaacttttcagttttcctcattctgtcagaagactgaagacacgggtaaattactaagttgctttgtccactaagtgtttttcaaagagaatcagattttgagtctcggcctgttgttgctcatgtatggctgtcctttcaggatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaaggtatgagaattgatttctaagaaaactcttgagagagagaagaatgttgtgggaatagattgttgatgggccttagggaactaactctggtattagaccaagccagctggaagtagattgtatctttcagtccccagatgctgtgttctcattttctgcaaagagctcatggtctaataggcagcaagctctaccctcccacaaataagagctttatccacgaagtgggaaaatggacgggtagttgttaatgtaattattttcacctgtctcccatgattgagtttttgaatgttactgtttgttcttttggtttttctttttattacggaagaacatgacattgtggaaggagagtgagttttagggaataggaggaattagaaatacagaaggacctacaagttaaatgtcttgtttctcaccctagaaattccaatttattttataagtttgagccagcgatgaactttattttattaattttgtattaataccaggtcttaacagatgattttaagagcctagaaataagataatgatactaggtgttaattcttctaaccaccatttattgagtgtttacgacagaccaagcatatgcatatatatctatatatattatcacctgtaatccttgcagccaccttgttaggtaggatttcttatctctgctttaaagatgaggtaactggggcttagggagtgacttacctaccccacgttgcactaagtggtggcagagccaaattcaaacctattttgcataattctaaagtcttcctgcttagccactgccactctcctgcttccctattatggtcctagtctaggagagtttaggaaggatgcctatataggatggtattcatgccattgaggtcacagtggtttaacacaacagcagtatagaaaaaagagtatttcctccctggagaggcttcccttttgtcccttcttgccctttgcctaatcagagtctttcctgatgtgcttcaccagatgtggttgacattcctctgtctgtgtccccatggcatgaagaaagctatcacaggccaggtgcggtggctcacacatatgatcccagcacttcgggaggctgaggcaggtggatcccttgaggacatgagctcgagaccagcttggctaacatggggagaccctgcctctagcaaaaaattaaaaaattagccaggagtggtggcatgcacctgtagttccagctactcgggaggctgaggcaggaaaatcacttgaacctgggaggcagaggttgcagtgagctgtgattgcaccactgcactctagcctgggtgacagagtgagaccctatctcaaaaaaaaaaaaaaaaaaaagccatcacagtaaagaatgggaaggttttcaggatcctgtctctcctaaggttggaaagactcttaatcatggcattggatgaacattgattgttatttatttattggattttgcaaggttgcccaggctggccttgaactcctggactccagtgatccctctacctcagcctcccaagcagctgggattataggctcatgccacctggcccagctttggagattttttttttaactggaagttttagggatgaagttgtaactaattatatggagaatcaagctagtgaatttagaaaaactgtataggaagaaaaccctgatagtgaattattttatttttattttttttttttttttttgagacagagtctcattctgtcacccaggctggagtgcaatggcatgatctcggctcactgcaagctccgcctcccgggttcatgccattctcctgcctcagcctcctgagtagctgggactgcaggcgtctgcaaccacgcccagctaattttttgtatttttagtagagacagggtttacgctgttagccaggatggtctcgatctcctgaccttgtgatctgcccacctcggcctcccaaagtgctgggattacaggcgtgagccaccacacccggcctgatagtgaattctgataagagagttagagaaagggataaaggcccaaagattaacagcttgacatatgctgaggacttgctaagcactggctgaatgaatatgtaggacaaccatgaccagaggtggggcaggttctctggacttcatttttgactgacactttttcttttcccagatatttcttcttgcagctagaaagcggaaaaagagcaaaacagccaactaccttatctccattgatccagttgatttatctcgtgaaggagaaagttatgtcggcaagcttaggtgaaagcaaccttagatcactgtcctattctttctgatagtcttattcctatagttgcagaacagtccttatcttggttacaactagcatgtattgatgttgtaatcttaaaaaaaaagaaaaaggaaaaaaaaaaaagctgggcgcagtggctcacacctgtaatcccagcactttgagaggccaaggcgggcggatcacttgaagtcaggagttggagtccagcctggccaacatggcagaactccctctctactaaaaatacaaaaatcagccaggtgtggtagaacagcctgtaattccagctacccgggaggctgaagcacgagaattgcttgaatccaggaggcagaggttgccgtgagccaagatagtgccactgcaccccagcctgggtaacagaatgagagtctgtctcaaaaaaataaaaaaataaggctggtgtggtggctcaggcctataatcccagcatttggggaggctgaggtggaggatcacttgaggccaggagtttgagaccagcctgggcaacacactgagacattatctcttcaaaaaactttaaaattagccaggcgtggcagttctcacctgtagccccagctacccaggaggctaaggtgggaggatgacttgagcctgggagtttgaggctgcagtgagctatgatccctgccactgcactccagcctgggcgacagagcgagaccctgtctcgaattagtaagtaaataaaaagttaaaagaaaatctcagttccttccttgctttaatgagatatttttgaaaaagtgatgatgaacattgagacatttggaaaacaggcaaataggcttccattttccttctcttagattgtgtttgtataagaaaaaaaatacagatcatcatggtgactttttctcctgactccagatccaacctcatggggaccaagtttacagtttatgaccgtggcatctgccccatgaagggccggggtttggtaggagcggcccacacccggcaggagctggctgccatctcctatgtgagtgctgctttcccagggccgctgcctgccctcctggtgtcctgctggcacttttcacctagtgtcgctgaagaacctcccctcccaagcttgtttctatttctgtgatttctgttgctgtaccattttctccatgtatttgagttttagttatttgaattgccaagttcaattatttttcactctcagaacatttcttcccttatttccttttcttttttcctgctgccacttaattcagacctttacttcttacccagtggccaaaggttacaataaattaaagctgatctttttttgcttttaatcttttcctatctagttcattctcttttttctctttttaatctctttttcttattttttttcctctttttggcatttatagtccacttctttttaaattgtatcttattattatttgttttattgtcctttttcatttcatttcacacccgggaaaggcttgagaactatctagctcgttctctgctgccaccaaatgaatcttcctacaacgaggctccagttgatcctcctgttctgcttcaaatcttttagtgactacccattgtgtgagatctaacatggtagcatttgctttcagacttctctattggcatgcccctccttcccatcattctagccaagcagccctcctgtcattcctttgtccaaccacactcatctttcctccttggagaggcttcccttttcctctttctggccttttgccttatcaaagtcttttctgatgtactccactagatgtggttgacattccttcatctgcgtccttgtagcatttgtaacccacatgtatttgttattacttgttcaacatgaaccgtttccaccagtttgtaaacttgtgaattcttactcatggctatatccatactagcacatggcttggcacacagtagatattcaaagagttgttgagtaagagaaagcaagaaggaattgacccatctcagctggtttttttattccaaagtctcaactttcttaagttgaaattaatcccatgagatcttatctacatgcctgagaaccatttgacttcacactttaatgtaaggtgtctttcctctatagctttcatatataatctgcttggcttggctgggcttggtggctcacacctgtaatcccagcactttgggaggctgaggtgggcagatcacttgagcccaggagagaccagcctaggcaacatggtgaaaccccatctctactaaaaatacaaaaattagccgggcatggtggcagttgctggagtcccagctactgggggcactgaggcaagaggatcacctgagtcttaggagggtcgaggctgcagtgagccgtgatcacaccatgcactctagcctgggcgacagcatgagaccctgtttaaaaaataataataatcggccgggcgtggtggctcacgcctgtaatcccagcactttgggaggccgaggccggtggatcacctgaagtcaggaggtggagaccagcctggccaacatggcaaaaacccgtctctactaaaaatacaaaaaaaattagccaggcgtggtggcaggcacctgtaatcccagctactcgggaggctgaggcaggagaatcgcttgaacccaggaggcagaggttgcaatgagccaagattgtgccactgcactccagcctgggtgacagagcaagacgacatctcaaaataaaataagaataatctgcttggcttgacaggcatttttaatacctagtgcaggccttatttaaccacagctcattttcactgtatgtaatatagtgctatgccctcactgggaaataaatatgtgttggtgctgacaaagttgaacagtttgttcacagttatctcaaatcacatttaagactcaagagtaagaggccgggcgtggtggctcactcctgtagtcacagcaccttgggaggccaagatgggcggatcacctgaggtcgggaattcgagaccaacatggagaaaccccgtctcgactaaaaaaaaaaaaaaaatacaaaattagccgggtgtggtggcgcatgcctataatcccagctactcaggctgaggcaggaaaattgcttgaacccgggaggcggaggttgtggtgagctgagattgtgccattatactccagcctgggcaacaagagtgaaactctggtcccaaaaaaaaaatagttaagagtaaactctcaagccaagagattctgttttaaatgtaggtgtttaaagaaggtataggccaggtgcagtggctcacgcctgtaatcccagcactttgggaggctgaggcaggcagatcacgaggtcaggagatcgagaccatcctagccaacttggtgaaaccccgtctctactaaaaatacaaaaaataattagccaggcgtggtggcatgcgcctgtagtcccaggctgaggcacaggaatcgcttgaacccaggaggtggagattggaggttgcagtgagctgagattgtgccactgcactccagcctggcgacagagcgtgactctgtctcaaaaaaaaaaagagaagtataaagagatataatattactttcctgtttttgattctgtttacagcaaagtaataaaattatttttggtacacctgatttttttttttttttttttttttttttttttctgaggcagagtctcactcttgtcgcccaggctggagtgcaacggcgtgatctcggctcactgcagcctctgcctcctgggttcaagcaattctcctgcctcagcctcccgagtagctgggattacaggcgcctgccaccacgcctggctaatttttgtatttttagtagagacagggtttcaccatgttggccaggctggtctcaaactcctgacctcaggttatctgcccacctcggcctcccaaagtgctgggattataggcgtgatccactgccccggctgatacagctgatattgtcagcatcttacattcccaagaaagtctcatgttataaaagaatgtggtctctatttttttcctgtttccaagttctgctttgttttcctatcttccaggaaacaaacgtacttggatttaaaggtcctaggaaaatgtctgtgatcattcctggaatgacactgaatcataagcagatcccctatcagccacaaaacgtgagtaagaatgtatttaaatcagtgaaagactctaaaagacagtagtacaatacacagagattaatacaaaaaaaaaaaaaaagattgagcttccagagccccacactggagatagctccatacacttctttaggaaagctgcccctccaaaacctcaggataagagcagttgcagagtcattgccttgaaaccattttttctacaaagagaaatgctggatgatgtagaataattttaaaaaaaacctgtcttcattgttggctttcattcttcgcttctggtttaccctttctgaaatggagaaagtattctcctactctaccttctacctcgtagagttggagttctcagtacaaagtaatgattttccctttggacagaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccgtaagcctccaggaagggttgggtgggaagaggaggacagatgctcttacaggatgggaatgcacattccctgtacatgataggaagtgacagtcagcagataatcatggaggagagacaggatttctttggaaagatgaaactacagttttagagaaaacttgtaaatcactgtgttgaggaggggagaggagtgtgagagagatgctatagcaaatcagagaagttggctgggcaccatggctcacgtctgtaatcccagcactttgggaggccgaggtgggcagatcgcttgagaccagcctgggcaacatggtgtgaaaccccatctctacaaaaaatagaaaaattagctgggcgtggtggcaggcacttgtagtcccagctacccgggaggctgaggtgggagcatcacttgagccaggaggtcgaggctgcagtgagctgagattgcatcactgctctccagcctgggtgacagcaagaacctgtctcagaaaaaaataaaaaatcagagaagtcatagagtaggttgtttgggaaacaaaggcaaatgaccccaataaaggttcctggcagctctagcctgcggagtttatgacattcccagcaagctgctctctattctacagaaacctggtgattaactggcctatttggaggattctttctgtatcataaataggatcccagcactttgggaggccgaggcaggagaatcacttgagcctaggtgtttgagaccagcttgagcaacatagtgagaccctatcttcacaaaaagtaaaatattagccaggcgtggtggcgcttgcctgtagtcccagctactcaggaggctgaggtgggaggatcacttgagcctgggacgggaggtcaaggctgcagtgagctgtggtcattccactaggctccagccagggcgacagagcaaaaccccatctaagaaaaggaagaaaaagaaaaagatttccctgagtgcaaccacattatattctaacatgttgatttctttctgtttctagctgattatatagtcatgcagtttggacgtgtggcagatgacgtgttcacactggattacaactacccactttgtgcagtacaggcctttggcatcggtctttctagctttgacagtaagctggcgtgtgaatgagagaacagtcaggcagggagcccttctccccacagagctttcaggagcagacagtggcctccccttcccctccctgccccaggacttaaagagcaatagtttgccccttttggaatgatctctgaatatataaaacacacacacgaagagcaatagtttgccccttttggaacgacccctgaatatataaaacacacacacgaagagcaatagtttgccccttttggaacgacccctgaatatataaaacacacacgaagagcaatagtttgccccttttggaacgacccctgaatatataaaacacacacacgaagagcaatagtttgccccttttggaacgacccctgaatatataaaacacacacacaccccgcgcactctcactccttttccaggtttcatagacttggtgagggatcacagcttagcatgggtgagagatgatttaaagcacagggagattcttgnnnnnnnnnnnnnnnnnnnntgaatatataacacacacacacgaagagcaatagtttgccccttttggaacgaccccctgaatatataaaacacacacacgaagagcaatagtttgccccttttggaacgacccctgaatatataaaacacacacgaagagcaatagtttgccccttttggaacgacccctgaatatataaaacacacacacgaagagcaatagtttgccccttttggaacgacccctgaatatataaaacacacacgaagagcaatagtttgccccttttggaacgacccctgaatatataaaacacacacacgaagagcaatagtttgccccttttggaacgacccctgaatatataaaacacacacacaccccgcgcactctcactccttttccaggtttcatagacttggtgagggatcacagcttagcatgggtgagagatgatttaaagcacagggagattcttgtcacattggggtctccaaagctagaatgggatttcatgtgcttggaaacttgcagtagaatcagggactgacatcgcagttcctctcctctcttcattccctcacagcagattggccggcaccaatcttagtcaagagtggctgtgatcacatttgtgatcaattatgtgagaattttatataattgtcttcatttcaattaaggctgaaagcataaactctagaggtgactcagtcaggactgacagtaatgtgataattgccttcattttcaacccaggagtgcctctcacagctatatgactacggatccattagtgaggagcgacacacacacctgtaggcatcctgtgcaaacactttgtcattatcaagagagatggcagtattgaccatttagtttagttaaaaaaaaaaaaaaaaaggtggcaggagaggctttggggaggatcagccagcagacatgagcactgctggcccgtgtggcagagctgtggactttcttctcggctccctcaaccctggctcaggcacagaaggtgttttgctacgtttttttgattattacacccctccacgtattatgtgactcttacaccagttcacccttcccagaacgtatccaaaccttgagaatgcaggagctctgtgagctccaccgtcagcaccattcagctgcatcccttgtgcacagaactgtttgccagcgttgggtgggacacccgtggcggctgctccctcagacctcccttctgtggactgacctctcacctccgcctgttgttcctgcaccacatcagataagcatgtgaaggagggccaactggcagctgcgggacccttggcttgtcccccactgacaagtcccacctgctgggtgaggacgagactgtttccatctcaggcatgtatcccaccaagtgcctccctcacagccatgcccagaagcctcacacctcgtcaccaccaccaccccccaccccatcctgaggcactgcctggcagataaccctggttggccacagaagctattaatacacgacagcatgtggggaaggacttatggtgggccaggtggacctcatcctgcttcttcctccctctg

SEQ ID NO: 14840 - DNA, 7066 bp, Human
gcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaacccaggccatggcgtggggcaggcgcgcgggtccatgggggtcccattcactcagtcccctgtcgtcattagcgcttgagcccaggtgtgcagatgaggcggtgggtctggccacgctgtccccaccccaaggctgcagcacttcccgtaaaccacctgcagtgcccgccgccttcccgaggctctgtgccagctagtctgggaagttcctctcccgctctaaccacagcccgaggggggctcccctcccccgacctgcaccggagatctcaggcacccggctcaactcagacctcccgctcccgaccctacacagagattgcctggggaggctgaggagccgatgcaaacccccaaggcgacgcacttgggagccggtggtctcaaacacctgccgggggtcctagtccccttctgaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatgttttaattgtgagagtatctgatattcttgactgaacaatgtaaaaaacccaaagggggctgcgcacggcggctctcgcctaaatcccagcactttgggaggccgaggtgggcagatcacctgaggtcgggagttcgacaccagcctgaccaacatagagaaaccccgtctctactaaaaatacaaaattagccgggcgtggtggttcatgcctgtaatcccagctactcgggaggcttaggtaggagaatcacttgaacccgggaggcggaggttgtggtgggccaagattgtgccaccgcactccagcctgggtaacaaaagcgaaactccatctcaaaaaaagaaacgcaaacggtgcagctgcccctttttcgaggcacgtccacctcccattacccacttccttttttttttgagactgagtcttgctctgtcccctgggctgtagtggagtggctccatctcggctcactgcagccactcccaacgccctccactcctccctactccgcgctggccggggcggggttccgctggtcgcatccaataataagaacaggcggcgcgcgcccttcccggaaactcccgcctggccaccataaaagcgccggccctccgcttccccgcgagacgaaacttcccgtcccggcggctctggcacccaggtactggggaccccagacccacgcggtgcaggccgggagcgagagcctccgtgggggctccgtgaccccggaggggtagagccaagagctgggggagcctgagagatgagggtcgggcggggagggaggcggaggcggaggcggggttccgcggagctgagaaccggacggggtgggatcgaggagggtgcgaagcgccactgtttaggtttcgctttcccgggagcctgacccgcccctgacgtcgcctttcccgtctccgcagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggtggggaccccagccccgccccgccccgggtgggagagcccgcctaggaccccgcgggcccggcacacgtgttctgtccccctcttcaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgaggtgagcgacgccggctgccaagggcgttggcattcgtcctgcttgggcaaaggggaacattctctgggtcagatttgtggttttagaagctgttctgggagaggctgccagcaggcccaggacaggtggagagccacatccccacctcctcaggccacagcctaagggttcacagccaggaagctggtgggggctacaccaggctctccttgtatctctcactctggtgtcggggcctaacgcctgccccattctctctcagaaggcccaggcacggaccagactgaggcagaggcccccgcagctgtcccaccaccacaggtacccttctctctgcctgcctctcctcctgccaggccgcggagctgcttacgttcaccctgacttttccctgcagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggtgtgggcgtgcccggggagggggggagcgcgggaggggccagtgcacctggacggacactttagaagggggctggggattggggagctggagaattaggaggggaccaccgttcccactgtcctcccctcctcaggcccagggctccctgctggggagctgtacgggtgggcagtagagacgacccccagccccgggccccagcccgcggcactaacgacaggtgagaggggtaggggttgggaggcctggggcacagggagaggctagggatgaggtgccagcacaggattcccttccggatgcaggcgaggccgcggccccagagtccccgcaccaggcagagccgtacctgtcaccctccccaagcgcctgcaccgcggtgcaaggtgagtgcatcccaggaaggggcagcctgtccccgcccacccccgtcactcacggcttgtccccgcccacccatcactcacatcctgtccccgcccacccccgtcactcacatcctgtccccgcccacccccgtcactcacagcctgtccccgcccacccccgtcactcacagcttggtctccacacagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggccccccaggctccgccagcccctccaccccagcctgcctgctgcctcggaactgtgacacccccatcttcgacttcagagtcttcttccgaggtcagtgaggcccctgcctggggggctgtctccaggggtcgttgggagcacctgcctgccaggtactcagcagagtccccttcttcagagctggtggaattccgggcacggcagcgccgtggctccccacgctataccatctacctgggcttcgggcaggacctgtcagctgggaggcccaaggagaagagcctggtcctggtgaaggtgagaccagagcctcaaggaggggaggccatgtgctcaggcccactgacagacgcctgatgccctcagagcctcggagagggggaggggaggccatacaccgggtcactgacagacgcccgacgccctcagagcctggggagggggaggggaggacacacgccgggtcactgacaagacgcccgatccctcctggcagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacacgtactggcatcttggctggtggggaattgggtccaggctgaacacgggtgaggcccagggagggaggggacctccacggcctccctgcacaccaactcacttctgtcttcaccacacacatcacagccaagctttgactcaaagaacaagacccttgacaggccagtggccgccaaagccactcccaccagctgtgccaagggcagggacagcatttccccatgcaggacacctgtcgccagccctcaggctgccactgctgcaccctgcctccaggaggcaacggtgttgagtgcaaactcgagcaattatttacaagagcacaacataattggaaaagagaaagtaaagatattcctaattcagagccaaaggtacacagcagctgttggcgggaggccacctagagatttatcaaggacgcgccaccccaccaggagcccctcttgatcaccaagtgctttatcttccaagtagtaagtcaatcaagaggtttctaaagataatccatttttgataaattagaatggaaacagtgtctctataatatacatacaaaagtgtccagttttcaactgtgagcaacacaggtgcacagaccaggtgtcagcgcaggaacccgacggcaggcatgctgatgccccccatttcccgccactcccgacagctccccgggcatggccccgattcccgccactcccgacagctccccgggcatggccccgattcccgccactcccgacagctccccgggcatagcccgtgattgcctggcctcagccctcggccccctgcgtgggcggctcctccccggcctctggtttcttgtgcctgcgcatgtgcctgtacttgtccacgtacgccttcaccaggttggccaccttcacggggttgatctctccactcttgctgtggcagatctggagaaagaggtgcaatcaccaaatgccctttcacatccagatgttccgggccagagcccagggccaaagctgggctccctcgcctgccctgctcaggagcaggccctaggtgcagcacgcagacagacggcggcagaggccgccccacctatgtgagacccccgtcctgttcgctatgccgctcacaaggccactgagggtcccacggtgtcggtgggcggggggagcatgggctgagacgtcaccaggcaactgctcacctctgggggtcgttctcccacctgtaagctgggcgtgggctgggtagttttaaattacccagggtgcactgaggcaccctccttcctaagcatctgccaggggcagccacaggcgaacaggcttgaccccaggcctacaggatgtggcaatacagccccctgacccctaacctggctggctgacctcgggcctgcactcatggccaccccaaagtccatgctgacgagacagcagcgacgtaccgcccgtgaccccgagccccacacacaggctcgcacacagcccaccttctgcacggccttgcgcaggatgtccttgtactcctccttggtcacctccctcttctggtagaagggcttgatggccagcttcacctcctccacagcacgctcctgcatgtgcagcttcttcatgtactagaggggacatgtgtgtgatgcggccaggaagggagccgggagtccctctggccagaggcactgtggttctggacacccttgcagttccagaggcacagcgaccagcttccgcccataaactcagccccaacaactttagtttcaaagtaagatgggaacatggggaaagtgggaggaggcaggactcacctcctccttcttggttttctccgcagctagcctgggggccggggtcttctcctccgagttgctggctgcagtggcttgactggctggctctgaggctggggtcagggcagcgggcactggggccagggtctgtgctgccccacagcccactagcggcaggctcccctgaaggatgaact

SEQ ID NO: 14841 - DNA, 7104 bp, Human
cgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaacccaggccatggcgtggggcaggcgcgcgggtccatgggggtcccattcactcagtcccctgtcgtcattagcgcttgagcccaggtgtgcagatgaggcggtgggtctggccacgctgtccccaccccaaggctgcagcacttcccgtaaaccacctgcagtgcccgccgccttcccgaggctctgtgccagctagtctgggaagttcctctcccgctctaaccacagcccgaggggggctcccctcccccgacctgcaccggagatctcaggcacccggctcaactcagacctcccgctcccgaccctacacagagattgcctggggaggctgaggagccgatgcaaacccccaaggcgacgcacttgggagccggtggtctcaaacacctgccgggggtcctagtccccttctgaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatgttttaattgtgagagtatctgatattcttgactgaacaatgtaaaaaacccaaagggggctgcgcacggcggctctcgcctaaatcccagcactttgggaggccgaggtgggcagatcacctgaggtcgggagttcgacaccagcctgaccaacatagagaaaccccgtctctactaaaaatacaaaattagccgggcgtggtggttcatgcctgtaatcccagctactcgggaggcttaggtaggagaatcacttgaacccgggaggcggaggttgtggtgggccaagattgtgccaccgcactccagcctgggtaacaaaagcgaaactccatctcaaaaaaagaaacgcaaacggtgcagctgcccctttttcgaggcacgtccacctcccattacccacttccttttttttttgagactgagtcttgctctgtcccctgggctgtagtggagtggctccatctcggctcactgcagccactcccaacgccctccactcctccctactccgcgctggccggggcggggttccgctggtcgcatccaataataagaacaggcggcgcgcgcccttcccggaaactcccgcctggccaccataaaagcgccggccctccgcttccccgcgagacgaaacttcccgtcccggcggctctggcacccaggtactggggaccccagacccacgcggtgcaggccgggagcgagagcctccgtgggggctccgtgaccccggaggggtagagccaagagctgggggagcctgagagatgagggtcgggcggggagggaggcggaggcggaggcggggttccgcggagctgagaaccggacggggtgggatcgaggagggtgcgaagcgccactgtttaggtttcgctttcccgggagcctgacccgcccctgacgtcgcctttcccgtctccgcagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggtggggaccccagccccgccccgccccgggtgggagagcccgcctaggaccccgcgggcccggcacacgtgttctgtccccctcttcaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgaggtgagcgacgccggctgccaagggcgttggcattcgtcctgcttgggcaaaggggaacattctctgggtcagatttgtggttttagaagctgttctgggagaggctgccagcaggcccaggacaggtggagagccacatccccacctcctcaggccacagcctaagggttcacagccaggaagctggtgggggctacaccaggctctccttgtatctctcactctggtgtcggggcctaacgcctgccccattctctctcagaaggcccaggcacggaccagactgaggcagaggcccccgcagctgtcccaccaccacaggtacccttctctctgcctgcctctcctcctgccaggccgcggagctgcttacgttcaccctgacttttccctgcagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggtgtgggcgtgcccggggagggggggagcgcgggaggggccagtgcacctggacggacactttagaagggggctggggattggggagctggagaattaggaggggaccaccgttcccactgtcctcccctcctcaggcccagggctccctgctggggagctgtacgggtgggcagtagagacgacccccagccccgggccccagcccgcggcactaacgacaggtgagaggggtaggggttgggaggcctggggcacagggagaggctagggatgaggtgccagcacaggattcccttccggatgcaggcgaggccgcggccccagagtccccgcaccaggcagagccgtacctgtcaccctccccaagcgcctgcaccgcggtgcaaggtgagtgcatcccaggaaggggcagcctgtccccgcccacccccgtcactcacggcttgtccccgcccacccatcactcacatcctgtccccgcccacccccgtcactcacatcctgtccccgcccacccccgtcactcacagcctgtccccgcccacccccgtcactcacagcttggtctccacacagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggccccccaggctccgccagcccctccaccccagcctgcctgctgcctcggaactgtgacacccccatcttcgacttcagagtcttcttccgaggtcagtgaggcccctgcctggggggctgtctccaggggtcgttgggagcacctgcctgccaggtactcagcagagtccccttcttcagagctggtggaattccgggcacggcagcgccgtggctccccacgctataccatctacctgggcttcgggcaggacctgtcagctgggaggcccaaggagaagagcctggtcctggtgaaggtgagaccagagcctcaaggaggggaggccatgtgctcaggcccactgacagacgcctgatgccctcagagcctcggagagggggaggggaggccatacaccgggtcactgacagacgcccgacgccctcagagcctggggagggggaggggaggacacacgccgggtcactgacaagacgcccgatccctcctggcagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacacgtactggcatcttggctggtggggaattgggtccaggctgaacacgggtgaggcccagggagggaggggacctccacggcctccctgcacaccaactcacttctgtcttcaccacacacatcacagccaagctttgactcaaagaacaagacccttgacaggccagtggccgccaaagccactcccaccagctgtgccaagggcagggacagcatttccccatgcaggacacctgtcgccagccctcaggctgccactgctgcaccctgcctccaggaggcaacggtgttgagtgcaaactcgagcaattatttacaagagcacaacataattggaaaagagaaagtaaagatattcctaattcagagccaaaggtacacagcagctgttggcgggaggccacctagagatttatcaaggacgcgccaccccaccaggagcccctcttgatcaccaagtgctttatcttccaagtagtaagtcaatcaagaggtttctaaagataatccatttttgataaattagaatggaaacagtgtctctataatatacatacaaaagtgtccagttttcaactgtgagcaacacaggtgcacagaccaggtgtcagcgcaggaacccgacggcaggcatgctgatgccccccatttcccgccactcccgacagctccccgggcatggccccgattcccgccactcccgacagctccccgggcatggccccgattcccgccactcccgacagctccccgggcatagcccgtgattgcctggcctcagccctcggccccctgcgtgggcggctcctccccggcctctggtttcttgtgcctgcgcatgtgcctgtacttgtccacgtacgccttcaccaggttggccaccttcacggggttgatctctccactcttgctgtggcagatctggagaaagaggtgcaatcaccaaatgccctttcacatccagatgttccgggccagagcccagggccaaagctgggctccctcgcctgccctgctcaggagcaggccctaggtgcagcacgcagacagacggcggcagaggccgccccacctatgtgagacccccgtcctgttcgctatgccgctcacaaggccactgagggtcccacggtgtcggtgggcggggggagcatgggctgagacgtcaccaggcaactgctcacctctgggggtcgttctcccacctgtaagctgggcgtgggctgggtagttttaaattacccagggtgcactgaggcaccctccttcctaagcatctgccaggggcagccacaggcgaacaggcttgaccccaggcctacaggatgtggcaatacagccccctgacccctaacctggctggctgacctcgggcctgcactcatggccaccccaaagtccatgctgacgagacagcagcgacgtaccgcccgtgaccccgagccccacacacaggctcgcacacagcccaccttctgcacggccttgcgcaggatgtccttgtactcctccttggtcacctccctcttctggtagaagggcttgatggccagcttcacctcctccacagcacgctcctgcatgtgcagcttcttcatgtactagaggggacatgtgtgtgatgcggccaggaagggagccgggagtccctctggccagaggcactgtggttctggacacccttgcagttccagaggcacagcgaccagcttccgcccataaactcagccccaacaactttagtttcaaagtaagatgggaacatggggaaagtgggaggaggcaggactcacctcctccttcttggttttctccgcagctagcctgggggccggggtcttctcctccgagttgctggctgcagtggcttgactggctggctctgaggctggggtcagggcagcgggcactggggccagggtctgtgctgccccacagcccactagcggcaggctcccctgaaggatgaactggaccgtgggctggctgaccagtgcgca

SEQ ID NO: 14842 - DNA, 6908 bp, Human
  misc_feature (1)...(6908): n = A,T,C or G
aaaaaagccagacacaaaaggcaaaatactgtattatttcagtcttacggggtgctacagttgtcaaaatcataggaagagaaagtagaatgtgtttatcaagggtgggggagcagggaatagggactttaataggtacagagtttgtttgggataataaaaaaaaaagtgagatggggctgggcacagtggctcgtgcctgtaatcccagcactttgggaggcggaagtgggaagatcacttgaagtcaggagtttgagaccagcctggccaacatggtgaaaccccgtctgtactaaaaatacaaaaattagccgggcatggtagtgggtgcctgtaatcccagctactcaggagactgaggcaggagaatcgcttgaacccaggaggcagaggttgcagtgagccaagatctcaccagtgcactccaacctggggaacagtgggactcctcaaaaaaaaagaaaaaaaaaagttggggccgggcgcggtagctcacgcctgtaatcccagcactttgggaggcccaggtgggaggatcgcttgagcccatgttggacaacgctgtctctaccaaaaaattttagccgggtgtggtggcacacgcctgtggtctccgctaggaggctgaggtgggaggatcacctgagcccaggaagttgaggctgcagcgagctgtgatcgagccactgcactccaggctgggcgacagaatggggcccagtctcaaaaattacaaaataagaaaagtcccattgttcccaagatggtttcccgcctttaccccagatgtgtgaccctgagcaaaaaaacctttctgtacccaactgcctcatctataaaatgggggtaatgataacgaggccacagaaggcgactgtgaagtcgagttccagtgcttgacgtatacacaccccagggtttgcactgctgttagagcccaacgggagctggcgctgcctgctaacacggtagatacctgcatctgaccctgttcctggtgctcgcccgggatattggcagggatggctccttctcatctctcagctcaagctttctcaggctgcccagaggaccaagtctccctctgtccctgtccttcggatcgcctccctattcacctcctgcgtcctcgcacaagaactcaagtccttaggaggcagggccaaccctgttccctcccaggacccgagaatgtagcggggtccctgaggtgctgatgtccacatggacaccgaggtcagttccgggccaaagcggccagcgcaggggctgaccactcagacctcactcctcgcaggggtgagcgggcgacgctgcctcacgtcattgtcctgccctccaaggcccgcgctcgtcctctgacaggatgccctgacaccgcagtgcgggggcggcctcccagatagggccgcagtcgctaagtccgaggcggctggctcacctcactgagcccggctggacgtgggaccaccggtcgccgcggccagggaaccaccaaggagtcaaggcgagcctaccgccagcagcttctgcccgggcccacgcgccgttccgggtaggcccgcggcgcaggccacttccggcagcggtgcaccatgggacttgcagttcgctggcaaaggttgagtcccgggcgtggcggccgcgctccatgttgggagctgtaggcgccgcgtggcatgctgggggtgctaggtaccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgactccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgtgagtgtggtgaccgggcccggggtgccggctggggacgcggagtccgtggggatgcggggtgggcggcggggtatttttgggacggaggcctacgggccgagccacgcgcggcctcgcccggcggccccgggatgggccggcaggaggccgccggggtaactccgccgtcgcgtcctctccgcccgcctcaggatgcgctacgtcgcctcctacctgctggctgccctagggggcaactcctcccccagcgccaaggacatcaagaagatcttggacagcgtgggtatcgaggcggacgacgaccggctcaacaaggtagcggccgcccttgccccgcagccgccgtggggccccagtgtcccatacaggcgattcttctgcctgatccggccacatgctggagggttcggggagaggctcgtttcagtctagttggcgatttcttggatagagaagtaagccgggcggaggtcgggcgccggtggctcacgcctgtagtcccagtactttgggaggacgaggcaggcggatcacctgaggtcaggggttcgagaccagcctggtaaacatgtcgaaaccccatccctactaaaaatacaaaaattagccgggcgtggtggtgggtgcctgtagtccccctacttgggaggctgaggcaggaaaatcgctcgaacccgggagatggaggttgcacggatcgtgccactgtactccagtctgggtggcagaaggagaccctgtctcaaaaggaaaaaaaaaaaaaaagcagggtgggtacgaggcaaaatcgtgattaacaagctttggaagtttaataccagtgagctgcgtaagattgctttaaaaaaaaaaaaaaagcagtcctggcgcatggctcacccggctttgggaggccatggcgagtggattattggagccttgaagttcgagactggtctggaaaacattgcaagacccggtctccacaaaaaaaaaaaaaaaaaaaatggttggaggcagtggtgcacatctgtagtctcagctactcatgaggctgatgcgggagaatcatttgagccttagaggtcaaggctgcactgagtagtgattgtgccactgcagtctaacagaaccaggcctcgtctctaaaatacaataaaaaattagccaggcttggttgctcatgcctgtagtcccagactgaggtgggatagtcacttgagcccgggaggtcaaggctgcagtgagatcctaccactgcactccagcctgaagtcaaagtcaatttcattgccagtttattttgccagtgttgaagatacctatgagtagtcaacataagtagtgagatgccctgtgtccttttgtcagtcctaagtctaagaaagctagtgtccatttatttttatatcacttcccaagtgaggctggtggctccctttgggcagtgcagttctggaaacttcagggcctattcccatgtggggaacccagtcctgctgtgactctgggagggagagggccggggatacaatcgtacattcctggtaacagccctgtgattgtctgcttcaggttatcagtgagctgaatggaaaaaacattgaagacgtcattgcccagggtgagttgatgtggacgggctttcgtttgttttcatggtccatcctaatccctgccggtccatctgtggcctgccaggtttcgcttgtggaccagagcaccctagaagcctcacccgaggagtgagcagggctccagtgggctcacgtcatgggcacttctagacactctcaggagcagggcagcagggggcaccctgtgttctcagcagacgtttaggtggccctgcctcttaagcctgactgctcctagccctgaggccattccccaggatttgtctgaagcttggtgtctggagaactgagttcacgtcagcagtccttaccacatgctttctgtgagggggttgggggcagggactgagggtgccagggatgtccataggctccttgcctctttgttgggcagatggttttttgttggcttcagctgagctggtggaacttgtttggaagttgagctgttggggcagctgttcttgtcttccatgcatgtgaccacgacagggccagctcagcaaacgggccaagccatgaacacagcattgtggccagagatgtggatactggggcagcacactcattccctacctagttatgaacatgtctgtccagtggacctctgagggtggaggtggggaaattgggcaggcaggcagtgtgggcctaattcctagaaggcaagtccctggataggaaaggtggggaagagaagtccccgttgaggagtggctcagggagggagtgttcaggaagaacgggagacactggcatatggtgggtccagatatgttgggtgccatgtgccatctctggtgccatctaacttccctgtggaacagcctcccaggctgggcagctgctctggtctcacctctctgctttctgtaggtattggcaagcttgccagtgtacctgctggtggggctgtagccgtctctgctgccccaggctctgcagcccctgctgctggttctgcccctgctgcaggtaagtggtggcctggtgagtgggcaaggggctggggctcagacggtgttgctgcagtggggtcttcatggggggactggcctggcacttgggcagtgctcaccatgcctctcctctgttccacagcagaggagaagaaagatgagaagaaggaggagtctgaagagtcagatgatgacatgggatttggcctttttgattaaattcctgctcccctgcaaataaagcctttttacacatctctcaagtattccatgagcactttgtcaagggtggcctctgcccaggttcttatccaagagggcaggtgtggagctgaagtgtgggcaacatggtattggggaagcgtttctggtgcaaaatgagcatgaggaggggagtctgggcatcacagctgcctggggtcccttcctgtggccttgagcagtatcctagctcctgagtacaccccagaagaatgcgaacgggctgggcacagtagctcgtgcccattatcccagcactttgggaggccgaggagggaagatcacttgaggccagcagtttgagaccagcctgggcaaatagcaagaccccatctctaaaaaacaacctaacaaggcgtggtgtgcacctgtagtcccaactatgagaagttgagatggaaggatcacttgcccaggaggttgaagttaacagtgggccgtgatagtgccactgcactccatcctgagcagcagaaaccctgtcttgaaaaaaaaggacagcagagaagctgatttcaatggagtttgggtaatcagggctctgtctttggggtggcttggtgcctggacttgcaaggacaggattggtagcccctgggctctacaaatggatgcaggaagtgagcccagcttgggggtggcagatgcccctgggtttccctgcaggggtcatggctccgccataatgccctgagcaacttgggcaatcactcctcaggcttgtttttttgccgatcacagcccacccctgccttactgggcagatgtgctcagggcttgtgggaagtgaccacagggccatgtgctcactgaactaggtcctttggggatgggcctgccctcccccgacaggctctgtcctgggaatacagggctaaggacagaggccatcaccctcccctcccagcctctctgccctcctggccttactccgtacgcagtctcccaggcctcagggtctttgcccgccaacgtaggcacccagaagatggtctgccactcccaccctaggcttggggtcagcaacccacccgctggctttggtgtggggagcacctgctgtgtgaccaccttagttctgggaggataaataggctatagcacagaagacagttggggtggctgggggaggcctccctcagatgggaaggcaagacctggaggaaggcagagtccctggaggggaaggaatgtggattgttggagccagggagccacagaaagtactgagatggagggggacccaagatgctttttatttattttgttttttttctttttgagatggacttttgctcttgttacccaggctggagtgcaagtggcacactctccactcactgcaacctgcgcctctctggttcaagtgattctcctgcctcagcctcctgagtagctgggactacaggtgcctgccaccagtcccagctaattttttgtatttttagaaaagatggggtttcaccatgttggccaggctggtctggaactcctgacctcaggtgaaaccgcccgccttggctccgcgaagggtatttccaccaactgatgtgggatagattagggtagcgtaaaaacaccaacctttctacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagcctccagagtagctgggactacaggcgcccgctaccacgcccacctaattttttgtattttttttttttttagtagagatggggtttcactgtgttagccaggatggtctcgatctcctgacttcgtgatctgcccgcctcggcctccccaaactgctgggattacaggcgtgagccaccgc

SEQ ID NO: 14843 - DNA, 8297 bp, Human
  misc_feature (1)...(8297): n = A,T,C or G
tgaggagaaagagatgggggttgggcatggaggagggccgggtcgccacagcccagggcctctggctaggctggtcgccgtcttacctccgggcccgcctcccgcccagctcctccgtccttggtacgggatgggcccttgctgggctattggcgcccccagggctgcagctcgcccggcctccgcagtgccaggtcgacccccagcgcctacacccacgcgggttcagacctgccgagcgcccgccgccgcgggaggggcttgaggccggggcggggcggggccggggcggggcgtccccctcgtaggctccgggccgcgcattctcagcgctgggagccgccgcccccgcagctgccgccgccgccagggcccggactcggacgcgtggtaggtgagtgcgcggccacgacagctcggccgagcggggcgagcggggcgaggggggcgaggggcgcgaggggggcgaggggcgcgaggggggcgaggggcgcgagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccccccgctggtggcagggtctgcctgtgcaacccttcctgcgtgtatttaggccccggctccttcatggagggtgaatatcccctctcagctcagtggtaaggtctgtccccctccagctccattccatgattcctctttcccaggctgtagctgccgctgtttgtgggggaagggccagtgatgggtctggagcgaaggccaagagtggggcacctgggggaaggtatgaggtccctcccaggatcagactgtctcgaaatgtcatctgccttgggaggccaaggcgggtggaacatctaaggtcaggagttcgagaccagcctggtccacatggtgaaactctgtctgtactaaaaatacaaacattagctgggcgtggtggtgggcgcctgtaatcccagtgactcaggaggctgaggcaggagaattgcttgaactcaggaggcggaggttgcagtgagctgagatcgtgccattgcactccagcctgggtgacagagcgaaactccatctcaaaaaaagaaaaaaagaaaaaaacaaaatgtcttgtgccttgccccaccctagcccagactaaaataccgggcttggccactcctctctctgcctccagaatgaacccggcccactctggcccttgggccagacctgtaacctgtgacctgacatgtccttgcccctctagcctagagtcctggggagcttctgtccacctgtcctgcagaggagtcgtttccagcccggctggtgagtgctggccagggtggggcagagcaggcggggcggcgaaagtccagacctggctgtgctgtctggaaacgtggcccagggcgctcagctgtctgcaccccacgccctccctggcttccccatgctcacagcttgcccactgctgcaggtcgggcgggcacggggcatctggggaggggcatagcctgtctgtgctgccccctcgggttggtgtgggtcgcctgtccaggaaaaaccctcccagtctgccaggctccacctgcctccacgctccattctccccaccccggccaggatgaaggaagggctgccctttaacagaccgtaaacaggcctggagagcttaggaaggggctgagctggggcctgtctgagcccctacccctctgctgtctgagtggcctcctccgcccttactgcaggcccataggctcctgccagcctgtgacgtgcggccccgggaatgctgtggggagcgggcaggctggcatgagctcaccggaggtacccgctagggcttcctcccccggccgccagcaggggtgagtcagcagtgatggcgggaggtcctccatgacccctgtcctgtctgtgggcaccaggggtctgtcctggctgtcagggctcctgagtcgctaggaagtgacacgtcctgttcccacaggggctcattcacaggcctcccaggacagtggctggctctgccccgacttctgggctggcttgggtatctgtgtcccctcttttttttcttttttattgagatggagtctcactgtcgcccagcctggagtgcagtggcaccatcttggctcactgcaagctccgcctcccgggttcatgccattctcctgcctcagcctcccaagtagctgggaccacaggcgcccaccatcacgcccagttaatttttgtatatttttgatggagatggggtttcaccacaatggccaggctggttgtgaactcccgacctcaagtgattgcacctgccttggcctcccaaagtgctggcattataggcgtgagacaccgcacctggactcctttcctctactttctttgggttaatttgctagtctctttttattatttatttatttattttgagatggagtctcactctgtcgcccaggctggagtgcagtggcaccatctcggctcactgcaagctccgcctcccgggttcacgccattctcctgcctcagcctcccaagtagctgggactacaggcgcccgccaccacgcccggctaattttttgtatttctagtacagatggggtttcaccgtgttagccaggatggtcttgatctcctgaccttgtgatctgcctgccttggccccccaaagtgctgggattacaggcgtgagccaccgcgcctggccctgtgtcccctcctatccgtcccccagtcaggggcctggtgctgtggccccgctgacccctcccctgcctcctcagccccaggatgggtgagttcaacgagaagaagacaacatgtggcaccgtttgcctcaagtacctgctgtttacctacaattgctgcttctgggtgaggaggggtcgccttgcccccacccccacccccacccctcccgggccaccatcagacctgggcagatgcggtgacctttgtgtactgcttgtagctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctggtcaggagggcgcagggccacggggtgggggtggtgcagatgggcccaaggaggttgtcgctgcaggctttgaacctgtgccttgctgtgctcacctgggggggggtcacggtccttccacacctgcctagtcctgtgggtccccacgttcctgctggaccagctgagggaagacaccagctccgcaagaaagcttcagggagggtggccgcccctcagcccccacctggagcctggggagccggggtggggactctgctctgaggtgcactaggtctaggcactaggcctcagaacaagggtgcccttgtgctgccccccccagtacttcatcctgctcctcatcatctttctgctggagatcatcgctggtatcctcgcctacgcctactaccagcaggtgaggggcctgggcaggccattcagagacacagacatgcacaggcggggcggacacacacacatgcacacgcgtggctagccccaacccccacccccatggtcccagagctaaccaatgtgccactcggccctggagatggggtctaggtctctgcaggggcacatggggtcaggcaggtgtccaggggatccagaagctctctctgcctctgccgcacttcattgtcaccctggtgacggtcctggcaccacccaacctcccctcatgccgaggtctgacctcagcccttccctgtggctctgagctgggccccgggcctccccaccggccatcctggggctctgccagccccaccttggaaggtcttagactgaggctgaagtttcctgcaccccaaccccagctgaacacggagctcaaggagaacctgaaggacaccatgaccaagcgctaccaccagccgggccatgaggctgtgaccagcgctgtggaccagctgcagcaggaggtgggtgggtggtgctgggagggcgcgtgcatccccagggcctccctggacctctgcaggagcctctggccccaggtctcaaccccagccttgttcttgatgcagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggaggtgggtgtgcagcgggatcatgcctccagtgtctacgaggtgggggggggcaccccagtgactggctgtgggcagtgggacacgcctccaatatctaccaggaggtggggggtcaccccagtggccggatgtgggcagtgagaccacacctccaatatctacgaggaagtgggtgggcagcccagtggctggctgagctgttggtggcctggctgcctaggtgctaggggtgggtttggccacaccctggaggctggaggcagtaggggccagtgggaggtgccccctgggcccgccttcaacacccatccgcgccccgcagggcggctgcatcaccaagttggagaccttcatccaggagcacctgagggtcattggggctgtggggatcggcattgcctgtgtgcaggtgagggcacatgggggtggcggtcatcttgttggggacacggggcagggcggtggctggtggccccatgacgtctgcttatgcccacccggctctgcacacaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcagatggacgagctcgctgtgctggtaacagatggtggtctgttctcagggccctcgcatccagcagggcagacagacccacccccgccccgcccagtgtcaggacaaagaagggcagagccaggaggacacaccccccatggggctccagggaagggaggtctgatgccagggacagctgagcacaggcctcagcagaaagaactgaacatgttcctaaatggtgagatggtgtgttcagagcccctggaggagaggaaaaatgctttccaaaacccttctggccatggtggggagcaaacgtgggaagggtgcagactgggggccatgcccaggtaagaggtgtcaggcaggtgggctgggggcagtagggtgagggggtttacatggaggagcctataggccctgctgggggccagagggtaggaggtaccagagcctggtgtctggcagaggtaccctggagatgggagccagggctcggtcactgattgtgccccccactgcccaggttcctgtccttaaggctcagaactgtagaccctcaggcagacccgttctcccctaccagaggacaccacgccagatatctgggcagcagggacatctgacctggggtgcttgctggcagcactgcctggacagcagggcctccttagggccacctcccaacccagctaggagcgtcttaaggcctgccctccctgctgggcttgggtgggacgctcagggacaggcagcagtgggcagaggccagcaggtactggcagccctgaccacagcagagactgggccccagaagatctgtttctctcttctttttcatagttgtgttgagacagagtctcactctgttgcccaggctggagtgcagtggtgcaaacacagttcactgcagtggcaacctcccaggttccagtgatcctcctgcctcagccccctgagtggccgggactacaggtgtgaacactgtgcccagctaatttattaaattttgttgtagagatggggtctcattatgatgcccaggcgggtcttgaatttctggactcaagtgatcctcctgccttggcctcccaaagtcctgggattataggggtgagcccctttgcccggcctaaatctggctcttcagattccgagagagagggtacaggagcctctctgctcagcctgaagaacacccagaaggagggaacctcaaagagccccgagatggaaggctctcctggcagcgcctcctgcaggggtgcctgtggaacaggctggccccagggctaggagagttcatggcccagtctgcttcactgggctgccacagtgtgaaagctgggcctagacctggctcctgacatcctagtgagggctgggaccttagtggttctgaaagacctttactggatggttccttccagagtggggtatgggatacacacacactgcggccaggcattacgccagctcccggatgcctcagcctcgtgaattcggggtaggacgctcagggcccatggtcagcacagcgggtgggtgggttccagcgtggtcacttctccaggggtgcataattgagcagcttctcgatcaggtccacgtgggccagcagcatccggcggcagcagtagcgcttcaggcccagggcatccagcgcgtccctgtgtcgaggggaggagcagaggccaactgagttctctacggtctgcaaaggcctggagcccacatccaacctgcctctcactgcctgctggcctcacccccccgccaccggcaaggcgaagagattcacccggctcagaagctgagatctagcagaatgatcctggctggagtaacctggaaatgcccagaaccctgggtggagcgtgaggagcctcctctcccacctactctggctgtacgtgtgtgtgtataacatatgtaagaaatgtaaatgaaatgaaaacgaagtaattgcggggagcttagaaaaccaagaccaccaaggtgctgatgtgcagccacctc

SEQ ID NO: 14844 - DNA, 5247 bp, Human
atcttcccattagctttcctgcaatactctctttctctgtctcacagccaacttggtgaactccccctttagagttcatcctgatgtcacattttccaggaggccttctctggcctgccccttagttatccttcatggtcgaaggcaggcctttctccctctgcctttccacctctgtggccccagcccctgcctggcccagagtgctaggcaagggcccctctgttgaacaaatggcccccctcctccccagatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattggtgagggagccaggcctggagcagtgtgcacccggggccactggctggggcccagctctctggagccctctcaccccctaccctgatggaggcccccaggctcttttctagtgagaaagtccccaccccgtctgcccccaagctcgtgcttattccgtgtccttgcacagtcgggtcttccccttcgtaagccaagctgtgtgtgccgggcgccttccctggccctgcttcctcctccgccctgttggtgcaggctggaagatacaggctcagaggtttaacatgggttgcttaaggtcatgcagcttagctaatgccaaagctggacttgaccccggccctgtctgatgctgaagcttgtgacctctccacggggtgggccaggcaagggggcagtaggtgccctctcatagtcattgaatgattaagtgcctgaactggaaaaactaggcccaaattaagttgagaaggccctgcctcaggcttcttctctgtaggaggaggataatagcagtgcctgtttaaaatgcgtgcagtgagcaacatccgacgtgggggcaggagggtcctggtgcattgtgaggagcatgacccagaggatgagttaggggcctgagtggacccctgtccctcacctagtctttgactctctgtgcagagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctgtgagtagcccagtgggaggggacatgcctgggggcccctgaggcactgtctaagggaaaggtgaggccatacaaagcccacgctggggctaggcgcggtggttcacgcctgcagtcctggcactttgggaggccaaggcaggtggatcatgaggtcaggaggtcgagaccagcctgagtaacatggtgaaaccctgtctctactaaaaatacaaaaattagccccacctgtaatcccagctactcaggaggctgaggcaggagaattgcttgaacctgggaagcggaggttgcagtgagccgagattgcaccattgcactccagtctgggtgacagagcgagacatcatctcaaaaacaacaacaacaaagcccacactgggctgccccacagcccttggcacctgagcagtaatccctggctctttgccactccttggcacagccagaaggcccggtttccctgtcctggctgttacacctgttgcttcccggcctacattcctgcctcatctcccaagggccctctccccagtgtttttgaggaggaattggaagttttcctcttcttgcttaggttgtgttagaaggtcccgtcaggctcttgcagtcctttgaatttatggcaacgattgatctgtgggccccagggtgcttggcgagggcagcggaagagctgtgggcatggatggctcctggatccggctacctggcagaggctcctggccactgttcgcaggtcttcccttgctctgaaagcagcagaggctctgctcacgggcaggctaggctttcatcacggtaggatagggaaggccatggctctgttgcctccttttcttgcctctcacagattggaagtatctagggacagtgggtggctaggacagtgctggctgcagggggtctgggagcgtgggcctcacagtggccttctctatcctctgcaacaccctccagccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcgtgagtcacctggaggccaaggcgggcttgggggactggatggggaaggccctgactcagagggccagagtgagctggtggcgggaggggctcccgacagacgggaggtacgagctggacagtgtggttgacctcactggggtcccagagccctccagcctcatccgtgctgacagcttgtgccaccatgggcagcagggcccaggcagggcgctgtctcccgtcggaacaaggaggatctggcttcacctggggtccctcctgggtgcccgcagcagggcatgggtggtgctggcggcgccccctgctgccctgattgctgcctacaccgtcctgctgctcctgttctgcacatcccaggtggctacctgcaccatggcccctcgggccagcctggacccagtcatggtgcttgctttcttcttggtcatgggcccctgggtctggctaggcagttgttctgtttccctcttttaagagtcccaggggtggggttgggtggggagcagcattggccggccgtacccagagctctggaatctgtgaaattgtatgtcttgtttcacatctcttctggaaaagggggcttcctcgagccaggctcagccccgtgacagccccatgacagcgaagggacctttctgtccccgcccctgtccctgtgctgggcccacgtactcacccacgtactggtaaggatcctctgaggtctggcttttccaaaatttgccacttgaccagtgagcgcaagaggctgagcctcagctgtgctttttgtccctttcaggtgcccggctcccctgggcacccagagccccccagataggccggtggaggaggtggaggagctgtccccccaaaactactggcctgtggtctggactccagggccccatttctgatgtcgccaggtgtgcctgagcccatcggggccaggcctgaggaagtgtttcttgggaggatgggatgaccccctgttcccaagagatggcagcacagtggaggccatggtggaaaaggccctgccatggggtccttgagggccaggacagcctgagggagggatggtggccactgcccacaaggggcctggtgggaacgggtcccaggacagactcatagctagaccccgttggcggcctctgtgttgaaccagaactcattaaacacctcctcttgcttcatcctggtgtgcctctttcatggcagggccctcagccaccctgctagatggttaggaccaaggctctgttctcctggaagccaaggtcggcacattggtcttgggcttctcttctctctgggtttcttgttcactaaggagtaacacagaggtcaggcagagaatgggggtctcgcaggctagggacctcagggagaggcctctgttgcccttttcagcaaggctggaaatgggatatgggcaggggacgtcttctctgacttcaccctagaccttctggctccaaatggggcccatggccttgagcacctgggaccagctctttccaccacagggcattgggcactgggcactttcttatcgagatagtcactcccacgtctggttcgtgatgggcttggccctccagctcagcacaactgcaagaatggattttgtattctctagacggacactgtccaagatggtagccattggccacatgcgacacatttttaatgaattaaaattaatcaagactggaaatgtcggccaggcctggtggctcatgcctgtaatcccagcactttgggaggccatagagggcggatgacttgaggtcaggagtttaagaccagcctggccaacatggtgaaacccatttctactaaaaacacaaaaattagctgggcatggtggtgtgttcctgtaatcccagctgcttgggaggctgaggcaggagaatcgcttgaacccaggaggcagagattggagtgagctgagatcatgccactgccctccagtggccaccacatccggcaaggcagatgggaccatttccttcatccagaacgttctgtggacatcactgctctaggttcctcccttatggagtctcacaagactgtctagccagcaagatctcttttccaaccaggccaggagcacctctccacccactgctgctggtctgaccgccttcctggaagtccctcttgaggcaggccctggagttagaagctgggcagaggcacccacagccttatcctttgccaatctctgactcaatgccacggccactgtagtgagctgaaccacctccagcagtcccctggcagaagcacctggaaaacatgcaatgggaaccttcaccctgaggccaggcccttcccatgctacccaacagtagacaggacaccctgtgttgttggctgcaccggggtgctgggatctgtggatccctggggcctggaagccactctcagcacatacagccactgtgttccgaggtccagtcagctggccgggaaggaattcaacacagccaaggacagaggtccatatgatgacgggtggatgctcgtgtgactttgctgaccttttatgttttctatgggcaataaaggccaagagagctccctgctgtgtgtttcttgcgtcctatgggttggatgggaccatggagagtcgcccacttcttgcctcggggctggcaatggcctgagcctgctgggctcacaaagggcaggggctccagccctctgcttggctgctggctgcagggctccacaccttggagtgagtcactcagcctctgtatcccaagcatggaaatgagattgacctgcctcacagggttgatgtgactctgcccgcagaaggttc

SEQ ID NO: 14845 - DNA, 5322 bp, Human
aaaggctcagttcaccaagactgtaataattcccaagagtaaacaccttaataacctaaatgcagagagggcaaaagttgatttaaaaattagaaacaagttgaaaaacctacagtcacagttagagatttaaatataccattcataggccaggaattgtggggcatgcctatagtcccagctactctgggaggctgaggcaggaggatcgcttaagcccagctgtttgaggctgcagcgagccatgattacttcactgccctccagcctgagcaacagagcaaggccctgtctctaaaaaataaataaataaatgcaccactcttagttatgtataggccagtccaaagataaagaaaaccgtaataaattagaatgacaaaatccacatgcttgatccaataaacatgtacatgtataaaattctgcatcacatttattagagcccatgtgaaatatttacagaagttcaccacactccaagccatagaggattatcatgtaattaaattataagttaataacaaaaaacatactttaaaaaatctatgtatgttttcaaataaaaaaaacacccgatactcgactgttattaaccaaagaagcaacattctttatcatgagtttttcatggctttcccgtctttcatctcatggctccagctcccacctcacttggggggaggtgaaggtggcaagggtcctaaccagggcaggaccaaagcagtgaagacactgttcattcatgcgcaggtgtctcctaggcgcctatgatgtgctaggcattacgtagacactgtggactagaaacgaaaaaactaagattagggctccccataaaccgggccatgcaaatcaattactagctgtcatttgattaatttgaagtcagaagctgtgtctgccccacttaaaataggcatcccttattcattgaggaaagagcattggagcaggttttaccagtccacagactacccgagaaccacctggggagcatgctgaaaacacaggttccctggccctgccttggaaaggctaatctaacccattaagtaaagaggaaactcaggaacacgtattataacgaaccccccaggtgattctcatttggaaccagagacccgcatgatttcctagctccctccaagttgaaaatcatcgatttcatggtctttgacacatggcctaatttggttagatttctctttacacagacgttagctttacgttgttgttgttttgttttgttttgttttttaaatatatatactggactaaattctcccagtgcctcttattagccgagcccaaccagaagccaaaggcaagggtgatgccgtcctccagcctgtgtcagcctggaggaggtgcccgggtcctggagggaccaacagagaggaccagcacctctgccctcctcggggagtccacgggagctctttacactttgctttagaccaaacaactccaacaattacacattttttcttacacaatgaaattaaataataataaaagaaaaataaaataacatttttgaaagtgatttaaagttttaagaggtttttattccattgtgtagccaatgttttccttttaaagattattggtaaagtttattttactttctaactcaaaatttgtccacggaaacttcttgggaaagtaggattccctgcatcgcagatggacatagagagaggatttgttggagctcagctgcgcggtgctctgacggccttttctctctcttcagggggtcccttcttggaggacgtggtaatagttggtccaagcccctcccatcctccaaaacttcctttggcctctcctgggggcccagtgaatccttccaccttctcaccccggctctttccctctttacccagcaacagatacattcactcagagaatttctgtgattggctgaagacagcaggggtcgcccccatcctcgaatctgttttcttcttctttacctccgccttgttcctgtcctcaccacacggactgagactgatttgattaaagcaccagagtgtaatggccctcagagcagggctggtcctggggttccacaccctgatgaccctcctgagcccgcaggaggcaggggccaccaagggtgagtgcgagggcgaggagggtgcggcggggagcagagatttacggagttgggttacatgaggaggtggcatggaggatgcttgttcctctcgctctctggtttatgggcaacttccttcaccaagagacacccaatccccctcatctctgtcacatccactctggacctaaatgaagatgcagctcggtcagctgcgcaggtgccccagtcagcctttgctgacgttcagatttctcctcattccttcctccttcctgagacccaaacctccacccaacagatgccagcaagcaccctgatttctctaccacccctggccgggaatgtgcccgatcaagtccagttctgttgcagtatttatgcccatgccggtagttaactatttacctgtctttgttcttcgggagacatgagctggggtgcgggtctacagatggttcatcttttttttcttttatttccctggcccaccattgtgctgggtgcatgctagttcctcaataactgttgctcaaacaacttcatagagttctacaagaattaaaacttaatccctaacttccagaaaactagacaacagttatggaagagccacactcagtcataatgctctgagatggaggaattgggacatgaaccttgacttctgactcctcgtccagtgctctttgtaatgccttgagttgcctctccctatccccttggtctctgggtcactaaccttaattcttacccctgccagccgtggcctgtttcccctcacacccacctgcactgcatctctgtgcaaagctccatactctcctgtccttaatcattcctcctcatcccacccccacagtcccaccagctcacaacacagggcctgacaacacagccagggcagatgaccacagccaagatttaaattctggaaccccaagcatgattttaggcagtccctcctcttcccatcctgatatgccagactgcactgtctctgtgccgactgcagtgtgctgggatgagcctctttcttcctgttctctctccctttctctctcccagggccagcccagtgtcagaacaggactctgtccccacacagaacccaggacggggcccaggctcagggactcaacaatcacatattgtggatgagacagacacatttttttctctctccttgaccctgaactcgccaaacacagctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacggtaccggccctccctctgcccacccagtcaggcgggaaggtccagagaaacttcctcccagttcctaggctcccatcactctggggcgcgctctcagcgcccgcgcctgtcatgccctgttcctttctttcccaggaggctccaggtcttcccagacccctttggcacccctctccttgaggaatgacacctctcacccggactcccgcccagggaccagtcaaatataggagctcctggcgtccccactccctccccagtctcctctccctctgtttccctcctctcctgccccagtggataccccagagcatcccctgcccacagatggctacaaagggggaacgtcccttaatcccagtcctagtaaggccctggggtgagggatgagcctgtggactcagggcccgttcctcctagtgcctccacgggtgaccgtgctccccaagtctcgggtggagctgggccagcccaacatcctcatctgcatcgtggacaacatcttcccccctgtgatcaatatcacctggctacgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattggggtacggagccccctccccatgcaccctcctggccccaggtttcctttactctagaatcctttcatataccaccgactccttcctttctctcctagagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtgcagaggccccgggagtctggggggtgggggaggaaagtggatgactctgaacaggacgtgggtggagaatcagagattctgttgtggggaaagaagtcagaaaagaaatgggcagggagaaaagaagcagaggtggggtgagagagtgaggttttgggggaggtgggcactcagagataggatcccagcatattgaaattgagcaacctcgatcgtatgttttctgctattttaggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacaaacacacattcttgctctacccaaagctctggctggcagcactaaatgctttggtggtgtttgcactgtgtcctttccaggccttggccagttcttccaggggtgaggcatgtggtgctggggattggcagccgtcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaacaacagttctgaagggtgctgggacaagacaggctcatggggactccactcctgcctgggtttactctgt

SEQ ID NO: 14846 - DNA, 9458 bp, Human
  misc_feature (1)...(9458): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacctagtctatacaaaaaatatgaaaattagaaaggcgtggtggtgcacatgtgtagtatcagctactcagggggctgaagtgggaggattgcttgagcctgggaaatcaaggctgcagtgagctgtgatcatgctactgcactccagcctgggcaacagagtgagaccctgtctcaataattatataaataaataaataaaaataaacaaaataaaacttttgcctttcttaattctcacatattctgaaacagatttttcaaatttccacccatgaattcttaacatcagtgattttttttgaatcattaatgctttttttaatttttttttttttttttgagacaagagtttccctctgtcacccaggctcgagtgcaaggtggtgcaatctctgctcactgcagcctctgcctccctggtttaagtgattctcgtgcttcagcctccgcagtagttgggactacaggtgcgggacaccatgcctgactaatttttgtatttttttaatagcagagatggggtttcgctgtgttggccaggctggtttcaaactcctgacctcaagtgatccatctgcccttggcctccaaagtgctgggattacaagcatgagccaccacgcccagcccactaatgctatttttacatccatacaacacagcttatcgaagtgcataacttttgctatcactttctattcacgatatttaagacataatatgtgtgtgtgtatttatgatgctgtcactgtctctgtaatcctagatcagaagtacttagtcacatgagattggtacagttgtgttttcattcatcctctattcttaatctctctttgtgatttttgagaccataaccactatataattcttttaaaaaggctgagaggtgtgacagcactgcaattgtggggccatcagaagaagaatgatagtaatatctacattaagttcctctgcctcttttcttttttaactacttctaacagttaacttctaccatcatccaatcctataattgattttcagtattccatgtaaatatatcttccttaaataatactttttgttaatcaaagaaaagtaactgaaaatgcctactcttgtgtgagatattttgtaaggactttaatataagatagctttttttgcctggagtataaaagagaaaagtcatcttcttacatgggcatatatggcaaagtgggttgtcttctctcttcgtcaatgttctaaaacctgaaaaagccaaggaaatatttagttggcaaagttcagagaattttctaagtgtatatggatgaattttgtcctggtcaacatgatgcagagatcacacactttatttttatttttattttcactttcactatttattacagcagggaaatatgtaagtatcagtgtttgaggtgatatttctcctactgaaataccaagtactatagaggaacacaaatacaagtttaaatcaatgcttataccagtaactagtaacaacaacaataacaaaatctctgcaaaggggatttcaaccaaaagaaaaaaaattttagaaaaaaatatttttaagctgaagcattttactttttactgtcttaagactagaaaattgtgttattaatattttatggtatttcttcatagaaaagcccatctgatgtaaaacctctcccctcacctgacacagacgtgcctttaagttctgttgaaatagaaaatccaggttggtgttaatatttgcagttccttttgccttttaggaaaaaaaaatcaaaccagtgagttacttctttctgatttgagggaggagggaaccagttatgattcatttctattctatctcattaattctacttctttgactttttagaaatgtctgcagcatagtgagattctcctttggacacaaagtgttttgttttgttttgtttttttaacaaaaaaaaaaaaaaactcaatcaaatagtaaaagcaaaagagaaaaccaagtgtacttcgtatttcccaaactgcaaagttatgtgtataggagactctatggtcagtatggtgtagcatagtgaattagccccagatctgaaatcagacttggatttgaatccatgctccaacacctattagctgtgtaaccctgagcaagctactaaacctcttttaatatggggataatgatagtatcaacctcacaaagtttaatgagaattaaatgagctacaaccggtaaagcatttaaaaccatttgtggccatcataagtcctcatgcctgttagctgttatcaatatagcactgacatcaatgctatatcaatatagcatgttatcaatatagtgtcattcccaaatgacctcctgtgcacactggcaagccatctggcacatgctttcatctccactcccaggtgctaagcagatacaaaacatgtgaaaggccatggatatattttgtttatccagaacagtattaaaccacatagtgctttttgaaaagaatatttattgtcaacctttaaaagtcggaaattgttacattttaaaaatcaagtattgctattcctctggggaaaaatgtaaactcccaaaatgctgagagccttcataccagcatgagaccaattcctaagagctgagtagtggctgctacctgtactgtctgtctaaatccctagccaattgcatttgttttattcaccgtggcccctggtatgaactcactaagaaagcatatagtttctattaaactttgcctgaagcataaacccaaatgacatctattttgggagatagttactaagaacaagtctctggaatgagctttatttctcaagcaaaagagatttcattctgccttctacaaaatcaactgattttactcccataattttcagaaatcatgacagatcagaggtcctgtatgcttctggatttcgattttaaccctgggccagtctaggttttctagactttagagtcacagaacacagagttttcaagatccatcacagctacacaggttatatgcaggatttgccacatcacattatcatgtgaattcttaaagcttaagagtaattgttacataagtttataatcctaagacattcctgctatgtggaaatgaatggcatagatatgattctcagctaaaaggattaataaaatccaatctgcagatacttgaaacaacggaagtttttgagtcatatgccagattcacttcatttactaaggttatcttgttattggactggcagctggaacaagtatctgtaaaatattcattttatctgcattctgccttgttccacaaaaaagtcttgatgtagtttttcaagtggagcaattacaacctaaagcctatttttcgaactgaaatttatatacatttttagctacttatttattctagagacaaatttattgtttagtgtttcccctgccatttttttcatacaattttaagcatctcaaatgtttggcacaatttaatacaccacagtgcatcaagatgtccttgtagtttaattcagttaagtgcaacaaacatttgctaaatgcatacagtggggtaggcaccacactcacattagatataccaatatgagtcttcgtcctttagaagctgagagactaatggaaaaaacagaatgtcattgcagtgaacaagttctacagtagtggaggcaatagctccacttgtcccagagactgagacaggtatcaaaggcttctgaagatgaaatcacctgggattagccctaaaagacagatagatattacctagggcagggtagttttagcagaagggcagcctgagtgagtaaaagcatggaagacagaatatgtttacttaaagaattgtatgcatttccacattagcaggattgctgctttggttctctgttcacgtctcaaatatgtgtaacggcagtggaaagtcagaagaaccaaactttaggctcactttatttccccacatttgtgcaagtgaagttattaaatgtcttagtatgttagtgagacaagttatgaattctgactgcacctcacagaaaacataggaaaacacattattaaagattatttaaaatgctttatttctacttttatagaatatggctctaaattagtttataagccaaaggcataagaggttaaaatgacagtaccatctcaacaagaactaatgatgtaaaggagtaattagagtataaattgttttaaccttctaaaagtgcacatgatctgtgattggtgaaaaatgagaataagcgaatctgagtcagctggccactgtggcatgcatatgtgacccactagcctatttcccacaggagaatgtttgagatgcacagttcctgtggtgcccaaatagaagaaggctggaaaagctctgcttctggaagagcaagggctcccctctccctttcatgcagtttctaggagcaacataaattcaaccttccaaccaggaaaagtggagcatcgggtttactggagaaaactagcccagtgcccttcttttacaccctagaaccagagaggaacttggccataagcttttgtgcagacttctccttgggggaaaaaaaaagtcattatttaaaaagacatgacagacttagacacatgccttaaattttaacatgcatatgtgattcaacttatcatttactggcttcacattatattttgcctctatacaagtttggctgtttgtttcttatctctgtagaaactaggagcagagcaattatatttattctttacctaaggcttttagaatagatattctaagaaattctgtatttttctttacacaaaacttgacaatagagctaatatgtaaggagagtcctttcgtttcctactaattacattcaagaacaactctgcaagaatgtagaatcctaaaatgtatactgtgcattaatttcctgttgtgtttaaacataactatgtctcatatttcggtcttgtattttttttactataatccttctagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcatttccttcattgctgaacaggcaagatataatattacatgaatgattactatattttgttcacactaataaagcttatgctcagaaatgccatacacacacacaaacacacacatttatcatttaatgcataaatcaacacaaaaggttttcccattaatatgaaatattacatatatataagtgccatatttaaaataatttgtctaacagtagaactatgtcggagcactcactgaagcttgcattccactgaaagagttatttgtgtaagtagagtatccggagaaggaaaagaacttacgacctttctttataacagaaactcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaggactgtgactatacagctgtcactcatttgtagtaaaacttaaaaagcaaaaacaaaaaacaaaaaagaccttcctgtgatactttatttccgaactaataaaaatctatatgactttttattattgtgtgataaccaagtaaatgttttctattttgcatattttcaggcatggtaacagaaatttaccttttaataaattaaaaaatctaaattttaacctacttgtatgttcggagagtgtttttgtactatattgactacttaaaatagagaatgagactaagaagggaacatttctgttgatacatgttttttaaaagtaattttaagagcattattaggttaatttaatccaattaatgacccaaatgccaaggtaattttaaatttacatttttaataaaagcaacatgttgaaacaagagagggtgagattaacctttttgctaaagtaatttacaagtcaaagacaggaagagatcagagtgaatgtgccttcttaaccagagctacagaatttagtgaataattaaagtacaaactgctttgacctccttgaacttttccaagcaatttctctgtacttctatatatgaatgtcttagccaattttctgctactataaccagaatacgacagactgggtaatttaaaaagaaaagaaatttattttcttcctagttctggaggctgggaaggcgaagggcatggcactgacatctgccttgtaactgatgagaaccttcttactgcatgataacaaagcagcaaggcaagcaaaagcgtaagatgaagagagaggaaatgaagccaaacacatcctttcatcagaagcccattccctctataaggcgttactacatttatgagaatggagtcctcatgacctaatcgtgaccttaaaggcccctcccaacactgttacaatggcaattaaatttcaacaaaggttccagaggtgacattcgaatcagcaatgaaattttcatagttaaatttggtattcgtggggaaagaaatgaccatttcccttgtatttttataattaaatcagcaaaatattgtaataaagaaatctttcctgtgaagataccatgaccccatggatggctcatgttggatttcttaaaattggggatgggatgggaaggtttggtgatgctgattatggaattgtactcttcagccctggttgtttgcttgtgtcattatgagcaaaagatctaaatgagggaaaaaatgaatggagaaggctgagaggcattgtgaagaaagaatgaccttttcttgcaatagaaatttaactccaaaaacaactctgaacggagagccaaagaacagcatggacaaaggcgtattttggtgatactgatatatagtgattgaagaatagccttctggtttattctaaacatatatcctatcaaatgtagcaaatttcttagaagaaattcctaaaagccaaatgttatttaaataaaaataaataaatactttgacccaaagtgatgcataggcctctcactgtgtcaaccagttctaatgcatttatgccctcagctgtatttagggggcatgtgcattgccaactgctaacccactttcagcatctagatgtaaacatctcctctgaatcctcacagcacttatgcatattttgtagcattactatgatctgaattccatacccttcttaactatgattcattaaaagcaagaactttaattcatttttgtaactcctgagaggcttaacaaaatttgcttcttatttcatgaagcctttattaatatttaaaatggcatgatacacagtgacctcttaaaggtttggtctggcgtgatgtggacagagaatcagatttggagccaggatttgaatcctcactatttattcacataactttggtttctttatctgaaatatgaagattagaataactgcctggcagaaatgtcacaagagttatatatttatacagaaaaatgaaaaacaagaagaaactattaatatcagtccaaaaggaaaaaaatttactctcatgtagtgagagataatcctcatggcagtcatgtgcaacttttgcaattctctcccgtatcttcttaaacctgaaaagtgtctagtttatttacatgttgatataatgtgtagagtgatattctccacaactgtttccctcagactaaagcccctggatttttttaaattttgcatagaaactaaaccaaggttaatccataaggaggaagcgcacaaatgctttttgatggaaagaggtatattacagcaaaagatgactcaaacatgattctatacaaaatctgcttttgtatgggaaaataagcagcttttcagaactagccctaatttatctttaaagaatgtaaaagtgcttatattgaatttgtatatagctgtagagcttagtgttaagccataattaatacaagagaaagaaaaataaaaggataagcacagttatgttttataagtttacctgcaagatactacattacttgtctgcaaaagacacaacaggtgggttctcaaaatagaaaataaatccagctgagcgcagtggctcacacctgtaatcccagcaccctgggaagctgaggtgggtagatcacctaagttccagaccagcctggccaacatggtgaaatcccatctctactaaaaatacaaaaattagctggccatggtggtgcacacctgtaatcctagctgctcaggaggctgaggcaggagaatcgtttgaacctggaaggcggaggttgcagtgagccaagatcgtgccactgcactccagcctgtgtgccagagcaagactccgactcaaaaaaaaaaaaagaaaaagaaaataaaaaaataaatccaattatggaaaaaatacagtcatagttttgtaccctgagttgtgattattcattttttaaaatacacttattatttcctaataccttatttacccatgaaaagaaattaattattaagaggtatgataatatttgttcttaaacctacacttaaaatgtcaaaagtgtgaccatagaatgagggatcttaaaattgacaactggctgagcagcctggag

SEQ ID NO: 14847 - DNA, 6328 bp, Human
tttagggccgggcgcggtggctcacgcctgtaatcccagcactttgggaggccgaggcgggcggatcacgaggtcaggagatcgaaaccatcctggctaacacggtgaaaccccgtctctactaaaaatacaaaaaattagccgggcatagtggtgggcgcctgtagtaccagctactcgggaggccgaggcagaagaatggcgtgaatcggggaggctgagcttgcagtgagccgagatcgcgccactgcacttaaaaaaaaaaattaaataaataaataaataaaaattatttaggaccttatctgactggctatagcacaactgaaatagcaaaatcaagattgaagggctattttcagcacaggtattccatttccaatcaaactcaagaactccagcagtgcaggaaccacagacctctttaactttgtgctgattcctaggcatccaccctctactggctcccctcaacctggggacatccctcccccatcctgcagcaacttcgggtccatcagtagtccacattttggtagggctttgtttattcacaagtccacatccctggaaggaactggctccctgggctgtgatggcgcctattctaaagacttcctcagagtggaaatttaggcaacaacagctcaatcgctcttttatgacaagtcaatcagtaaaacaatgataaaacctcggttaccataacttagaggctgtaatagattaacttttcaagggcacttgatataagctctgagtagactctttagagtctttattcacacagggttttaggaaaccaccctctttcataactactgtgtgtaaataacctctatttatctaatttgtaattttcctacagtcccctcaaaagggaacattaaaagaaatactaaaggaagttggaaagtttgtcaatgtaaagctggtctttgtaacctttctactcttcatttcctgtggcaattgcacttttatttcccgtctctctacactcagtaaacaaaaccatattatcaagggaaagacgtgagcccattaacattgtgagccctcagatttcactcacaagagacgatgcagcacttatctgatggagcagaagctctaattgcttcgaggtacaagtccatctaaacctctgagatctcacccgtccccggtaagcccttgcgccctccagacaagctcctcagtgaaagcaagcgccgcaccggtgcctgtgccagtctcccagaaaggagcataaggagtgttccaccaccactctggattctttattccaacaacccagccggaggggaaaatctgctaaaccaccccacaaggcagaaactttatcaaaatctggcactacaacactggccctcatcacgccgccacaaattgcgagggatagaagaaagctgcaaagtcacgttaaaaggaagcctagtcaaaaagtgaaaattttgtcccgccctaggcacacagcactcacagcataagatgtagttccatgagtcctaggaaagggggaagaaaggaaaaaaccaaacatctgctctaggtttagaagagggataacatcagcgccaagcaaaccgaaagcgcagaggactcagaagaggggaagaggaataactttatctgtcctggaggtgggcgaagagcagtctccaccggccgcgcgtcacgctcccatttaaccttttccatgccgcgacgcccacactccgccctcgagggactagccccccccacgatccagagcagaagcggctcgccccgctgcatccacgggccctcacccaagcgtccagtcctgcctttctccccccacctcgcccaatacctgtccgagagcaggcgttctgccctctcgccccgcccttgcccaggcagcccccggtcgcgacggctctcctcggggctcgggggcgctgggcggcggccctgggctgctttggctaacttggctgcggggcaggcgcgaggagcggcgcgccgaccgggccgagcggagaggccgcccattggccggccagcgccacgtggccgcccccgccggtatattaggccactatttacctccggctcactcgccatgggttggagagggcagctcgggtagagagggctggcggagcggcgcagacggcggcagtcctgctcagcctctgcccggctccgtactccggccccggcctgcgccctcagaaaggtggggcccgaaccatgagctcctacctggagtacgtgtcatgcagcagcagcggcggggtcggcggcgacgtgctcagcttggcacccaagttctgccgctccgacgcccggcccgtggctctgcagcccgccttccctctgggcaacggcgacggcgccttcgtcagctgtctgcccctggccgccgcccgaccctcgccttcgcccccggccgcccccgcgcggccgtccgtaccgcctccggccgcgccccagtacgcgcagtgcaccctggagggggcctacgaacctggtgccgcacctgccgcggcagctgggggcgcggactacggcttcctggggtccgggccggcgtacgacttcccgggcgtgctggggcgggcggccgacgacggcgggtctcacgtccactacgccacctcggccgtcttctcgggcggcggctctttcctcctcagcggccaggtggattacgcggccttcggcgaacccggcccttttccggcttgtctcaaagcgtcagccgacggccaccctggtgctttccagaccgcatccccggccccaggcacctaccccaagtccgtctctcccgcctccggcctccctgccgccttcagcacgttcgagtggatgaaagtgaagaggaatgcctctaagaaaggtaagtccgcgggccttggatggggccacctggggttggggacggagcctcccccgcggaaatgcgctgggagcgtggtgtcgctgcctttccagacagcggtttgggttttgtggaggagacgcgttcccgggcgaattccatggagtctgcctcgagtacagattcggaaaatgtgccaggcattgagaaaatttcaggaaggagctctccgtggaacttctcctggtacaaattctgttcctagggacccaggagggctgcgctgggactttgattctaactagctccactgctcacccacattctgtccccggcctcaggcctggctgacgccctgtctttacgttgcaggcaaactcgccgagtatggggccgctagcccctccagcgcgatccgcacgaatttcagcaccaagcaactgacagaactggaaaaagagtttcatttcaataagtacttaactcgagcccggcgcatcgagatagccaactgcttgcacctgaatgacacgcaagtcaaaatctggttccagaaccgcaggatgaaacagaagaaaagggaacgagaagggcttctggccacggccattcctgtggctcccctccaacttcccctctctggaacaacccccactaagtttatcaagaaccccggcagcccttctcagtcccaagagccttcgtgaggccggtacttggggccgaaaaactgtggcctgcagaagtcccaggcgacccccatccctatctagacttaggagctcagtttgggatggaggtgggagaacaaaaatgaatagggatttcacttgggaaatgaagtactttagttggcttccgagttccagactatatgtccagatattaattgactgtcttgtaagccacttgtttggttatgatttgtgtcttatcagggaaaaggtgcccagctgccagcccagctccgctgctatctttgcctcacttagtcatgtgcaattcgcgttgcagagtggcagaccattagttgctgagttctgtcagcactctgatgtgctcagaagagcacctgcccaaagtttttctggttttaatttaaaggacaaggctacatatattcagctttttgagatgaccaaagctagttagggtctccttgatgtagctaagctgcttcagtgatcttcacatttgcactccagtttttttttctttaaaaaagcggtttctacctctctatgtgcctgagtgatgatacaatcgctgtttagttactagatgaacaaatccacagaatgggtaaagagtagaatctgaactatatcttgacaaatattattcaaacttgaatgtaaatatatacagtatgtatattttttaaaaagatttgcttgcaatgaccttataagtgacatttaatgtcatagcatgtaaagggttttttttgtaataaaaattatagaatctgctgctctctgcttttcttacactctttaataatgattctctttctttaaagttgattcagtttcctgtatttgaattttcttgattctgctatgagaatttgtttatgttgataacttttttttttttttgacacggagtcttgctctgttgcccaggctggagtgcagtggcacaattctggctcaccacaacctctgcctcccaggttcaagtgattctcctgcctcaccatccccagtagctgggattacaggcatgagccaccatgcccagctaattttttgtattttttttagtagagacggggtttcaccatgttggccaggttggactcgaactcctgacctcaggtgatccgcccacctcggcctcacaaagtgctagaattacaaacgtgagccaccacgcccagccgataacttttaaaaataatacttcctacaggttgtgtacacacccagcaagttatgggcaattagtagtttaagagagaaaactactctgccaaatatccaagtaactatggaaatactttccttaccttgagtgccctaattttatggtaggtgtgtagtctgcacatttaactcaagtgttaggtgcctactgtggaatgttgtaaagccaaggagacacttcagggagatcttgttcttttgtctcctgtcctcacaaaaggaagaggaaaggtgacctgaagactttgtttcttggttagtgttccctgagaaaggcagctgcacatcaaaaagttctcagtggctgaattcccatttccaaagtcaagagttacaaaggaggctgggaaaggctagtagtcacaaatttctacttcctgtaacccagactgagtatctggcggagagagagcacagacagtgcctttctgatttcaaaaatgaaatattttcaaatgaatactttggaagaggtacaagcacaaaacttgaaagttgacaagagagtatgtggttaaaaaaaaccccaaaacctattctctaatctatttcacccaaactcccatttctcatcccgggaggcattcatagttgaccagagtttatgtaaacttgcagaaatatgagaaaaagatgcaatataaagatacagaatcaagtggatacttgggacagttttggggagtacgtccttattttacaactatatctttaagttctttctatagttcaacagaagggctaacggcccaaataattcagataagaacctcagctcttttagctagatttctagattccagtataatgctttaaatctaattattcataaatctaagcaactgtgaaagattaccttttttataaagcagcaatatgattagttctcttagaaaattggagttacactgaagttctcattctttgcacctatagttgaatggagttgaagaaataaaatgatcagctccaacaaactcagctgattagagggaaaagatactgcttaaaaagcaggtctgtcaatattattcttgtttccccggctgccctttaataacttgatgctaattgaatcttgtttgaaacaacagcccccctctgagctctactgctatttgaaagaacttgttaaaggacttgtgatctgcttgcttacagccacctctgggcttcccctgcagtggtctttgacatgacaatgtttcctttttgataagcatttaaatgtacacctaaacaacaacaacaacaaaataccaacatgctgggtcatttccttaatctaccacccttttctctgagaaaataaagcttttccttctgaagctagtactagcacttagccctgatggatgtcttccttgatgaaggtggctattatgacattcgtataatgctattctatgaatcaggccaatattagctattttttgcccaaccccagggatctttaaaagctttcttaatgcagatcactgtacagctatattcagtattaggaagagtcctggctggagatcgggatgaactaggtgac

SEQ ID NO: 14848 - DNA, 7112 bp, Human
ggaatacaaaaggggtaggatttttcttagcttttttttcttcttctaattctgggtccattcatcatgtcatgaaaggttctctcattggttgtggtttgggtgggaggtagggtagaatagattatccagagcagatgtcaataatatctatttatacaatagatccaaggcaaaaataataaagttataaagcattctccactcacccatgttccatgcatttcaaattctagatctctttgcccatttccagtggtatctgtttaaaagtaggggaggtcaaaagtaaaaggtctagaaaaatgtaaatgaaagagaagaaacattttctagcctcaaaatgagtctggaagtctgcaagtcctcctgttggtgtttatcccctagttttctacattgtagattttacactgctgattcatagagcttactcagctgattttcaccctgtcatcgttaagtggactatctggactttcatgcaagatgctgtgattttgaaaccaggtggggggagaccctttttttttttttttttttttttttttttaagttctggctgttctgagcatgttataggactttcatttcccatcaaaaccttgtgctgacccaatgattgactgattgatccacttattaattcacctattcaacaagcatttattgcactaactacatgcagggcactgtgctggatgttaggaacagtagacaaatgacacagcccctgcctgcaaggagcttacagtttagtgggcgaatcagccaacaaaatgtctgaggctataagtacttttccacacagaagaaaggctaaatggacaatcttgaagaaagtaaattgtatctggaggtagagggaagccctttccctcagctacagttgagctaaaaagaaggaaactcttcttacatttaggaaaaattccttctgatacttccagaggttcaaataagttgaacttcataaaatctgccaggcgcagtggctcatgcctgtaattccagcactttgggaggccaagacgggaggatcacaagagcccaggaactcaagaccagcctgggcaacattgtaagaccctgtctctacaaaaaaaaaaaaaaaaaaactaagagctggcgcagtggctcacacctgtaatcccagcacttagggaggcccaggcgggttgatcacctgaggtcaggagttcaagaccaacctgaccaacatggtgaaaccctgtctctactaaaaatataaaaaattagccaggtgtggtggcaggtgcctgtaatcccagctactcaggaggctgaggcaggagaattgcttgaacccagaggcgtaggttgcagtaagctgagatcatgacactgcactccagccttggcaacaggagcaaaattccatctaaaacaaaacaaaacaaaacactaagacatgtagccaggcatggtgggcacctgtagctactgcagagtagctgggactctgaaatactctgaaatagctattaatactgcagaatagctgggactttgaaatactctgaaatagctattaatactgcagaatagctgggactttgaaatactctgaaatagctattaataccaggctaaagtgggaggatcgcttgagcccagtaaattgaggctgcagtgagccatgttcatgccactgcactccagcctgggcaacaagcaagacactgtattaataaataaatagataagtaaataaactcagatccagcaccttgcccatctccccgccgtgaagtgggtaggaagcagagagcatgggctagtccttctatattgactggtcttgccaatgacactccctctggggcctcttgcttttcttctgacaggtcacctggagcctgggggccggcccagctctctcaggattcagcagacattggaggtggcagtgaaggatacagtggtagtcaatgttatttgagcagggtcagcaggccctggagcttcctgagtgcacaatgcagaaggctgcttactatgaaaacccaggactgtttggaggctatggctacagcaaaactacggacacttacggctacagcaccccccaccagccctacccaccccctgctgctgccagctccctggacactgactatccaggttctgcctgctccatccagagctctgcccctctgagagccccagcccacaaaggagctgaactcaatggcagctgcatgcggccgggcactgggaacagccagggtgggggtggtggcagccagcctcctggtctgaactcagagcagcagccaccacaaccccctcctccaccaccgaccctgcccccatcttcacccaccaatcctggaggtggagtgcctgccaagaagcccaaaggtgggcccaatgcttctagctcctcagccaccatcagcaagcagatcttcccctggatgaaagagtctcgacagaactccaagcagaagaacagctgtgccactgcaggtagctccctgaggtggcctactgccagaccaagccccctccagattgacccaaggaagcctagtcagggctggaaatgcaaccttggaggtcatatgtctaaactcctactcacgtcaaaatgttcttttttttagtgttcctgattggggtcatgaccttgcagtgacagggtgctcccttccattccaggctgctggtgctgttgctggacaggtcttatagctattaatagagagtgcttccttatatgggcatatctgttttcctgggctgctaattataactccattccctcttccacccaacagctcttcaagatttgaagataggtattacaatccccaagcctaggtgattatatagcccatatcacacgaatctcattcccttaaactcataaaaactaaagtcttagaaagtaccatactaagtactttctaagcattatctaatttaatttttcaaagaaccttttgaggtaggtatatgataacatccccattttacagataagaaaactgttagagaggataggcaacttgcccaagattctgaaactgcaaagtggtggatttgaatccagtcagtctggctttaggggctgctaagcataaccatgagtctctatttggcccacctcagcccaattctcccactccagcaaatccataatggggaggtgcctgtcctagtaggagaggatattctgggagacagtaacagccttggatttctctaactggaaggggagcccctccagttggggccttctctaggtccacccagggcatgtagaagataggcatggccaggaactctgagggctgttccttctctctgcttagactgcttggttcctgaaattttctgaccttgtggtatctgatgtggtttatcttcaggtagatgaacttgcttccaggtccagggcaagtttggggcctggggtgtggcttgctatcagggatctggtttgcctgatgttttctggggctgctgctcctagggagagggtattatcctgcctgcaacctccttttcctgcccctccttcctcagctgcaggctcaggccctccctcccaggagaaatccatttgtcttccctgggagggagtggacaagcagctgagaggtggcagggtagtaaaagccagtgttgaggctgctgctcctagcactgtgaatactcaaaatgcttccagcctggccttggactccctaaaatacccaggcagtgtttttttttgtttgtttgtttggttggtttttttttattttttattttttggtttgtcacctccctggctttgagtgcagttgggctgcagtggggcgccaagatctccatccccatactttgctgggggttggtggggggctttgcccagaggccagctcctaagcaaggcaggctggagctatttcctcttcctttccttctccataccccacccctggcagcagaggctgggaggagtgttcaaaggagtctggcccttctttgacagagggaggccttaccagctgctcctggtctctcattaaactctttcatggcctttgggtgggtatgggatgatggactaggctgcaggggagagggtgggcagagtgaactggatctcagaaggctgatggaggtttcaggtgcgactgataggtaggcctagtagggggttggtaggtaggtgaattcccccttggaatcatacctctcaaacggcccttcccctccccagccaggattggaggtggggggagggaggaggaaaagagaaccagggaagcacccctctccagtcctgagggtccccacccactcgctcagcgccctccctctctccctccctgcccaggagagagctgcgaggacaagagcccgccaggcccagcatccaagcgggtacgcacggcatacacgagcgcgcagctggtggaattggaaaaggaattccacttcaaccgctacttgtgccggccgcgccgcgtggagatggccaacctgctgaatctcacggaacgccagatcaagatctggttccagaaccggcgcatgaagtacaagaaggaccagaaggccaagggcatcctgcactcgccggctagccagtcccctgagcgcagcccaccgctcggcggcgccgctggccacgtggcctactccggccagctgccgccagtgcccggcctggcctacgacgcgccctcgccgcctgctttcgccaaatcacagcccaatatgtacggcctggccgcctacacggcgccactcagcagctgcctgccacaacagaagcgctacgcagcgccggagttcgagccccatcccatggcgagcaacggcggcggcttcgccagcgccaacttgcagggcagcccggtgtacgtgggcggcaacttcgtcgagtccatggcgcccgcgtccgggcctgtcttcaacctgggccacctctcgcacccgtcgtcggccagcgtggactacagttgcgccgcgcagattccaggcaaccaccaccatggaccttgcgaccctcatcccacctacacagatctctcggcccaccactcgtctcagggacgactgccggaggctcccaaactgacgcatctgtagcggccgccgccagcccgaactcgcggcaaaattacctctcttgctgtagtggtggggtagagggtggggcccgcggggcagttcgggaacccccttccccgctcttgccctgccgccgcctcccgggtctcaggcctccagcggcggaggcgcaggcgaccgggcctcccctccatgggcgtcctttgggtgactcgccataaatcagccgcaaggatccttccctgtaaatttgacagtgccacatactgcggaccaagggactccaatctggtaatggtgtcccaaaggtaagtctgagacccatcggcggcgcgccctgcagagggaccagagcttggagagtcttgggcctggcccgcgtctagcttagtttcagagaccttaatttatattctccttcctgtgccgtaaggattgcatcggactaaactatctgtatttattatttgaagcgagtcatttcgttccctgattatttatccttgtctgaatgtatttatgtgtatatttgtagatttatccagccgagcttaggaattcgcttccaggccgtgggggccacatttcacctccttagtccccctggtctgaactagttgagagagtagttttgaacagtcgtaaccgtggctggtgtttgtagttgacataaaggattaagaccgcaaattgtccttcatgggtagagtcaggaagcccggtggcgtggcacaacacactttggtcatttctcaaaaaccacagtcctcaccacagtttattgatttcaaattgtctggtactattggaacaaatatttagaataaaaaaatttcccagtcggaagtgtatctgtgttaatcatgcacacttgcaagcagatcactatgcctttatctcgcacaatccccatggaaggccccgaaacagactgacactttgaaaaaaatattttatttatttggagtctagtgcataaattggttctcgggatacttgattactttccagctattgaaattaggggagggggaaatgaggatgcaaacctaagaaggttctgggcgggatgatttgggcagggctttttgaaagcagcgcctgctttgctgtttttactgccttctttctagacacaatcgacttttacactggggagaccagagctcacttttctgcattaagtaacaaaaaataaactttgaaagaaaactgacaatcaaagaaaaaacacaagagaagttgtaagaagaattgagctatgaaaaagctaaggtgtagaaaaagaaaccatcatttggagacgcgtacctaagctttttctctaggaaatgctgtcatgaattcttcctttgtagtgatcattagttcatttctaaagaaaacaaacattccccaagatgtaaagtaataatatttcattaatgaaacataacaagtataaacaccttgtttactcctgtttcttatacaaaatgggcaaaaatgtcttcaaggatttataaccattttgtaaatattaatgtggcttctgctaggggtggacaacttcccggcttctatgggaggggccacttagaaaacgccttcagataaggttcaattcttttgtatttcagcaaagtcagcccacgcatctctatttggtttgacaaataatgcaactcctactacatccccgatgacacgaagtgaaattcctattgtgtggaaataatttaacttctaatcttctggtggaacaacaatcgtttctatttggatgtttgtatttcactaagtaatgatggctcaaaataatatttagtttccttgttcctttgtgctgtttttaaaatggcatgttagatttgggggtgggaggggatatccttttgctaaatttcactttatctgagcaggtttaaaatatatatgttgtagaagtgtatcaacagaataaatgacttcaatcgaaggcacattttacccactttcaaggcttaacattgttttctatgaaatttgcatccataggc

SEQ ID NO: 14849 - DNA, 9681 bp, Human; identical to SEQ ID NO: 12753

SEQ ID NO: 14850 - DNA, 4959 bp, Human; identical to SEQ ID NO: 12873

SEQ ID NO: 14851 - DNA, 7873 bp, Human; identical to SEQ ID NO: 12856

SEQ ID NO: 14852 - DNA, 9123 bp, Human
actcaactgcattggctctgggccgcctccagtgccctcttccccagcatctacctcccacccaggctgccacctgcccaccaccaggcctttgtccgacatcgcctggaggaggccttccgtgtggcccttgttgggcaccgacatcccctgcctgtcctggcctatgtccgcctcacacaccggagatctgggaggttcctgtcccaggtaagtggaagctgaggtctaggggtctgagtcaggaggtatggccctgttctaggaaggtcccaggagaagaccttgcctaggggttggtcctaatctaggcgttctcagcggaaggccctgtcctggagcatctgatgagggaggcatggctttgccctggaagatgttgaggggtagggaggcccagcctttggagtgctggcctgaggggagatattctgagtggaaggcctgagaagccactcagagactcgatacaaaggggccctacttgggctgggtgagtgtctcacacctataatcccagtactttgggagcctgagatggaaggattccttgaggccaagagttcgagaccagcctgggcaacatagtgagaccccaacctctaccaaaaaaacatttgagacagagtcttgctctgttgcccaggctggagtgcagtggcaccatctcagctcactgcggccttcacttcctggttctagtgatcctcccacctaagcctcctcccgaatagctggactacagatgcataccaccacacccagctaatttttatatttttgtagagatggggttttgtcatgttgcccaggctggtattgaactcctgggctcaagtgattctcccgcttttgcctcccaaagtgtgggattacaggtgtgagccactgtgcccagcctaaaaaattattagccaggtgttatgcacctgtagtcccagctgcttgggaggctgaggtgggaggattacttgatcccaggagttcaaggctgcagtgagctatgatcatgccactgcactccagcctggatgacagagtaaaaccccgcctctaaaaccaaaccaaactagagagtccctactgtagagttagaatcagattgtgacagtgaaccagaagagtttcttgaatgtggatgtgtgcccacatggatctggccagcccagcactggcttagcagctctctgcctccaggatgaccttgtgcagtccattggtgtgagtgcagcactaggggcagccggcgtggtgctctggggggacctgagcctctccagctctgaggtgatcattgcccctttgagcctgccatgtagcacatgctggggtcccagggtgggggacggccatgtcaagattatagagcaggcatattgacacatatcttcccttctcctcaggaggagtgctggcatctccatgactacctggtggacaccttgggcccctatgtgatcaatgtgaccagggcagcgatggcctgcagtcaccagcggtgccatggccacgggcgctgtgcccggcgagatccaggacagatggaagcctttctacacctgtggccagacggcagccttggagattggaagtccttcagctgccactgttactggggctgggctggccccacctgccaggagcccaggcctgggcctaaagaagcagtataaagccagggcccctgccactgcctcttcttttccctgctgccacttttccagtcctggaactactctgtcccactcttgctctattcagtttacagtcaaccctcccaagcacacaccccgcttcccttggaatccctgaggggtagaaggggccagaaaaaacgcttataaaaccagaggccctctgagatcatgtgagtcctccatggcaaggaagcagttccagggagagtcaggttccagctagttagggctgccagcctagggctttgtgcctacacctcactaagcccatggagaggtcacagatgggccgtgcacgggcagatgggccccaaaaaatcttggcgaaggtcggtaaagtgctaagctgttgtctgcactctttcatcataaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgcggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgagtggggtggggggcgcgggacagctgtatgagcggcgggcgggggtcctgctggatccccttggttgttctcgagggccctgggtggggaaccccctcggccagccccacgcagcttcccataactctaccgaggctggcacgtgccccagcagtcattggccacgtgcgtgcccaacttgagctcgctgcccactgcctgttgggagtccgcgctcccagcggtgacccggccagcccctccgggcctcagttgcctgctgggtggacaaactcaccggacagggcaggaagccagtcctcttgccaaaccctgatcctttcctggactggtcaaggaagttggcgggagtcctggcctgctccggtgaagagagggagggggctctgttgggaagctacctggttagggccttggcagcttggcaggcctgactccacaaggtagctgagtatcctggagcctgaggcagtcttgggactcgcttatcagcttagaccaggagcctatcttaatgcgttaaacacatatgtttactctgctgggatggggtgcctaccacgcacaaatttatttatttttattcttgagggggaagggaggagggccgggcacaggaaggaggaaaatacctaggcacaactttaaactggtcaccaccatggtgggttttgggtgggggacatctaatagggtgtggaacatgttcactgagtggtgtcagccccagacttaggactcagggaggcctggggggaagtgcttctgggtgagtcctgagaggatggagaagagagcaagttgtacaaagacctggcagctggagggaccccagcgcagtggagtgaatgagggaaggctgggctgctccggcaggtagaatagtaagataaaatgggagcaggctgggcgtggtggctcacacctgtaatcccagcactttgggaggccaaggcaggcagatcacctgaggccaggagttcgagaccagcctgaccaacatggagaaaccctatctactaaaaatacaaaattagctgggtgtggtgtcgtatgcctgtaatcccagctactcgggaggctgaggcaggagaatcactggaacccgggaggcagaggtcgcagtgagccgagatggcgtcattgcactccagcctgggcaacaagagcaaaactctgtctcaaaaaaaaaaaaaaaaaaaaaggtggcggggagcagaggccagtgcgcaggctggactttgtcctgcagatgaggggtgtgagtagttcttagaagtagggccagcctggtgatcacaccctgtccaaaactctgccacagcagccaaccttgccaatgtcagcccttggccctggacagaccccacacacaggagtgcaccagccctactgaactgacccttggctttggtttttcatctctgagagggacaccattctatcttttgggattatgaggtcgagtgaggtacccccagccatccctcatcagtagaggcaagttgagtgtcctattccaccttctccaggtgcccggagcagtgcccaagctgactcgggttccagtgacgatgaggcagccagtgaggcccgcagcaccgccagtgaatgccccagccttctcagcaccactgcagaggacagccttggtgagagcgggtggaagtttgacaggggcttggtgagggctccatgggctgaggacaagaagcggtgctgaccaggtggccttgcagggggggatgtcgtggatgagcagggccagcaggaagaccttgaggaaaagctgaaggagtatgtggactgtctcacagacaagaggtacccctggctgccagccaactcctacacccagctccaagtgtgatcaagggagggctggcccatatgaccccccttctcgacctcccccagtgccaagacccggcagggtgctcttgagagcctgcgcctggccctagcgtcccgcctactccccgacttcttgctggagcgccgcctcacgctagccgatgccctggaaaagtgcctcaagaaaggttggacctgggggtgtgtgggagacttaaactgggcagacactggcccttgctgcatgggctgactggaaagcatcccacagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccacgtgagtgtgcctgtgccccatgaaacccttcctgcaccttatccctcagcagagtggtgggttccccctatcttcagcctcctttactctgaggggagtgagctccagggctgggaacccaggttcacccgctgaccgtggcattgcattgcccttctcccaacagtgtgcttctgcccttggcctgggctgctacgtggctgccgctgacatccaggtgaggggtctttgggcacaggtggtagagcatctagggctgtaactctgcctctgagctcccctgcctctctgtgctcctaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggtaggggtggctgtccactgggagggggaggggatctcaaagaggcccccaagccacacatatagctcagcctgccccttccctaggcagctgccccggctgccccagctcttgtccagtgaaagtgtgaacctgcggatcgctgccggtgaaaccattgcactgctctttgagcttgcccgggaccttgaggtgcgagggacaaggatggggggtgcttggtgacaccacctgcccatcacaggctggatgcagggggtgccacacaaaacagaacagctttaggtcattatgcagaggaggtggccccaaaacagatttatctcctagatgtcatgatgggtgccctcagcagtggtgtcctggcctgacagaggccaaggaggggtcaaaggggccaggcagagaagagagggtctctcagtgaaaggaggggtttgggcagtgccctgttcagagccagcagagctcaagcatctaccacacaccctccaatgctcccattgcaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggaggtgtgtgtgagaacatatgtgtcctagcaagggtgcacccccaggcatagcagccaagcccagttgtgttggcacctctaccctgcagggcggtgaatgcgaagaagagatagtgcgcttcggctttgaggtgctctacatggacagctgggctcggcaccggatctacgctgccttcaaggaagtgctgggttcgggcatgcaccaccacctccaggtgcggggacggacagggaggggacatctggtgtggttgcttcagtctggcctgagctcactgccctctgccccccagaacaatgagctactccgtgacatctttggcctgggccctgtgctgttgctggatgccactgccctgaaggcctgcaaggttccacgctttgagaaggtttgcacccttgggcacctttctcttccccctattcccatttcctggaggcctggaattctgtagaggccggaagaggacccccagccctttcccttcccagctccccagggtgtcactctctgtccccactctagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtcttaacccctgggtatttttctgttctccctccccatctactatcccaggcttgggcccaactggtcttccacgatgtcacctttgccctccaaggcagtcttccccaggtggtgcctctccccctactcagagcccagcctgtctttaagagctgaggctggaccctcactgggagccctggcagagtttgggtgattgctatgggggcagctatttctagacttcagaacctgccatctggggtggccagagagtgttgacaggccacaggaggagccaggaggctggtgccccttcccctgaccttgggccacccaaagcgaggctttggcaccagaggcttggctaggcctggcttgaagagatcaggagagggaggcagccattaagttaacaacaggttcttgtacaaaaatctcaccaaggaaatagtgtagatgtggcagccagcagtagggaaggagagacctgcccatagccactttattcccccaccaacacacacccccaggccccagatccaaatggcatctcagctgggtgcttgggcctcactggagttgagcctccgaagctggctgaggctggccaagcggagtttgagtagtgtctcctcctgcgtgcggagcgtgtgtgccaggatgcgcagggattcactctgcagcactgtgaatgggaagtgggggatcatcagaccatgtgccaccccgtgacccctgcagacccagcccaggaccaggggcagccacgggcctcccgccccatccttcactgctgcagcatctgcagttactccttccagctgcacagaagggcctcccagtccccactgccttgctttccattcctactagcaccctatgcgtccataccgctcaggtagacagccaggagtgcgagcactaggcaagtgagcaccagcagcgcgagcagcagcaggaaccctcctcgtctgtacacagggctgcagccagcctgggcacacagtgacggcggcaaaacgcccagcagctcatcccacggtcgtgcctcttcagttagataggggcgcagtgtgcctgctgggtggatgggacattgggagggtggtgggtgcacctgctttcgtcccctcccccagcacatcatccaccccactgtccccactcacctccactatgtaggtcgctgatggactccacctggtgcaggcatacctcatgcacgtggttgggggccaatggccccctgctcctctggctgggcatcattggcgccacggagtctgcaggggcagcgcaggctgatttagccagtggtgggtcaacccccttccttctaccaggtggcttcaggcagcaaggacttgcggatgatagggatagtgggacatttggttccaaatcccctaaaactgactcaggaattacccttgatttggatccaggatgatcccagacccttacaggcttattctgtatacaggagcaacaggtacatttgatttgtttccttccaagcaccccagggactcactcaggcattcctctgcctgcttatttctagcagtttatcagccttgaatgctaaacctgcagcaaatggaattcagtcctgcctcttttgtcagttctccctgcagacccaatgcctggcatcttctggtcagaaagccctattgtagccactctggtgcctttccctcctggccttggttctgtgtttgttaacatactcagtgtgactctgctgtacatgtgtgaaccctgctgttttcattcaacatttactgttggggagacccttctttgttatactgttgcacatgcctctgaggtctctcccttcacacatctccctgaggctgcctgggcatctaggttgtttgcagtccccgccccccttttttttttgagacggagtttcgctcttgttgcccaggctggagcgcaatggcgcga

SEQ ID NO: 14853 - DNA, 87690 bp, Human
gtcattcttaaagaagtggtcctctaggagctgtttcttattcagattggaatggattatcacagtatttccttttttgtgcctcttaactcttggcaaaggtttcttagccttggacttagttctgtcaatacctgggctgtgagctagtttctgcgagcaagggaggagttggggtggcctgaaagagtgtgaaaaggagaggaggactagtagtgcagtgatattgtaaaacagagccctttaaacattaaatgtgaagatagaaaaaaaaaaaaacctcccctttatgacaaagtgcaaaggaaattgcataaaaaagaaaacagacagcagggtattcagccaaattatatggtaaaatctttgcgatcgccataaagtgcgtttgctttgaagtgcacgcatgattcagtgaagggctcatgttagcaattagaaatcggttatttgggtccctgatttcatttgcgccgagagaggcaacttttaagggtgacgataaatctccctgagcttaaaaggcagagagggccaaagtgtgaactttttacttcagcaacggaagcgagaaatcagtgattcattaaagaggagacctccttggaagctggcagcagaggaggaaaggacactaattatgtcttccttttctgtgctcgttctgaccagtttataacctgctgctttggacggtttaaaatcctcagcatcttctgctttctcccagccctctcctcttctgggagtgagaaggggggaaaagtcagccaagcaccaggctccaggtggctctcaagtacttcactgccaaaagaaatgggggtggggggaggagatcctacgctggaaagcaagtgagaaaggggctccccagaagggattggttcaggctggaagacagcaaaattcggaaagcgggaagataccgtcagcgccgtggcccgcgctgcaagcataggacgctttagcagcgaattagacagagctagaggcgccggcggaggctgcggccgcaacagccgcggcgaggaagggacctggcagcccccgagctcggtgcaaaggcatcgcgctctctcctcgctcccctgctcccccacccccttctctgcccctttcaccctccctctccctggcgttcccagcagcctagggtttcagatgtcccaccgccggttgaccccctcccccctcttctccacccctgcaaatgaggtttgaccagcagaggcagagcccacctctggcttagaatcactgacatttagactccaggcttcaacctgtttacaagcggactttccaaaggaagggggtgggagatagggccatacaaaacaccagccgccgtcccccaaaacaaaaagtgactttcggcagccttcaaatcggcaggcaccactaaaaacagaaaggaagagagggaagaaaacaacggcgactgggcagctgcctccacttctgacaactccaaagggatatacttgtagaagtggctcgcaggctggggctccgcagagagagaccagaaggtgccaaccgcagaggggtgcagatatctccccctattccccaccccacctcccttgggttttgttcaccgtgctgtcatctgtttttcagacctttttggcatctaacatggtgaagaaaggagtaaagaagagaacaaagtaactcctgggggagcgaagagcgctggtgaccaacaccaccaacgccaccaccagctcctgctgctgcggccacccacgtccaccatttaccgggaggctccagaggcgtaggcagcggatccgagaaaggagcgaggggagtcagccggcttttccgaggagttatggatgttggtgcattcacttctggccagatccgcgcccagagggagctaaccagcagccaccacctcgagctctctccttgccttgcatcgggtcttacccttccagtatgttccttctgatgagacaatttccagtgccgagagtttcagtacaatgtggaaatggatactgacacattgtgcctcagcctttccccacctgcccggctgctgctgctgctgctttttgttgctgttcttggtgtcttccgtccctgtcacctgccaagcccttggtcaggacatggtgtcaccagaggccaccaactcttcttcctcctccttctcctctccttccagcgcgggaaggcatgtgcggagctacaatcaccttcaaggagatgtccgctggagaaagctattctctttcaccaagtactttctcaagattgagaagaacgggaaggtcagcgggaccaagaaggagaactgcccgtacagtaagtaacaaatgcatgctcccctccttccaattatccacccccagcccacacgggggggaaaaatctgttccagatgtggccagctaaatatttacgtccccaacccctgtaaaatgattaagtggaatactttcacactaattcaccccccaacccccgtgtatacattgtgctgccgcatcccctcccctaagcgcgctcccttcacatcccccaccccttgccgctctacccaccccttccctccagcctgtcactagccggaccacgcagggcgctcaagagagttgttgcagtgcaaagatgcccctttctctctccaccgcctttcccacctcatccaaagagcaatttttccttccttctggaaatggctcaagtaaacacattttgtttcttttccctggcaatcttgttaagagttttgggacaggctcctcaagctgaaaataattatccgctgtcaattataggggctttgtgggaactttatttaagaaagaaaagtcaattccactctctccccacccccatccctttaccccactacctctagatatgagcgaaaagcatttttctggttttgatttttgttttgttttgttttgttttgggtcccttatgttagtttgagtgattgcagtccatgaagttagcttttcaggcaccaccgctgctatttgtcttctgcctgccttccctcttggtaacatgatgctcatgtctgcattgtcaatagcgtatgcactgctttgtggtgtcctgttgtactgtttcttctgaaacctctcatattgcagagccatactactacagcattgtaaacatctgggactggattcacacagacctcacacaaatttcattgtcattcttttattttcaaagtaaaagtcataagtctgtttccatggctatagtttatcccacagtgtgacattttctcctcagcgtaaattatgcctgggatccctacattttggtcttgccttttccctctctctttccttctttctctctttcccttctttctttcttgcaggggtgtgggctggttgggggaagagaactagaagaagaggggtggatattgtgtctcttcttgaatcaacccagcaaacccagattactctgttgacttcctttctcagatactttcaagtggtgagacttattcatccactattgattgttatgtgaaaggaacccaaggctctgtaatggcacactgaagacagtagacaatgatgtttaaacatctttagtgaccatttggcattatctcaatggtaaattccaagtcacctttaaaggggacatttttgtgttagttgttcaggaattctaagcatagattgtcttgtcagttaacttaaatacgtcagtcaaacatttcaagattccttggtttagaaagtaccaggtactaatgggaatgacagttgaccagaatttagcattttatttttgaatacaaatttacaagaattaagaatttagttttcttctgtggggatgcacacacattcaacattaacttctgtttctcctcagccactggttctatttactaaaattcacaatatgtttataagtaataaaaatatgtgtagaggtgcttttaaagtgtttcattttatgtttcatactaaagatattaagtaccacattatctgattcaaagaaagtagctgaaataatgtcataatgatgacaattatttttgcttaaaaatcatttgttacccgaattcattagatcctatgtatataacctttaaggtttttcgattaaaaatttaaaaactttatttacttctaaaataaaatagttgtggtgtcattcagttagcaggatggggaagaagctatccaaacattgggctggacagagtgagctgggaattaacaacaacaacaaaaaattctgatggactcatttcttatttttcatggagaaaactcaaaagaatatgataaagtttcagagtgttatccttgagcaaacatttttctttttaaaaaatgtttgtgctatactttaaatgtctttatgatatgacttaaggtcaaatctgctctgttttagtttacacaacctaaattgctattttctagaataataatcacgtgtgattagctgcagagtaaaatgatttccacagtacacactgaatttcatctttacaataagaactatctgcaaagaagaaaagtatacaatatatattgtataaaaggggtgtagaaaagttccatcctaactgtccaaaatatactaatattttattttctctgtgataacatatattacttgttataatgacaagctaaatatcttatatggtaatgcaatcttaatcaacggttaacagtgaaaggggaggggttcactctgctaaatattgtcaaaccataaataatttaggctttccaagaacatctgtgtcaaaacatagcaagtgaaaattagagattgaaaaagccttaatttcacatgtggccaggtaatctaaatgctgctacgatttccagctggactgattcagctgaactacatggtatcattaagatattgtctaaacgttgcataataacatgtgaacaaacttttaccatgcctacagggtagccagccagctgtccaccaaatggtagcttgttaaatactaggatctctaacctctgaagagtgtcaattccttttccaaaaaccacatttcagtaacattttcctaaacaagttattaattattctcaatacacaaagctgttcttttgaggtttgcttatttgaagattaattttctttgttacttttgaccctagtattattgctgctaaaatacagtaacagcttatctaagaggttatatgtttttgttgtcctgggtaattaaacaactgttttctggctttttgccagcagaatgctaacaaaagggaagtaagacaatcattcataagtattgcaaaatcatttttaacttctactttcaaagctagttcccagaaattcgatggttctaaaaagactacatgtgttaacaaagctcttctctatatgggtgattattataatttttgagggtggggggctatactttttgtttgcttctttgccatgatatgagagtagaataaagagagcagagatgaattatgtttctcctgctagaagtctgagaaagcttgaataatttagaatagctgtggtgtatctgtcactagatatgtgtaggctcatttaggttttgttttatcattctttacatctagagctttgcccttgaaaccttaccactcggctttagttctgacctcttagaaaggctggatacagctgttaggtatccttgcaactgggaccagttgacttatttctggatgtgagtaaaacagctgtgagcttctcccatggttgtcatttgtagaaaagagggatctagtgaaaggaaaatgtaccctaaacttgagacaattaagaatagatattccaaaaagggaaactcacaaaaaaggctcctgggcctttctgggaaagaagaatgggaggcaatagagaaatcaatatgtaaagagtatgtagtataggctttatctctttaaatacacacttcatttaatagtcataatagtcctacaactatcaacatttttcaaatttgaaaactcatactgaaaaaagtaaattgtccaaggtcattcaactagacatgggcagaaccaggattcaagccccagcctattggttgtatctctcctttcttattgtacctttctgctacttccaacattaatatcaatttattagaatttgacacctcaaatctctaaaaaacaaattatccaaatctttacttgcttcttgctgtgaacacccgcagttctttagaattaaattggaacagaaataaaatgacaattgcagaaaaacaaatacattaaacgtgtcattgcaggtggccacatgatatcagacaaggttagtgtattctctaggtaaactctctcttttgatatttgggaatataattgcttatggatacacacaaaatacacatacatcaatctcactcatgttaacagaggtcattaggaatacatgactatttaagaaaaatccatgaatgtcattttatatagtaattgtttacagctgagggccaaatgtttaattgttcccatgtgtaataaaataatttgattgtaaatacctgtgataaattggactgttgcagaaacttctgatatatgactctaaaaagggcgacatcttagagacttaagccatacatattaagaaaattttaaaataaacctgcaaatcaaaaagacactttaccatataaaatgatagattattatctgggattattactttttaaccaggactagagcttattgtaggaagctaaatgaagtgagaaaaaaataattgttgaggaaaataggaactcagaagtgatcttctaataacgacacaagagttttctgtgaagaaaaacaatttatggcttccactggtatcttatttcagttgtggttgtttctagaatttggttgcataatttataaccggcagcatttaatcacgagcattgaggatttatgaaggtggaagacactgtatttaatgtttacatgacattgtcctgttacctttactgcattcctaccatatggaccctccactttgatggatttatcataaatctattaaaaatgcacaattcaagagagtttcctcttcataaacctgatttataacctcctacgaggagaaacctaaggaaacagttgtcaggaatcagatgcccgtattggagcatgagaattcagagacaccaaattctaggtcttggatatttcagtaacctattacctaaaggtgtgaatgactctttaaaagcagttgttttcaaaatgatgtttaggcacagaattttaacaaaagaaaaagaagtagaagaagcgtgtcttataggatcaaataaactccactgtcttcatagtttcttctacatttatgctatccagtttagagtgaaaagctttattccagtgcatttctttagaatttaaagaactgatagtagaacatgaatgaacactttaaatttctatacaattactttaatgtccagaagcaaaccccatttattatccaaatgtctaactttccacaagccaaaatgttgaaaaaaagttgacagctcatttgaaatggaactaatgttcctcccatttatgagctgcctgtgaataactacatctttcctaagccttaatgtctgtatgcttatctgacattgtagtgcaaatgatatttctttattatgcttcagaaagaagagtaatatatgtgtattagttcaaagtgattttaatctatcttaacattaattctgtgaactttgcaatgaagagtaattcagatgacatttttagtattactgttccaacatctgtcaacatttatagttgatgtttgcttaatataagtaaaatattagaattttccttccagaaattataaatctattttattttacagtaagatggaatatacaattcatgtttatgtaattttaatacagttttatcacaatatatacaagtaatcaacttcattttgtctcaagtcatttatgcagaaggatttaaatctttcatggtatattgcaatgatctaagataatttacatttgacatttgaccaagggtgtttattactttgtttcacagatttaaaacattattttgtaatcggcactctttcttctcagtgcatgttacctttatctgtgtcagtcagtcagtacaacaaagaatagcttagaaatgtacttttaaaatttgcgaaaggaaatatacctgcatcttggaaagccactagtgacactctgatactgaattaatgaatacaaaatgttgatgttttacagaatcagtttaaaacccagtacttaatttgtatagattttacacaaatagaaagtttcaagacatctaaaagggagccaggtcacccacaaaataatgaccttaaaggctcccttccttttaaatcagatcaattgtgttctttctttgaacgctgtgttctaattggcacaatacatcaaagaagacactcagagtagattcccatgtaaggtggacaactggacagtgactttttactgccgctaacacgtgcatccaattactatctgatagattcatagtgctggcagtaaagcattgccttattttatagttcacctaataattcttcaacctaaacctgtccacctttacctatacccattctgtcagtatgtgcattattaatgaataattttcaaagttttggcatgcttcctgcaaagaatgatgtcattgagctcttaatgaatcatctaaccctaatagaaggcaaagtattgattaacttgatataccccaaatttcaaagaattgtcaactaaacctaataattgcaccacaactagaacctaattctgaatagggtgggttaaattccatctaattctgaatagtgtgggattgctgcaagatttagaacttttttaaaaaggtatttttaatgtttttctgtaattattattacttttcttcaaggaccttgtgttaacatgctttactgataagcagacatgttatttcatccttaaccttttttgctcctgtgttgaggacaacttgacatgttcatagagtctttacaattcaaggctcattgacttctttctaatagctttgttttgagttagtctgtgacaaccctgcttctgagccattgtaaatccctaatagtttatcgtcccttcctcactccattattttcaccttcttggttttgtgtgtgtttttttttttattacttttatctggtttctgaactggctacatacctttaagcccagggaaagtcattcattagtattacttggcacccaaggtgacattcagggccagaggcctagacattttcagatgcgtagcatctaaagctgatagttttgtttttattttgcataaaaatcttcaatggtgtaaattcaatatactccatcaggaccgtcttctcatttcgattctgcagtgaattccttcttatcccagcattccaggtcaatttcttttaagctctgctgtaagtgaagtggacaaaccactgataagcccccttcagagtgctgattatcccattactagatcatcattctgcatttttcctccaagttaaatttttgctcccaataactcttcctgcttttcctattttcttttaaattatttgcatacataacacttactagctactttgccatttttctcacatttttgcctttgtctgggctaccatgaaagaaagaaagtgaagatgattttgaagacagggtctcactcatgatcacagcttactgtagcctcaacctgctgggctcaggcgatcctcccaagcagttggaactgcaggcatgtaccaccctgcctggataatttgctgatttttgtttgttcgttttgtagagacagggtctcactatgttgcccaggcttgtctcaaattcctgggctcaagcaatcctccagcctcggccacccaaagggctgggattacgggtgtgagccaccatacccagcctgaacacttatatttttctactttagttttcatttattttaaaaaagatgaatgctgatttggaggtctttgatattcccaacttccagaatggcacttagattatcaagcttctctgtgtacccctgtcaaatatatgtggcttttaaaaataaaacctaggttctcaataaaactttttaaatcaggaaacaatgtaaaataggtatatgtatgtcaggtgaaacaaatatagaaatacgtatgcctttactaggaatttttgaaacaccaacaggagttagaatctgaattaattccataagtgttttcatatacttctaagaattttttggcactgattgatgaattagatttaagtctatcatatgcagaatctgactattgacatatgttaaatttatgttttaataataataaaagtcaagcttgtttttacaattgtttccaaattttaagtaactttaatttactgatagaattattaaaagaagaattaatattctgtaacatggggtaaatggtaacatatggacactgatttacatactattgatagtctaaagtaagatacctttataatggtattcatagcagtaattaccagattttgggtgtcattttttgggaatatctctgcagaaggatatgattccacaagtattaaagaaaagtgctagtgatgttaatcacattatagtataaaaacttgatgaacaaaaatagtgttttagagctcaaatatgctgacgtccaggaagcaagagagacggtaaagatcacataatgaaattttttagaagccagagggaaaagtagaaaaagagaagaggccctagagtgtttagacacatactgtgaaaggaggaggagatgctttgctggagtgatgaagacaagggttttgaactctcaggaaagagatcaagctaatgagtagcactgcgaaagggctgacatgacaagaaaggtgtgagggaaatataacccaagccctggcattcaactggatgttaaattaactgaaatgagaacctatgatctaagagaagtcccacagaagtcatcgcagccaggctatcaaagtaaggaaagctaagtcccagttcctgctaaagaggaggtatgatagagtgattaaaagtatgggctttgattcaaagggataaaaagtatagtcccggagtgaaagcaggctttgaagccgcagacctgtaggcaaactgcgaggtaagagttgataactttgggcaagttgtcatcagtaaaacaaggatattaacaatacctacctttttactacatggtaaagatgaaatgagatcgtatattcattcattgattcattcatctgaaatttgagtgcttgctttgtgtcagatagtgtgtgaggcacgaataaatgcattgttgaaaaaagttggtctttctgctctcatagagcttacactctccacagataatgtcaaaaacgttaaccaagaggtgatatgatgaaaaattgaagtgagtgttatcaatgacacaagtacagtgttttaatagaaaacaactgggaactaccccaaagagcactgctagagaagccttttgaagaggtgagaagggaactaccccaaagagcactgctagagaagccttttgaagaggtgagaagggaactgcaaagggagagtttggtgcctcattcaagaagtacagagaaggcacattgaggctggatgtggcagaagtttgaaatctgaattgacacacacacagcttaatggtgcctgtcacatcataagccttaatcaaaaggatactatatgaagaaaaagtaaatacgatgcttcctcttatttcaaggggaaacatcaggaaagcaacaattatattattcgatgaagtggaaattaacaatgctggaattgaggaaagaggcaggaaggagaaatatacttggtttttgtttaaaaagggaaatatcggccaggcgcagtggctgaccctgtaatcccagcacttttggaggccgaggagggcagatcatgaggtcaggagatcaagaccatcctggctaacacggtgaaaccccgtctctactaaaaatacaaaaaattagccgggcgcggtggcgggcgcctgtggtcccagctactggggaggctgaggcaggagaatggtgtgaacccgggaggcagagcttgcactgagccgagattgtgccacagcactccagcctgggcgacagagcgagactctgtctcaaaatagaactacctgaaatttgatttggaattgtaatattcatactgttctgaagttttggggaaaaagttagaggcctggttctttaagaaattggtagaagaaacagattgagcacttctaatccaaaattctcaaatccaaaatgctccaaagtccaaaactttttgagtgccaacatgatgccacaagtagaaaattccaaacctgtcctcatataacagatcacagtccaaacacaggggcacagtttattcagcatccccaaggggaaaaaagaccctcccatcccccttcagctgctgttgcttaacagctgatacaggtattctggtgatgctactgtgctgcctagttacccccaacacatgattttttcactgtaatagtggtatgtcatgttgtttactcttaagtacttatgtatgaataagtgtaagaaaatgattgcttatcagtagcatttaaattcagagtcaggaatgatggtgatgccaaacaaccacagattacctacatcaacggctaagatagtgacatctttgctttctgatggttcaatgtatatggactttgtttcatgaacaaaatgatttaaaatattttaaaaaattacttccaggctgtgtgtatgtaaaccacaaattagttttgtgtttagacttgggtcccatccccaagatatcacattatgtatatgcaaatatttcaaaaactgaaaattccaaaatctgaaacctttctgatcccaagcatttcagataaaggatactcaacctgtatttgaaaactgaaggtaacttgaggagagaacaaggtgcttaaaataaagaatagaagatgaatattttcaaggacacaagctgtaaaaggttaaaagaaagaaaaaaagaatagcgaaataggtaaccgtggagatttgatgactatagaataaaaggcaacaaagaaaagtaattcttaatttttaaatatttcagaataagtcttatatttcaacttacagtttcgagacagcattatcacagatacttagttcttattaaacttggtagttgttttttgtttctcatcctattactgtgacctttttggctcatacccttaaagcatttgtagtctagaagtagaaagaggagatcatcacagggagttggaagagcatataaggcagtttctactcaatgccaagaagcagggcagaatttaagtaaacagcagtctctaactgagggagagatgcatgacatcaggaggtcacactgaggataagggactccagctagacagagataaaacaagagaaggaagaatattctaaacgaaggcacataagtgtgtgggtgcagagtcaaacatgaagttttcaggaaatcacagggaggaaacaaagtttgcatgcaggtgggcatcttctgacagacaaagcaaagtacagtagaaggtggtatcatgtgagagggaagtatgtaaatgtatccttacatttgtggatctaaactttctggcaaaatattacattgacatgatttttatttaaacttgccctttacttttttttttcatttttactttttgaagtaaaaaaagaaagaaagtggaagaatatttcaaaagagtattatctatattataattgacaatctaaatatagtaagtagcaagaaattgtagcttaatcaaaagaaaaaagaactaattttatactagggacatggaaaagaagagttcttctgctcttcactaaaatgacattattcttcatatttctgatttgccaaatgatcattattttacaatttaaaatacttggaacttcaaaagttcttaatatgtatatttcactgtgaagaggttttgtaatttccagcaaatccccaaaaggaacacctgaagcatcagtatttcttgctctagttgtgggttttttgtttttttttttttttttttttttttggcatttgtattctaacttgtcttagatttacttggtttagataatcagaaaaagaaacaaagtatgctaaacttctttttctggaaaaggagtacatgtaagtgttttttaaacaaactaggagaaacatacagacagcatatatacgactacacccccctactgacactatgagctcttgagtcagacttcttggtgtagaatctgggttatttataaaacttcatagttgtgtgatcgtagccaagttactccctgggtcttggtctctgcatcttttaagtttagataaaccaacctcaccactgttggaagaatgagtcataaatttacaaatgatactataaatgtaaagttgtattaaatataggacctaacaccatgtaagagtttgacaatgttagttctcattactcttttatgccatgactgcttgtgttgttactaattattccattatgtgaaaaattccctaaatcattgaataataaaaacttcagcagattaatgctttcatcaattgattctcaaaaaaattttgtaatatgggtaagatcatcgttgttatacccatactatgtttagatgagaaaattaggcctaaaagttattgtgccagactgacattatagagttaacataattgaggataaaacctaggccagtcttagtgatggtgatcttctatctttgcttgcctgggacagtcccagtaaatgtctcttgttctggcattttattattaacacctgttcagtctcagtgtactatcacaagaccatcctagtcttaatcagtgtggtctatgtaaggcacaaatccacacaagctagttccctcttagatactactacattccatcacatcccatgtcatatgtcatataatatcatgtaatctctatattccttcacatgtcatataagaccctcatgatttactccctaccaactccctggcctcgtttgttactacagtgcccattatagctattttatgttgatttcagttctagaacctgccttgtcccttcctgttcagccttgccagacactgctaggtcggcctggaatgatgtccctgccctctttcccagctcttcttcttttcaaatttcacttagatgtcatctctgggaaaccttcctgctgtcctctcaaaacctgtgcttccaaaaaccatatacctagcattataatgcaataccacacttgattagttgactgtttacccatctagtttcctcataaacagaaaacttgttgagagtgagaaccacacctcactgacttttacatgcatgcacttaagatagtatttggcatataataagtcctctttctatatattattaggtaaataactgcttttaaccatatgatcttggtcaacttacttagactctcaaagttcagtcacctggtctggaaaggtgattaatatgctacctacctaaaatgatggttgaagtaaattagctcttaaaatttcacttagttctaagttctacaattctgagaacctgaaaaataagttagtagggctatcattatttaagagactgttaagtacttaaattcattaaaatttctgaattaaaaaaaatgtgtaatcatgaagtgaatcatttttcatgtttctctacttttcctaaggttactactgataacattcagtggggattaaaaattactttatcccctttaaaattcctgctgactatgagacagttatttctagtttcagagttgtgtttatggattcttggataatttggtggttattaaaaaatgagcaattcttagtaattattttagagaggaagaataaagtgctgtaaagagtgggagtaaagggagtggtcttgtctgtgtcaaaacatttactgtggatcttaagcaggtcatttactttatcttggcctcagagacttaatctataatatgagtgtattgaactacattattattaaaatattttagtttagtatatttatttcacagactaaggaccagattcctggagtgtacctatattaggaaataaagctatattatgctgaataatgagcacccaaagacatcaggttctaatcctggaacctgtgaatgttactgtatttgtaaagtttttgcaaatgtgatcaagttaaggatcttgaaatgaggagattattgtcattgtccaggtaggcccttaatgccatcacaagtgcccttataagagagacacaaggagattagacatacgtagaagcacagaaggcagaaggcattttgaaaatggaaacagaaagatttaaagatacaatgttgttgtctttgaagatggacaaaggagtcatgagccaaggagactggaagaggaaaggaacagattgtctccctagaacctacagaggagtttggccctgctgacaccttgctctaggcccagaaaaattgatattggatttctagtccccagaacattgagagaatagatttatattagtctaagacaccaactttgtggtaatttgttgcagaagccataagaaaccaatacagatatggtacttagagcagggtcctgctgtaactcaacctaaaaatgtgaaagtggcttgggacgtggacagtggacataagctggatggattttgaagcacatgataaagaaacctggatttctttaaacagacttctgttagaaatatgaggataaaaggtgctaaggtgaggatttaggaggaggtgtgaggcacagtagagaatgcctacctcatttagagaatacatataacatcataaacagaaagctggtggacatattaatattaacagtgctttttttgagggctcagaaggaaattaagaatatgttattgaaaactagaagaaaggcaatcctttcagctacagaaatgtagctgaactgtgttctacgttgtatgaaaaacagaacgtgtaagtgatgaatttggatatttagctgaggaaatttccaagcaaagtgttgaaggatcagcctggtttcttcttcctgtttatagtaaaatgcaaaaagaaggagataaagtgaaaaaagaactgttaagcagaatcaaaatagcacttgatgatttgggaaattctcagcctatccagattgcaaaagatgctaagttgggagattcactgttaggaaagcatgctctgaagagaaggctaagggtacgactagacaaccttatgatagtgctgaagaaatgaaacatgtgatggatggattccctcagccacctcagcagaagtcaggaatagagatgaggttacctaggaaagatttgtagagaaccctctcatggcatgaatccctgtgacatacatgggaggaccacagagtttttgagaatgttgtatcagcagaaacactgccagctggaactaaaatagacaaagacagagcaagttgaaggaaggctgtcagactcccaaaattctacaggcaagttgataaaactattcagctgcaaacacatgatagctttaaagaaaaaggatcaccatgaatgcagagccttgggtacaaaggaagtgcagaggcatagaagcagagactctagccatgtgccctgaggcaggaccctcaagtcacagaggctgattcccaggccttgaaacctagtggagtttaccctgctggattttgaaattgcttgggaccagtgacttctttcttctttacatttttctccttttggaataggaatgtttataactgttatactatgcttgttctaccattgcattttaggaactgataactttttttctagttttatggactcagtaatggagaataattttgcccaggatagatcatacccagagtcttatccatatctgaattccattatttacattacacaatttgagatttttgagctgctgttacttaaatgagattttgggctttaatttaggtaggatacagaaggctgaataatggccacccaaaaatatcaggctgtaatccctggaatgtgtgactattaccttatatggtaaagttttgcagatgtgattaaattaaggattttgagatgaggagattatcctggattattcaagtgggcctcatataccatgacaaatgtccttataagagagaagcagagggagattagatgtacacacagaaggcagaagatgatttgaggatggaagcagagatttgaagatgctacactgttggctttcaacatagtggtaaggccatgagccaaggaatgtggccaaggaatgtggcaccagaagctgaaagaggcaggcaatggacgctgtcccctggagagcttctagatggaatacagccctgccaacaccttaatttcagccgagggaaacagatattagagttctggcctccagaactgtgagagaataaatttccgttgctttaagccatcaactttgtagtaatttgttatatcggccctagaaaagtaatacaggaatctaagacaactttgtgcagcccaaattaaggataatttgacaaaaacaaagcactatcttgtggtagatagtactaagcatggactcaaatagatgtaagttctaacctcttaacgaatggtgtgagtcagaaatgtctctaaacttttgttttctcattccgtctatgaggattaaatgaaataatctatgaaaagtatctaggaaagtatcaggcttataatggaacctcaaattttagttgaatctaaagggataacaaatttagttgactatatgcttttaaaacgttattttaaaatatagtttatttgcttacaataccttgactgctaggcactacaaaagcaaagggctttggttgtttgatacagaacctatccataaaagtagcctgtttttcctttgggcgatacattcaatctgacttgattaaagggttcccattaacctggcccaaaagccccttttctgaagataggcgctaaaccaatgggaacctttcctatttaaagaaacccctttatatttaaaggtgagagaagaccaatttttaaaaatgggtaattagtgttgccttagttcattttctgttgcttgtaagagactacctgaaactgggcaatttataagaaacaaagtttgtttcttatacttctgaagtctgagaagtccaaagtcatggagccgcatctgttgagggtattcttgctgctgtggactttctgcagggcaccgtggcagcagagaacatcacacatcaaaggggctgagtgtggtagttcaggttcctctttctcttcttataaagccgccagttctactcccattataatccattaatcaattaatccatcaatgaattaatccaatcatgagggcagagcattcatgaaccaatcaccttttggttcctggtgccatactggggattaaatttcaaaatgaattttggaggggacaaatattcaaaccatagcaaatgtaattaaatttcagtaactggtacattctgaaggatttttcaacatttatgttgacattactgtgtatttactctttgaaactaacatcttttatcatctatcttctctcactatgtgtagatttcctttaacatcctacctttaagcctctcacatctcaaaatgtttccataatacatagtacaactctcctaaaatttattaacatctttgtttacatcacttgaatttttatggcttggaaaaaaataagattctaaaactggcatttcctcttacagaaaatttgtttctctcatagtaataggggctatgaagttagagacagcagacaaatgttttgttgtcaagtcttagggtaatggagcttttatggagctgaggctgactgaaacagctgctaatttagagtgttatggagcttacttctttttctcctcaacactctttgtctactgagtgctgggactatagtaatttgagaagagagatgatggttgtgatattgggaaaggtggtgcaattaggaatggggctccagtgcaagggaacgagataagaaatgtgacccaggattaccttgagcacaaagagcacatgaggatcaattctaccaaccccagtgccattcaaggatttttacttatattatctgagactaggcaaataaatgcatatgttcattccaatccccaggaggtttctgaaactttcttagagatagaatgcccacagataagagttgtgcattctgatttgagatccataccctacctatttctctttataagaagattctttctaatgagcatttagaaaacaggcttggagaaggagaggaaagccagattggaaataggtagtaataacaggcagtaatagatatttctcaaacttgggtctatggaccacatgctcagaatgaactagtgtgcttgctcaaaatgaaaattataaaagtctcattctagatgcactgcacacagttggcggtggaggaggggggcaaatatgttcacacatagaaatctgaactttaataatctctaaaaaacaataaaattaagagtaacactaaattaagtgtagaggtgatgggaggaaaggacaaaggtcttttgagcttgagataatctgaaaaatttggcagaatgaatttcatacacatattccaggtttgcacattttgtatttttgcacatattctggaaagggagaaagttccagtatattctataaaaagggggtaatttttaaagtaagttaaaacacatgcttaagtttaaatgctccctgtttggtgaaagagattttctgataaatctgagattaggtcagttttcagctcactcttgtaagtgtctgagtgcgtgtgtgctaaagctggagggagggaagagaagatatgatattcatcaaaagctggctgttttctcaccatgtcagagtgctccgccactgctatttataaggaagagctggggatgctacaccaaatgacagtcgtgtaaacaaacttttagggattgagagctcttcccttcttcttttttaagccacaggaatttatgcgtatgtgcgtctaaccccaagagtgttggcgggaacctagccctcaaagtgatcacttgaatttgcagcccagcctccaaaactggaaacatgaagaaggaatattgacgagattctatagtttcctcaggaaccatcttttgaactcaaagagttctttaatgtcttatggtttattgagaaaaaagtcctctattgtgagaaattctttccttcagctgtggagattatttgagtttcagttcctgtagatgaccttttctcagacgagtgaactgggactacagtcaaagctgtgactctgtccaccttgggtgtttcatgagtatacaaattataggctcatgtctatgtaagtgacatttctttatacctacaaaatacacataataccagattcatattccatataattcatggaatatctcctgtaaagtcataggaaacatgaatatgaaaatattaataaagaattgaccacatgggctggaagcagtggcccatacctgtaatctcaacactttggaagaccaaagcaggaggattgcttcagcccaggaatttgagatcagtctggacaacataaggagacctcatctctacaaaaaataaaaaaaaattagccaatcatgatggtgcttgctggtagtcctagctactcgagagtctgaggcgggaggatccctttcacttaggatgaggctgcagtgagccctgatggtgccactgaaccctagcctgggcaagagtgagaccctgtctcaaaaaaacaaaacaacaaaaaaattgacagcacaatacacactgacgcatttttcttctgtacagatttttaaaaatattttttcttcatatcaaaggcttcaaagtcatttaataagcttgacctatagtttcagctgaatttagcagtatgtaaccactgacaatggccataactaattagtctgagatgattattgtactgaacaacctaaagtagtgtggttgggtttttcacagtcccaaaagacttcatggaggtgtggaggtttgaaattatttgttgtatgcggtgctatgttgtatgaggcacttagccaaagacatctttttcctaatgttttgtgctccaaagaaggcatcaaattattattaaagaatctgaattgcatacttccaattttactcattgaaaaatgccatccatcaattgtcttattatatattttcccctattagtgactatgattatagatagaatagaaatatattgcctcagtcctagaccatcctaccctctcatgtccttattagtgactggcactctgattgaattagtaaaattttaaattagtaacattgacattttgtgaagaagcagactggggactagaaagggaaaaattagaatttggaataggttgttattaaagtcatatttttatagtttgttacattaactataaaaaaatccttgtttccctatgttgatcttgggcaaggttttgaggcaattcagttttaatcaacatatgtgttctttatgtgccactgtgttttttttaaattactttgtgtattagcacattacatttaaaaaacagatagacttaaaaaaaaaaaaacagcatacaaaattttcttaggcagcattgaatgattaatgcaaactgggtgaatggtcttaactactgatatctagctcctggttttagatattgtttcagttctgtttttagaataggagaaaataataataactaatgatattgaatgcttaggcctatgtactttatatgtacactcacttaatgctcaaaacaatcctagagtgtggatactaggttatcctattgtactgatgggaaaatttgaagctactgagaagccgagtaacttcactgagtagttaataattgatgagactaggatttgaacccaggtagtatggcttcagttcctgtgcacttaatcactaagctattgtgccctttgataagatgcaactagtctaatttgaaatccttcaattagacagaggcaaattagtcactatgctacatcagcaaattaaactttatagctagaggaaacttccatagagtattctgtgctttcttgacaaagtttgcctacataaagaacaaaaaaagatctcttcttgccatctacaaatgtttacctgcagttaaaaaagtctggctcctgaccacttttattttgaaactcctgatggctaaaaaagaaacagatgaaaaaaatggatttttttcagtagttacttttcaaaggatgataaatggaaacatttaaaaaatacttttatagtgtgaattcattttctatcagatctttcagtttgaaatttcttttgttatttgtttaatatcaaagatttttaaccttctcacatatgaggaacactatttattttattttcttgcagtttgagaaatatttgtcttgatgccaaactgcctgaagacatactcttttacaaagaaagcaaaattttaagagaagttaacttagggttgctgacatttattttcttctttatttaatcttcccatagttcccaagttcagaacttgaaatattatctttattaaagaaagtattcatattaaactcccacatctatatgtagccatttttaagtctaaagtataaattaaaaattatccagacactatcaaataaaatccccatcttagcaaatgcttttcccaatgaatttcaaccaaactaacctagaatcagcttttggcgaaccttgtactaatggaagatttgcttttttgcttttgaaggcaaattgatattcacaaatcatatgtcacaagccactaaaagtgtcagaatcccacagcaggcccttggtagcttgttaatctctcctgtttaaaggaaacagactaattcacttaaatataatgaaagccatgcctgccccagcttagtcccttaaagcgtcagcccatacaagtcctgccttctttcttcacctccttctttcctggctctgacaattaaacatgaaactaagaagcaatgctttccttaatgttgccatgtctgagttatttcagatgtcacatatgtgaaaattgtgaaaatgcaggatgcctttaaaaaaaattttcattgacaatatatgcaagggggtatccttgcccacctttcaccattgttctcaacaaagcataaaagataaatcaggatgttaaatgcagggaccagatgtatatataaccttttgccctcattattctaattggtttccattaggaggagggagggaaaagtaaaacagcaaaaaaaaaaaaaaaaaaaaaaaaggaaataattgatatagaggtgagagagtgaacttttaacattggattggctaaaatctgggaatattataatcagaataatagaagagcaatttcaaaagatcaaatcaaaggtgattcatataacaccaataaatggggaggaaataatttatcttaattttatgcgcccagaaatttttcaactgtggtcagtggtgccccaactatattatttttaacacttctcatatttacatgtatttttgtactttgaaggaagagccaaatgttctctgactcttattgcccagatacacacaatcacatttgtggctaactatatttgtatttagttctcccccttctaaccatgtgcattttccccttttagtagcattagctatttgtggttctccacactgaaatgaactgtaatatgcagtaaggttagatcttccaatcaaggacttcagtggcaaaggacctgagactgggatgacaacagagtcttactttcaacctaagtcttaatcaaagcgtagagtcataagattgaaaatctggagttagggcatgtaggggaaaaaaccattttcattgcaagcatactgtacatgttagtcatggctcagactgcaataggaattttatggagcaagaaaggggaggtgcaagaagaaggttttgagtttcctactaaatttatttttaaatagcattacagcatcaggatttataaagaaagaagcaataacaaaaaggagctttttacctctctctttttttttttttttttgcaaattatttgaggatgaaattgaccaccagaaaagagacatgaggagaccaaaaggagctgactgattaaagagtgagctcctgaatgtggcaaagtctggaatcctacaagacaacctaccaaagcctgttgacagctcatcttggggtataaagtctgagtggaggtcttaggtatggaaggagctttcagaggtcatttaggtcacttcaatctctctccacaaatcacactctttgttattttagacagctcccaaccatgccgacattttacagtaataactataattggaaacttgacagtatccattaatttccaattctagtgtttggctatacctatttttatctatatattttttaactcatatctcttattctctcattttagctcattttgccttggtttctcctcagtaagcatgagaagtaattgggtttaaataacttacttaaaatctttacatattctatgtgaaaaccacctacacagataatattatcagatttctatcttggtttccttaaactcaaaggattcacactgtgtttcaattcattttgatactttatttggtttacaggatcattttacatgtatgatgttatttagttttcaccataacgccatcaattaggtagcatatgtggtagtatcttcattatgtatgtgagaaacctcatcatatttcacttaaactagaattctctttctttgatttctaatcagtaatctttccactgcactatcatattaatcttaaataaagatttgttagccacagcactatttcgaaccaggtaattctttgtggtaggagcctgccctgggttttgtagcacatctagcagcatccctggtctccacctactgaatgccagtaacacctccctcccagttgtgacagtcaaaaactgttgtaggctgaggaattgaaaatctgactatatttggagaataattgcattcaattaatattgagtgtcatgagattctctaaatataagatgtgcatcttcctgttaatatacataagattgctgagttatcatttttttgattatgacaatgcctgtcacctcacagaggatatcatccaatacgttttcttaatacgtctaagggctttggttctccatcaaaaagtaattttccacttttgctttaaaaagagtcacagtaagaaatgctatttctttttttcttagaaatttaattttcaaaagaagaaaatgtaactcagatgggttttgaaagtctcagccacctcagccttggtggatagccaggatctcagccctggtgttttctttctttttttatggtggtccctgaggttgtgagtgtctgaaatatatagtgaattctacaatgcaattcaaatataaggaagtcttgtttattaccaggtgcaaacttgttgcttcattaccatgtgaaccagggctatcttatttgtgtaactgaggttataggagagatatcaactatgaaggaaaatgtatgtggagaccaaaagtgtatatgaaataatgaataatttcacgtgaatatgtagttagtgattgcccaccttctaagttaaaaatagatttcttaatgacataggacaaataccaggttgctgaaagttacttcttccatattgtaaagaggctgtttcaatgaagaaagatattatcaatgaccttattggaaagtcacatttaaggtgggtgaatccttcatgctctatttttgcccttcaacaaacatatcttttttggtgcttcttgagtgtataagacatttcatgggaagtttcaaactctgtgaaatttgcttgtacaaataacagaaaatttagagcataaagctttgaaatgtctttaaattttccaatctatgttttgaaaattactgttgagttcaagaatgcctaatggctgagtcctgttgcttcactgtaagtataattgtatttccttatgaaggttaaaattcccatttcatttcttccatttatctaagtttccaggtgtcattcacaattagccattaaaaatgattgtgtttaattgagatttaccagtggctttaatacaagttttcacttaaagagcaattatgttttatattgcaagttgaaaactgtattaacggtgaattcagtgaaggaaatttagaggtctgaggctaatgaaaactttttaatgacatgcaatacctaggaaatcatattcatctgttgtttttcacaaaaactaactccaggaaaattgatattgttgtagaatattggaaaagttacagaggacactatttagaagtacattcattattcaacaactactttcagtacttactacatgccaggccccgtgaaatattttggggacaacataattaataattgctgtctcccactaaaaccagagacagacgcataaacacataatcatacagtacagtaagtgctggaataacagggcagtggaggcacaaaaagagaggggaagagataaccctgcctaggtctgagtgtttggggtaggaacactcagagctgaatagtgtcaattcaaatttctccaagaggaaatttctttagcagagggtaaaggatatataggatatctccaagacattagggacattttgagtagaggagggaagcagcatctataagggcagataaaattacaacaatttgtcatgctgagggagtatttgttctctaacatatagtatccattgatactctatgatatctctatatgggataagaggacaaaaggaatacaggactagctcctgtgaataacactagtgttgtcaaatatgaggaaatatagtaagttgctttgtgctgtttgctgggttataggagttctccctatgtcctagctaattttatcaaaaattgtaacattacagtgagtgctagaataacagggcagcagaggtacaaaaaaagagagaagagttaaccctgcctaggtctgagtgtttggagcaagaatactaggaaaggaatggtgtcaattcaagtttcaagaaggaatctctttagcaaaggataaaagatatatggactatctccaagacattggggacattgtgaatagaggacggaaagtagcacacatcatggagcagatgatgttattttcatttttcagaagaattaaggagtaactagtccaagttcacaaagatggtaaatagcagagccatgatgccaagctaggtctgcttgactccgattttcatgaaatatcatctctcttctatgtgttttatctggtttggcatggctttttagagagtatagtctcttcaagggatcttcagggaatagaagcaggaggcataaagacatgagatttgtttgggaaaaataaatacagatcacctttctggtaaagggagcagttgagagagtgataggaggtgactttgtgtccatatggatttgagaaagagaccttttgcagatgcagacgaaaggaaatgagaatggtatataggtgcttaggaagtagagactacaaaactgctgaataggcaaaccaaaatcagggaaaattttcaagcaaacttacagaaaatagcaaatgcagatttattaagtgaaatataataatgagtttgtaaggcataaagaatctgtagaagcccaatgtttccaaatcttgccagactatgcaagacagacttctctctcctccctggctcagctcctaaacagagctattatctgcagagataattccagatgctctgaccccttccaaattcttatttgatgatcagtcatctggagtggaactcttactccccattgaggtttcagagtgatgcaccaaactttgctctcctaattaacactgtgggtcatccccatgcacccagtagttcttagagactggactgtcaggctctcatatctatgacattgcctctagggaggagaaggatgggtggaccccttgagtggccttcaaatgcctcagcattaaaatagaaagctctcatgagtgcctgaaaaatctcagctgttatttctccagcttaaaaatgtttgaactcagaaagcaataaactacaagctaagaagacccaaggagcttctgtggggcagcagaagctgcttttagctgaactagcaaaccctctgattgtcatcattccagtcaagatttcagcactgaagaataaccttgagagttgctgctgcaaggcaactcttatcatataaaatgtttactattccttttaagtatacagagtaccttttaacaaagacatttctgggaactttggtttgaattctttattgggtcaatgagataacaaggatgacattcattcagaaaagttagaagttgaagttaggaaaattagagaatttacctatgctttctgcagcagcaggcctctttaaaagatccaaattttgaaatatcattaggacagaatatttggtcgataaagtagtcaggccattaatattctttcacaattattcacttggtgattgtgttgctacaggtgacttgcttctttttagtgatagtgttaatgattgtcatcatgccttgcaaatattaattacatccttgcaggcatcatataaagagacattaagatttcagctcccatgctttaaagtcttgcaattaaatttagaaaacaagacagctagtattctgataagtacctataaaaattcctaattgttgatgcaaaagaaatgacatataaaattaatacagaggtaggtatgagaagccatgaggtagacaagaggtattctttgaaggaagcctgtagtctagagaagtggctgcagggaattcaaagtgatggccttgacttaaattacaaatgttgctgttctgttcagggatcaaggatcagatgcttatggttgaatgaatgattgccctagggaagggagtgttaaagattagcagggaaaactaaatgggcatatcaaaagccatcagaagatatcaaatgtcaggataagtaggaaaactcattaacacattaaatgttttgccctttaaaactacttttcttgatggagtatattttaaacaattaagtgaaacctgttttaattaaagattcttctgatgtgattaagctgtcattttacagtggcatgatgaattgtaacacttggacttcaaaattctccaagtgcattttggcaaaagctattccatgaagtcataatctgtcgtcaagaaccaaagcattgaatgaatactggtcaatgcaaatttgtttctgtttttcagtgctgtcaggatggggatgatttgaagggcaactcttagggttcttaaaaggatataggtattccaaggtgattcagttcaggaaggtggcattttctaaacaatcacaggactaaccctggatcacatattttcaagatggaattagattttctagtccagtagaaagtagaatgatagaccatgagacttggaagggttagggggtgaaagttggagtggatgatgagaaattacataatgggtatgatgtatgttattcagatgataggtaccatcaaagccctcacttgaccattacacatgtaacaaaattccacttgtatcccataaatttatatgaatttttcaaaaagagattttccagtccagtaaggtccctacagtaagccactgaagaaagtggcattatcaccattttataatgaggaaaaataagattttgagacattaagccaatttactgaagttaccccactaataatttaacactttagcccagtctattagactgaaaagtccactgtacaacaccctccctcagattcaatctgcaggattggtctagaaaagatttatctaattcacattttccttcttccaggtaatgtggaagtttttgagattcagtgattttcctggaatgctatgcaatgacaaatgtcaggaagagtaattaagaattgatttccctgtaggattcagaatatcatatgtcattatctttgaatatgcatgtgatttttgcaatgctatcccattccctgtgtgccaatataactttttcttccaaaatcttttatgcaaaaatatgcaagttaatagcattacctagtagcaatcctcaaaactttactggcacataaattaaatataagcactctccaaaggtgcttagatggtgcaaaagaagtacaagatgataatttgactttgctgacttcagatcttgttaggaggctctcattggggtataacactgcacataatcaactgctaaaaggcttgagccattgtgtatgccaaggataagcgtatatgtattgcatcacatagagaacaaatgtaccacaaaagcagagggtctttattggagaatgttattctgagatttttattttaggagggtaatcctattaattatctaatttccatttttctcttggcttctaaagtagatgtatcaattttagatacaatgtactgactttttatgttgtcatgagtagagcatgtaccactaaaactgatgtgcggagataatatgcaccacatggtttcttactgtctatatgtctggctttaatcacagattcttcatgaaatgttgcaagcctggggtgagctagctgttagattcttctggggtacagcctgggctgtggattattggtgaaactgcattacgaggctactggggttaattatgtctgaaagttttcagtacaatccacatcagttgacactctgtgcatactacataaacagtctggagggagacctttattagcagagcaagaaagcagctagctgtctgtgttctataatgtcctttgttttttagagcttctgactcatgtagcccttctgttttatttaatgtattcttaatcaaatatgtgcttattaagccaaataatgaagagtcaagaggttcaaatcttgaacataaattccctatgtctaagaacaattcttaatttaagattatgtgccccaggacagcagcccactgaatctgggggaaagcatgccaatgtttacccagaatttcaacatacattgtggcactggaagccatcctaacctgcagaagtgctatgaagaaattagccaatgaacatacgttaaagatcttctcccttgtgtatgtcgtatcttatctgttggaacttctgccatgtagaatcttcctaattgtcaattaaccataatgttcttatgtataatattctttctgttcctaaacaaaagtagggtggaagaacattagtctaagctaatccagaaatgcccttgcccccctcaagactcctgactttaaagtcactcagcctcttgggtacacgatttctactttacctggcacgaactctgcatcatcttataatgtggtgggtttggtaagttctggaggagacagaggggaatgcattattccaacaggtcttcctaagaaccttcatggcagaaaagactaggaagcttgagggtcctgatggccttttaagtgaaaaagcacttatttggctatacttagctataaggagaaatctgtattcaccaagatgttgaaaagcaggagaattttgcccccaattggcatctttgtctctaaactacctaagcacctcacaaagagaggcaaaatagcataatggttaagagcaaggacactggatcagatgctgagtttgaatcctggcttcaccacttaagaggtatgtgaccgtagacaagttattgagcctcatgtgcctattacctctcagtaaaatgtaaaacagggatactaattgtacctcactcaaggctatcatgatggttaaattacttgatatttgtcacttggtaagtgttaaacagtttcaactgtgaattctcaattccatccatttctctgatagaaagttcattattagtcatttatgtatagatcaacttttatatctataaactaataagaaaaaaacctgacaaaactacaagataacttcttgctcttagcccaacactgggaagctgtgactttgtgcaaaaacatgatctttcagggtttaagattcctcctctgtaaaagaaaggttgaagtagatcactggtatggcccctttctggtctaacattaagtttttccaactttagggttttgttgttgctaaacaaaaataactcatcatgtttcgaaattacattagaatgttgtttttttttatgaaaatcttaggaaattggaggtagtgtcggtgatctaaatggcatctcttacctacacatacatattttttttgtaataatctttttttcaaacagttttggcagttgaagcagaaagaagtgaaacattagatttttgaaagccaagtgtactgggggaaagggatgtaaggtcacctggttagtttgaagtgtgtaattcttttctctctcacctcattctggcttcttcagaatggcagttgggtaatactgcatcagtttgataaggctgccttgcccttcctaacaactaaaaccatcctagacaccttttcatggacactccctccattaaagcaccagaactttagaactgcttttaaaaatagcagataaattaatgatgttcttgagtaacacttttcactagaagagtctgactgagaaacaaagttgataatgctgtacaatattcttatattgaataaaggcgtggagtctttctgccttgagaaacatagtcagaaaatagccctgggacaccgatattagaaaaggaacagacacaaactccattgcatttggctgccagtaaagagctcattttgtttacattattactctccaaagaagacaagatgaaattgtcattatccaaatgttgtctagtgttttccaactaagttcctgagctaaagtaagagattgccaaaaaccatgtttacaacactgaatgcattgtgtaataaagtgttaggtagatcagctaataaaattacttattttagacttagataagttgaatttaggtttaattcactacccaatggggacaaagtgagttggttttctgataaactgaaacatacccaactttttgttgataacagagtgtaagagcctttagatattacccacgggaaccactccctttcagtgggaaaagcctgccattctcaactgaattgctaatggtcatctatttaattgattttgattctcaaatttgttaaaatgcagttggcaaagaatattttttattgcccctgttggctgacctatggactatgagctggaatagagttggtgaaagtttaggaatggagctggaattaaatgcttagattcccatcatttatttcctaagggaaattgtaacaatttcacctcgctctttttcctgacactaagaattgtatgaccaacactctcttgttaaagtattagtggatcaagtcttttgggaaaagctgcaatgtactttgaacatttgacccacagtaccacttaggataatttatctgaatttattttatttataagatgcagaataggaaactgaatcatgacgctttaaatataaatacactctgttctcagcatattcctgcagagtcatatgaaagaggtcctctcttccacgctgcattgtattttacttttatcattttagttttgtttaagtattgcggaaaaatatggaccattatattctccctgtttttattttaccttctgtgcactaacaattagtcttcctttgttttgcactatgagtctgaaacgtttgttagttctctgctttcttagtaaatggtaccatttaaaatagattgtaaatatatattgcatagatatttaaatatatattataaatacatagaaatatatatgcatactcagagtcctctataagctctctgttctacttgagacttttcatatcagatccttatactgttttctctttgtgtttgatctgttcttttatcatgtctacaacaaagatgtttaacctatgtacaaagggaatataatttgactttatataccgccttttgaagatcatttttaatactagtttgaagccacgtacatcagagtggtttggtaagatgagattttacacgtcttgaaaagtccaggagagaatggttatacttggtgaatcaaattgtcttctttcctaccccatttttccaactctaaatacaagtgaaatgaatgttcttgtaaattgtactttctttttatggcttttagaccatagttctatacactatgtgcacacataatttagagactaggtacatgcgaagagaataaagtcactgccttttaaagctctgtgtttacatcaacactgtctagctagatagcctgatgaatgaaaaagggaactggtattataatggtagttaattaagacagctaataaaaccaagatctgatcgaagctgcatctgggagtgaggttttaagaagcaggcaggactgtgcactaattgttggattgttattatattacatgtgtcttggagaggagatagtgtgactcagggtaggcagcagctgaatcagtagcactgggttttatccatcacaaatttagtattaaaacttcagctgtgttataactttcctaatggagcaaattccaacacatgacttgctgcaacagccaaacacacctaccactgcttttagagattttaaccctggtatgaggacaggttctatttggatactttctgagcaggatagaaagtttacttacatctgcgcggtgatgcttatggttctgctgtaacaatgaacaaaattagtgtctctgaagattttcagatgcaattagatgtaagagtaagttgattatttgacctaaaaaagcccacataactgtcctttagtatgagatagttgtagagacagggaagatataacagagtattaactataatatactactgattatattattttaatgatttaataagcacttttaattaaaaatatgccttcctcttagtccatgtgagaaatgccattaattataatattaaggcaacatatatgctagacaaaagcattttagtaagaacacatgagtgttcaacatgccatccactctctactttctatttaagagttttacttacaaaggtgttactagagatgcaacttaaggatctagtatattctttgttaaggagtctgtttgtattctcttaagaaaagggaacattttaatattcaaaggcaaggtagatccatcatattttaattcacctaaactaagaactccagagagagttatagcttattattcactatcttactctatctttatattattacttggttgtattgctaccaatatgaaagaaaaaaatagaggaaaaaatcctcaaattacttatgacataataggtgcactttttgcaaatttattttatttcagaaatggaagtatgttagctggctggataaaccggaactactctttcaagtctggctgtattctagcagagaaaagaagagcccccgccccccagcttttttcatattaaattattgagttttctcttcccattgatggcttagtagatagttcacttaatcttaaagcaaatagggagagatggtggaacttctaccactttccttacttaccagctatttttgctgaggaaaaagtttctagatacattctaattttgttaagagaatcttttaaattagaaggtacctgagctctcataatatttgaaatgtaccctcaggatttactttttaaaatttattatttctacataattaccaaggggcttgacgcaatttaaaaatacaaacacaaaacaaaactaatgaagtgagaaaatgagaataaaagctaaataatgagggtttagttacaacagttttattggaaactgtactggagattgctataaatcataacatttagctccaagcttattgaaatgtaaagaaaaaagaaaacgcagaacaaaccatatagttctcaacaaaaaaacaaagcacagcaagcaaagcatgaaaactaacaacaacaataacaaacaggtcatttagacgataaacaaatatatcctggcactggattcttacatggatattgaagagggactatggactatgcattgggaatctaatattaactaagaagaaagtgttcacaagacactgttctaggaaatttacctgcataatctcattcataatcatcataagatcgctatgaaatcagttgcgtctctgtaataaaaatgagaacacagagactatttggtttcattgcacctacagatggcattgtgtcatactaagaaatcttttttaaattacaaaacattttctctaagaacgtatctcaacaattcttgtgagaagcctagcatataatattaggaagactgaaagtttttatttttaatagtgtcaaaaacaacttctgttagcatttattgaggacatattataattaactcgttcaaatctcagaaaaatccttctgttaggtacaaataatattttattgatgaggaaaaagagtcacagagggaatcctgggagcactttcaaataccgtaatgagagcttctcaggtatcttctaaattgaaaggttctcttggtagaatcaaatgtacctggaaaatgttttctcagcataagaagcctgggtaaacataattatagaacttagacatttccccaggagaatgtccaaatcatgtactcctgccaatctaaactagcacaggggtgggttttaagatactttcatagatgtttttgagctttagactgttgatctcaaaaattagctgtctcaatcagagttatgtcagcagctgagtaggagtcaggtggagttcccgaaatgcacagtggatattttgttcctaaaatgtaagagctaggcttgtaccctggccctggtaagggtcatgctacctctgtattggtgtccccttttagaggtatgaagggccaggcatgagttccctctgtggcagcttttgcattgtgtacaagcaactctttgactaaaccattgaaatctactgtcagagcacaagatttcagtcaaagaattgcatcgaaagtccctcaaatcctcaccctgctaacggtgtaagtggcatggcgttatctttatcagtcccaatgttgtgcccagtgctgaatgatggtcacccatgcagtgcatccccaaatgtgctcctctttcatggactatgcttctaattaatttttggccctacttagtctgagatggaatcactgataatggcataactgattgattctataaatatttattagtttcttttactactgagttagtagtattaaaattagtagtagtagtattagtagtattagaatttcacacttggaaaatccagaccttaaacgtaaaaatcaagatataaatcagtaaatatttaactctagatgtgtgtgcacgtgtgtgtgtaatttaaaaaaggaatgtaactgttgtttatcttttggcaaaaattattacactgaatcataaactattgactccatctctccaaatttatcctgcaagaatggaaattcatagggttcaaactaataatggtagtaaaatattaatagaaatgttagtatagaaagtagtcacaggtaatctggaagtcttcttccttacagataagattccaacgatgggactgacttggaaagcattgatttctggttttcagaggaaaagtttacagagtagcatgtttctttgtttaattaaacggtatttttgatctaacatttaactttagttttacttatagttctcaaatcgtcagagatatttctatttttaaatctttggaaaaccactgaactgttaaaaaaagattctatcaaatgggataaatcagagaaggtgacatctgttattgatataggacatctcaatataatctctaattatcaaaaatatgagaatgaactgctgactcattttgccaattatgtgtctatctatcttattatctgtttattgttgggtgagaaatcaaaccacttatttatataagaaaattgacacatactgtcatgtgtttaaagcatgtcttttgtatctgattagtgtattttgaatgagataaataagaaattctgccatagattagcatcttcttcctaaagaaaaaggataagagaataagagtatttttagacacaataaaattcaaattttaatgcgggctaaacttaattagctcacttttcttcatttaacaatgccagagtaagcagtcttacccaagaaggttaattttaattaatagatatttacctactttaagtacttttaaaattcttagccatgtgaaatataataattatcagcgggcattatttactaagctaccaaatgatacaaataaaaacaagttttctgaacttggaaactttcaacctggaagttaccaaaatcacattcttttaaagaaataaccaaagtgctatctaatacatggaacaaaaccaagaatgagccatagtaatttaataatctctttgctaaacctagatactgattttttttttcatgaaatgaatgatggatagaataaaacatttttatttaaaaaaattttatacatcattttaaattggatacatttctttaaaataatacacagcaataatatataaaacttaagaacatatatgtatattatatatatacacacacctatgtgttgtatgtatgtatatgttatgcatacatatgtttatacatgtaaacattacttttttattgctaatagtattgcatgcccattgttagaaatatgtagataaagaggtattaaaatagctactcataattctactacctagaagtacctgttgttctattttggtgaatttctttttatttttttccctgtatctatgattatataattacacattaaatggataatctgaggagacatcatactgtatacagtacattttatcctgggtttaggcttttctcatggatactttttcatatcattaaaatattcatatgtattagtttaagattcttatattctgacttctagttatatcttagtttacttaaccatttatgtatataatagataatatacatttattatatatatttagaagagatacatatcaatagttaaaatattcacaataatcctgtttgatattcttattatctcagtttttgacgtggacaatttcaactctagatgtgtatgtgtgtgtgcgtgtgtgtgtgtgtttgtttaattttaaaaaaggaatgaacctgttgttcatcttttgtcataaattattacactgagccatacactattgagtatacttttccaaatatattctagaaaaatagacactcacatgattcaatacagtacatccaaataacaaactactaaacaaatgagacttagacttttcataactttagatggcaaaactaggatttgaacccaggtctgtaggaatccaaagactatgaccttaactactcaactttattactttcaaatacttgtctagaagccaactgtttaggtctaagagtattcaaaatttttaagttattgatagatattcccaaagagtttttttagttttctatgaatatatttagccttagcaaaagtagaatatcaagctattttcaaaatgaagtatgagtcaaactgatatgtcatgtacactttggccatatctaacttagtgatttcaaaataagagactaaagcctagcagagcaaataaaatggcatatatagagatatatacacacacacatatatatatattctgatatatatatatattctgatatatatatatatatatatatatatatatatatatatatatatataaagaaaatgctttcccattttcttaggcaagaattatcattgttaaaagtattaagaccacaaagaccttaatttgtaaagtggtggtaaaaaaaagatagctaaattgctttccatatgaatttaataattatctggctgctggggtaagcagcaagacagatgagatggctgaagaaataggaggtgaaacaaaacagaatgaggcaaaagattatagagacaagtgcctatgagaaatttgctcaaagtagaaagtgggagaggggcagagaatgtaaccaaagtatcctagaaaataaacacaactttaatttaatcttaaattatttaagctggacagatctatagtctctttttagctgcaaatgttaagcaaagtctgctgtgttcataaatttcttgaacgagttttggaaggaaacattaaagaagagaaaccctggttcaccatgcaactagtgcagagcataaggaagaagagtcatagaaaatgaaatcagaattgtagtggacacataagattgagcatttagggtaagccagaatttagaatcagaggtgatgaggggaaacataagtcaccacttcccagaattctccccatgtagagctgccagataaaaattaaatatggatttctattaaatggcttccaattaaatatggacttcagataaataacagattctttttataaatatgtccaaaatattgcatgtaatataaatacacgtaaaataaaaagccattcgttatatatcttaaattcaaatttaattgggaattctgtatttttatttgctaagtctaggaacctgctcctaagaacctctagagataatgggaaggctggaagttccaccttatctgggatgggagtgatagaaacttgcactgaactttctttacaactcagaaggtctggtgaacacaaatatgcacaattagtgtcaaaatgattataaaatccagatcccatgttaagtgccctttcttctgtccctagttctgttttcagaactaggtgagactactccattagtaagttgtgttactatggcaaggaagtatggcaagactatcccattagtaagttttattagtgttaactttgtttaatacttatggaatatttcatcctactattgccagtggtttcacaaaagcaaattatatttttaataactcactgttaacccacctttatatgcacaacttttcagaacatatgagacatttcttttaaaaaaaagttgcaagtctacttgtgccttattaactacttcattcatggtatagagagatggcaggtagaatcctcaggagcttctgttaaccatccacatattgtcaaacatttttgcccagacacattctatttacattttatagcaaatcgtggcagtcttaggaaaagacatattccagagggattgtgtgtaagactcctatactgaccttctaaattaaataaaaatatagcatgttcccaacataaagaaaatcatattatagacactaaaaacagttgttctatataagacaaatggtaaaaaagaaaataatagtttttctataggaacaataaaaaccttgagacagagccattgggtcccctccaccagcacaatggaatcctactataagggcatgagatgagtttaattagcaagtattgattgagcacttattttgtgctatagctagaccttttgctctgtgctaaaattgcaaagtaggtcagtccatgctgtcctgtatgatttattcatgtggcaatcaatatttgggcaaagtataaaaggtgccccccaaaaaagagtgattcttagcaagagaagaaagatttgccagggacgaagcatcacaaagaacagccctcagagtttttgaaggatggatatagttttgctaaacaaaaagaagttctattcatactgccctaagatgtgtgaaaaatggcaagtacatcaatattgcttgagtaaaatatgaggtgggcagagccagactaggcaaaagttaccatattataaagggttgctcgcatttcttcatgatggtgacataaaaaccaaagtgttttaggcaggagagtgtgacttgatcccatatgtaactcagagtgatcacttttgacagtgacgtgaaggagagagtcgagtgaggcaggagtcatcccaggaagcatagggaggacgcagttatactagtctgaaagggagatattatgactcatgcttaacttcatgagggatagattcatccattcattcaattatctatttttttctacaaatatttattgagtatttactatgttcttggccttcctctaggtactgattatatgaaagcaaaccaacaaagacatccccaccctcatggtggttatgctgtagagaacagaaataaatttttcaaaagcatattaattcattttttgaaatttataatttataattttattttttaagaaacaaaataagatgctgtgctagaactgcattattcaattcagtagtcactagccaagcatagctattttaatttaaattagttgacacagtaaaagaaaactaaataaaattattctgtttctcaatattattagtcatattttaaatgctcaacactcacatattggatagcataagttatcaaacatttctattattgcaaaaagttcaagatggagctactttgagaccgattatttgtatcagattatttacttatgaggcgatgtactgagacctgaatgacaaagtgtagagtaagctatacaaaaatcaaggaaataaagctcaggcagagtgcatgagttctgaagaatgaaatcaatgtgtgaaaaagaaagaaggccaagtgggctggagaatgttgtgtgaagtagagagtagtgggagaagtttggaaagtagatcctggtcatgtaggccatgctagaaaatctgacatttattctaactaagtagtgatgttatctccaaaattaattgacatgttaatttgggaagctagtgaatggattgatgtaagtgaaaaacatgatataattttatatttgttttttttaattcactttattttggggactgggaaaaatgaaggaaatatacaaatgagaaaaaaatgatggttttggatagcactgacagtggagctgtagagaagtgaaagagtcaagacattttggaggcagaacaagtaagtgttcatgtttgactgtaaatgggggtgggaggtacatagataagaggaaaagagtaagtggtgttgttttgtgctgagattaaggctgtgggacaaggaacagcttcaggaggacaaatcagttaattttggagataagatcactattagaatttcaagggcagccgttaagtgattagaggtttatgaggttagagaataggtcaaggctggagatgtatgtttgggcatcatcaacatatgtattgaatttaaagtcatgaaacagaagtgcctgtggaggcagcatagaacacttaggcctgagtccaacgtcaacccaatattttcatactgagtagagcaagagaagaaaacagaaaaatgacttagaagtactaaagggatgggagaaaaatcaagagagtgatatctcagaagatggatgagaaaactttccaagtatagaaggtcagctatgttgaatgccatgcaaggaggggtaagatgagaaaagacagttgaaattgagcagcattgttggtgcctgatgaaaggcaagtagaagttcgatttttttttttttttttgagctgagaaagggaatgaacagtgaaacaatggggaaaaactttctatttctgagaagggaagcaaagaaaaaaaaggagagaaattttgaggaaagcttgaggtcaaaataaggttgtttttgtgaagagatccccaagcatgttgcagagaatgatcctgtacattgtcagatattgatgatggtaatggtcattcactttggttaagatgaatggaagttcaataataatggaaaattgtaatgcattaatagtcttgtaaacagaaaatataaaacctagctgaagtattatattcttggttaaattctatttgttcagttttattttactgatttttttcctcaaggtatcttcaaatcaagtcttcccattttctcattctatattcattattttccagcagtatattgtttgttttggaatttgaagactatttttaaggtcaagatattttgcagactcccacatggggtcattatacctacattatgatgaaaagctagtgtggatgctttaaaataaattttattattttgtcactaaaaatatccaaatatatttgaaaatagtgtatatacataatatatgctgatttaagttacagacaatctctaatgtgactctcgattgtaataactaaagttttttaggcacccaaggccacagatgggtggtccctatcaacatgaaaagaagggagctaacaagtaattgtatatactgcttattgccttgaatcagggaaactacaaggaatatacaagtgctattatccaaattcgaaaagttattttttcaaatgaaatcctttgaaagttccaaaacttcctttcttttactgacccctagaaaccactgacccagtacatactataaaatcataacaatgctgaaacttagttattattagcaaatgttccacagaaaatcatcatgaaggaaaacttgtactctctcaatcctgagtattggaaatgcaaaatatttgaccctggaagcagaagtgggtcagagagttggtttaacacacacacacacacacacacacacacacacacacagagaaaacaaaacagtaaaaccctaattttggtaaaggaaaaaaaaaaggttaacttttgccccaactataactcatctcaaatctgatatttttactgtttgtttgaaattttgtaataaaaaaattcatttaatctttttaacaactttcaaatgacacatcttgtggtttttatagtaccctagtaacaaatacaattgcttaaaatgctattttcctaacagtttgtctttattcagacatggtattatcatctgcctgaatttatccccattcaagcatgaatccataaaattggactgtggcaatgggatgcattaaagtacttgggctggactagcagcttgcctcagacttggagctgacagcttttctgtgttttcagtctcacctgtctctctgttctctatggacgtctctttgcttgcactctgaccagatctctggccatccaacctggcttgttctgttggcccctatgtctggattcacatttgttcacctctagttctttaatcagagttgtgctttgatctgtctgcattcagcaagagcttttactttcctgggttgttaaaccatcattagcagtattttctcaacaccagtcattcacataccactactacaaatgttgccatatttgtcaggccctatcctattatttccttaattcttttcctgcaaattgactcactttgtatactaaaattaatgtatttttaaagacaaattattatatcactctaataaagggaaagccaatatctgttgccataaatagaaggtgatcacataattaaatataataaaaacaagataccatggttaaattgtggctatatgctatgttttggcaaaagaatctaagtctgaggcctcagatttcatttgttggaaagggagataagcaagttttccagaggtgttaaggacatattagtaataaactgagattttccttgacataaccagaagaactgaaaaacaggaagtgtttcattttatgatttaatgttatttcatactacttgtatgtgccacctcagaagcatctcatataccctcaacatagcatgaaacatctagaatgttatgtgtcccacattttagaagacagaattttaatgtaaaattagctatcagagagtttgtgctaaacatgaataaaactggataatacaatcaggtaatgcatgatcttcagtcgtatttcctatggttgagctataatattagcaataggctttaaggatctttagacttaagggatccaagataagttatgattgtaatgattctttgttttcttgtcatttgataagactttaggattcatagcatagatttcagtggggaataagtacttgtacctaacttgtacataaagtggaaatttaaattcaaaaaaattttttaagtagagcttttaaatgaaaaattatttttgtaaacaaaatgcctgtcatgaactataaactctagacgagttatttttatttgttcatgtaagggcaacacacacccacccacctctatttgaatctgcacccatctctggaaatgcttctttcctgaagttcggaactttgatggaatggtgaggaaattattatataactaatgagatcctaccaaactatgtgatgcatttggggaagaggattaatgctttggagctagtagacaatgcaataaaatctagagactcactttactccgctagaattggcttactgttctagattctgtttactcatgtaaaacagagagactgacatccccaaatttggagacatcatggatttcctttagacggcaacattctccaacttaaattactgaaatatctcaaagcaagcaacttattttttttaatgtagatgaactttagtgtgggcaaggtaacgaacttcctaaatattttcattccctttatgtaagggtactctgtcttcctcctgcctgtggtttactagagtgcttaacctatacgtggcaatcagtaaacacagcactttgaaaaatgaattctggttagtttttttttttttcctaaaactttctataaatttcttaatccaaaatccttgttcccttgaactccaattgaagttatttttgatacaatttattcagaaacttatatgttataaaagaatttgtgacatctatatctaatatttattaactttcacaaattgttttgtcctttgacagaatgtgcctaacacaatgtacactgaatttcaatgactgaagtaaaagtaaggtctagatgctggagtgtgacttctacttctttgtatcctatagttaataatacataagggctacttcataagtgtgcattgatttgtttgtgatactcatgaagatcaaatttaagactaaaataatataattttataaaggagacagctaattaaggaatacgtggtagcatggactgagaataaaaatttactaacttccagatagttttaaattcacaaatgttattgctagagtgaggttatcaagatatgcatacactctttttaaagaatattatagaaaagacaatattgctttcccctctctaccttcaatcatcaccaaatggtatttctgcaaagcatacaagattagttggaatttagaaataaaataaccactatttgttgaatactttccataccttaaataatgtattacttacataaattctatgaagtagggttgttcaatatcaatcaaaagagtataaggcagacctggttcagctctgtctgattttaaattctatgatgaacccactgtcccatgatttctccccagtcactttggatcttattcagaaatgtttctgttcttacatttaggtcctatagcagtgctgagcaaccataacagttccctagaggttttaggtcttcagataatgggtgttaaatctcctccaagattattacattacagtaagttggtctattatgtggacattatagagctttcattgctctgcttcaaagaatagactaaaataacttacctacttgaaaacactcatcaggtttatgttttttttttaataacaaggcagtgaattatggaaatagctcagactatctattatctatctgaatatataaaataataaaccatatcatatttcttcttcattgtattcagtaaaccagatacatgacctaatgaagtataacggagtggtgtagtttttttacattcttgctcctaagtattccctacaagtgaaattttaccaatttttatccaatgcagcattccttatgtataccacattttcaaaaagacatgttcaatgaatctgcataatatctgtaggaaagaagcaagcataatgttttccattgtaaaacattatgctataatagttattagattaacaagcatttactgccatttatttcacctagaactcatatgcaaacttttacgctagaactgagaaatcagatagactctagaaatgctaaaaaataagaacaaaggaagacttgattagaatatatttttctcatattaaatggaaagtatatttcaagtcatcatgtaaaccaatccttaacttgggggtggttctcatgttaatttctaaggtttatacatggacatggtttttctttctttctttcttttgttttgtctctccccttccaccttggattgattctttctttgactgtcaattcttttttcttttttttttttcttttgggcaaaggacaacacatacattcctaattctcttttcttctcaacatttctgagtttaccaaaggcggtagattttaaattcctagaaaaaaaggttagctgtgtatcaagaaagttattccaccagagtctaaattctcaaaagcattttctttcagaatttcatgttaagtaacactctgctgtcctaaagtgaaaaccaacaactatcaatcatttaagtcagtattgtcagaataatgaaaattaaaattatactgataaaagacaatacctgtagccatcacaacaaagaaacatttatctgtgtcctattattaaacacttcttttcatgctgcatataatgtcattgaactttcaaaattttattatatctcataatatttttctattaggttggtgctgtatcttttttaaaaagctaaagaaagtacaccaagaagctaaaatgttggcactttatggatacaagggtagatttcaaaggcttataaccctcactaaagtgtataacttttgggcaattcttgaagggacagggaaaggagtgttattcctattctttgggctactttcagttcattcacctcccaaattctgtgttgatgccaactcctgcttttcccctccactgctatttcagtctcatctgctcccgtcatttttatacactcctttcttctttaactccatttctccttaactgtccaaagtggtagatgtgtccgaaatggaaaatttcatggccactttggcttagtagtggcaagtggtcactgggacaaagatgaggctactttctaaagttcttcactcccagcctctcataaatcttgattatcttgatttcttaccgttttcctgtcctattaactaaccaaatagtggagaaagaaagttcaactcaagagaaatgagcaaagttctaccttaatttaaagtaatgtataagaatgatgcaagagatggacattgataggaacatgaaaagaatgggggcatatagcctgaagtgccagtcctttgtctgagataataaggactctgaaagaagggaagaatttaaccaaaagtgggaaggtgaggagctgaacagcacagaacagaaagcatgatattaaagataggggtcaaatggccagaggaaaccttgaagataagcagacatcattcaaagaattgcaaagtggaaaaagaagtggaaatttctcagtatgggcctcataggttactgtttcacaaatagagtgttgatagaaggttatcattgcattttagataatttgcaaatacgcaaggaaaattgtcttgctataccagaacaaagcccacttatataaagaaagctcttatccccaacagaacgccttatgctaaaagtttttttaatttgtggggtttttctcttgtcctcaactctaaatgtctttaatatactgtgagaacaattatcataatttctacattcaaaagttaaaagccaattaaattataatatgtgtaacattttttgagtagtgggttagtttatacttactggtactactgaactctaaaataatttaactattctggtcatatttgtacaacatttagaacctgagatgtaaagacttcaaataaaaataattaaataaagcttaaaatgttctttgtgtttggattttagtctctatttaaagacagattagatattttggaaattttcataaaataccctctttaaatcatattcattgtgtgctttgatcgcttttagaaaaaatagtaaaaggaaagaagctgtttaaaattaaatatagttggtcttaaatgaacaggaaatcagattcatggatttggctttacatgaccatttacccacattctaactgatgttcctaacatgccttaaattcattactaagtagctagttagacaatctcaatctagatacagtttgcttttctacattaattctctgttatcttcttacattcctcgctcaataacaataacatgtctcattcttttgactttgatacttaaaacagaacaaattaatcacaaacagctaatgaaaattaatagagtactttaactcagctgttggggaaattctgataaagttatagagaaacttaaattgtaattcaaatctggggagatacatttgttagaatttagccttttcataataaatgtttctttgaacttgtgttgtgatgagggaagacaagggaaaagctttgctgatcttttaaacacatcaaagccttaggaagctaaacatgctggacggatgcttttgtcaacctgaatagtatctgtgccgcatctttcaatgtagatatggcatttatctcctctaaatggcagaagacctccggtcactgcagggactctaaaccaggaggtctacacagagcttcataatttcttttggtatccctcaaatttgattattgtcatattttctgaaaatcaattttgtactctgaaaaacaagtactaaatactggttgtagaaaatacagaagagtacaaagaaaataaaaataaccaataatgtcatcacacagaagcaatcattattttagattatcttccttctttcagatatgtaaaaactatatgtgttatttaagataatatattaaatggtagcttttatagaattgtgagcataaaatatcaaatttaaagcttacattattagcaattcctcaactcattaatgctatttttaacctttttctaacatgttatatgattgttggtggaaacataataattacatgttagaataataatttatttaatacatacatttatttggacatttagattgttttcactttgtcatcattacacataataattgtaatatgcatttttttttctgagacagagtctcgctgtgtcgcccaggctggagtgcagtggcacaattcaactcactgcaacctccacctcccgggttcaagtgattctcctgcgtcagcctcccatgtagctgggactacaggcgcatgccactacgcctggctaattttttgtatttttagtagagacgggttttcactgtgttagccaggatggtctcgatctcctgacctcgtgatccacctgtctcagcctcccaaagtgctgggattacaggcgtgagccaccacgctgggccctaatatgctttttaatgtccaaatctgtttttggcatctctgaccattttattttctaatagtgcttcacgcatagaaaaatgttgatttaaagtacttttaattcaacaaactgaaataaaggttttcagtagattatttttgtgttttagctaggcagttctatcatcaaaaggtaatgatggtatggtttcctctttttaatacttatctttctaatttttgtttaatgttacattgcattaacctggactagtgagttaatgttaaatactagttgtgtcagtcggtgtagtttactaagagtgaacttcatttgaattcctgggatatgcctcaattgatcataatgagatcttctataatagactgtggaattcaattaattaatgttttatctaggattcaatagtatctttctttttgtgttatcttaatatttcagtatcagagttatgctacttttttgcaaaataaattgggatcactaatataacataagcttacctattttagaaaaaaaatgtaataacattcacaggtgaaaccactagatgttaaagcctatttttgggattaaaatttgttataatagtagtggcagaaatagtggtactctatcttatttaagatagcctctttctcagtttgagtcagctgtcagggaatataggatctaagaaaatttgaggctcatctttggttattttcaggtttaccattctgccttgccacttccccaaattggttagtaagcgctctttgtcttccatgtcacttcctctatctagatttcaccttagatggaacgtaactaagatgaaaagttgctgacttctgaaatatgcaaaacaaggagattaataaaagtaactgtcattttaccatattcttttatcattcttctatatacttttaaggcatcatctcatttaattcttaccacagttctaaattctatttttatttcatattacagatgaaaaaactgggcttagcaagcttaaataatttgtggacccaggatttgaactccagctttccaaagtccaaatgtataagcattgctctatatggtctttctgtcacttagggtactcattagagaaatctttccatgagacagttcttctccacctctccccggaggaggagggtgtggggaaatgaagtgatatgattacaacaaaacaaagaagacaaacatagaatctgacaatcagtaattttgatcacagtaagtatttgaaactgattatctctgaatattatgaaatcaaaccacaaaaagacgagaataaaatatataaactagcacaaaattatgcatttaaataccatgaaagaaattttgaaaaacaccagtatttcttagactatttaaatcattttcagacaaaaattatatattttgagtaactctcattaaagagataaaatgaattagaaaaaaagaaagagaatcaaacttacaaagaacttaaaaattagcagttataaaaagcacagctctccaaaaacattaatgaaatactgatgaaaatttggttttaaaatatgatgaaaaacatgcaagttcattaatatacaatgataaagataaaacaattctaccttattcatctacaaatttgtgattcaaatggtacatattttatgttatcttatttcagttttcttcccttttactttctagttggtcaaacatttgaatccatagaattgtcctatttgttagacctctgttgaagttattactgttattaatatttaccaattatattctgatattttaaatattcaataatatgaatgtttatatgagttactaaaatgggtatgcctaggtaaagtagcatattctataacatttgtttacagattgtctttcattttcaatatgtactttcccaatctgtatagtcaataaagtggaaagcggtatattaaagctagacaggcaactctaatcatggcttgactcctgtatgaattggtacaaaggatgtgttttccataattagcttccatgtgctaaaaaataatttaacctaaataaatagaatgtaattggcctttcttaataacactcaggttgtaaatcaatgaatatgtttaacatgccaaacattatatttgtcacatagaattgggaacataaaatctgaatgattgttaccagtagaattcccaagagaacttttgtttagtacccttaatatgaaagtatgttttttgttttatactaagatacatactaagtagaacactagctataaatagaatggaaaatacagccactagagtttaacttgatacaaaaaggaaaatctgaagatctccagtctacttgggcatgcttgagggaagggaagggagagtaggtcatttcttctcaccattaagaaaagatgcatgaatgcctcttggtgagtgatcattgttatgagtgattattgttatgttatgagccacatattcctacctgtaagcctagtttgaaaaccaaatttcatttataactgatgattagaaaaagactattcagatttatatgttcctgtcttgctgttatttatcactctttcatgatgaagttaaattttgagtctggaagtacttggaaaagattaaattaaatcaaatacaatattatatctttttaaaatcctaacattagtaggggaaaatgttcaagtgagaatgattaagggagacaaagaaagggaaaagttcttctgtgatacagggatttatcttatgcttactcatgatttcctcccaacattcatgatcaatttccactgagcctttcctgggcttgtttatgcaagtatctttatttgtcagctgactaaacaatgtcaggcaccagctttcgctaggcattaccatatcaggtggtaactactctgcaatagtatcatttttttagagctagtgaaaagagcatttggctgatattgaaaaaaacatgagtttgaatttcagctggcttaaccaccagttgtgttaagctaggtaattcattcaaccattaggacatttattgtgtccaatccaaattactgacattctttaatatgacctctaaagacatttccattggtaagcttctaacgttgtgcacatgtgccctagaacttaaagtataataaaaaaaaaatttccctgtgggaagtaaccatattcccctatgtagttgggataagaaggtggcttacatttctttttttaagtgacctgggagagcctttatgttggttttggatttcaagatttctttgtagacaatgcctgagactattccagaaacaaacttagaatattctatgaaagaatgagaagaagcagtattttaaaatggattcttactctggagtacagagatgatatggcaaaacaggaacggatacaaggcctaaggttgtggacataaggatagggcactatatcctcattcaaaataaaaaaatggggcataacaaagtttcaagacaagtaactgatgcttgcctggaagtggaaaactgggaaggtaaatttgaagtaatatttaccattattataaggaaatgatgcccctcctagttgtagcagcaaaagagaatcaccttttgccccacgtgaccatttgtttctgaaaataaagagggtgtgggccagaagatttaatctactgaagaggatgaaagctacgctgaaggggtagagtagggaaccaaacttaaaacagagatacaagtctcaggttctgctttccctcccgctgcctcttcctacagccacgctcctcacagatcgaataaaaatgaagagatgctgagacaccaacacacattatttattactcaaactggcagcctcacattatctccttccattgcactaaagaggcagctgttgaaaatatggaacacagaggggaaggattccccttcatctgttgattagctggagttaacattttgaaaatcaatgaaatgcaacacaatccagtggttaaggtttgatgtcatacatgagtttggaccttgactttaacctcttttagtttcagcttccttatgtatataatggagaatataatggggccatcaaaataatggccgatgtttgcttagcatagggtcaaggacatagtgatgctccataaatgggatgactattaatcttctataaattttgttatactttaacatagttgtttattctcttcttctctggaattaactcatgacaaaatgccactgctgggttggcttccttgcttaggtctatattctcagtactcagaacagtgctttgaacatacaggtttttgttgctaaactttgactattctactgtctgggaagaaatctcactatgcaagagttaagtgcatctagctatatatactcagtgttccaccaacacagcttacttctgtaataaaatacacaaaagtagtgagtattttctctctagactgattttaatatgtatgtttacataattatagaattgtaaaatcttaactttgattcaagaagttgtaatttttttggggggggtcaggacttctttttaattaaaatttactaaaatataataaaagataagaggaacacaatgtaagtcctaatgcatatactgtcctattaagcctagatatagaaactttctagagattgctagtgatcaagaactatgtagttttgccacatgagccctttcaatctggtggatttaattccttcttcatattcttccccgtctccttctcattctcttgcccttttctctcctcctcctccttcccctccttctgtttctttttcttcctctgcatcttctgctaactagaaacttctttcatatcctgtgccaaatatgtttccttccttacttaaagtaattatataccaaagaaaatcacttaaactcatgctactcaaagtgtggtcctaggaccagcagcactgaaatcacctgggagtttgtaatgcagaagctaaggcgtcaccccaggtgatgtgtatagcttgagaagcgctattttaaccaaacttgttaactactctagggaagatatggttttatccactagagggcagtaggacatatgtaccactggcattgcatttatttcccaattaaaagctcttttaagaaccactctcagttgccaaatggatagtatgcttggttcctttaaaggaaaaaacaacaaagtcaaaccaggttacatagagaaattcaacatgtgagattaatgaaataagcagttccatggcactagcatagtataaaatcaggtgccaaatcctaaattgtgattttggctcttgttcatagatcatagaattataaagctggaaaagtctttgatactcactggggcaaccaacttattttacagatgaggaaggaaactcctagacattaactggctgtttcaaattcatacagcttccaacttgccaatccaaagctggaacttctaccaacaaaatccctacccaaagattaagagagagagagagactttaacacgatgctaaacacctctttgtattatttaaatggaaaactggggttcatacttgtgctttacacatctattgggtttaatagtattcgttgtttctgaagaggtggggagatagggaggaattggtaggttttttttttcccttcaagttatttatattctgctgcactgccatcagaacacagcttgcatgtctccatctcaagcccaaaagtgtccacattaaatatcaaccaatcactaagtattgagtaaccacaatattcatggcactgttagacattctttttagcatgatgctagcatgatttctgctctcgatgatctttggttatgtgttattaacagccggctggtaactgcttttaattttcaatcccacatgtattttgcatgcaaaatgggatcaacaacattgtgtcagactcagagacacaaaaggtgatgaaaactgagctgatggattctcattcttctaaggaattggcaaggctttacagaggaaagaaccctaattgcacatacaacaccctcagtacaacttgctcacatgtctttaaaatgaccttttaaagaatgttttaaatgtcaatgcttttttagaaaacattgaatcaaacatgaaaattgcttgagaaaaattttgcaatctccaattaaaggcacagtcacatttccagtttccttttcctctttctcttattatcaatggaattatttaataaagcctaaaatcacatgaagtttatggatgtaagaatttggatactgatagatgtttacaaacagtttctaagaaagagactgaattgttaagcaaagctccaaagtgaaaaatgtaataagcaaagtcttggtggagtggccccagaaaaaaggagctcctaaaataagtgcacaaaaattttaagcactatctagtctggcttaatttgtatctggacaaaaggaagaggcttgtcagaaatttaaatttagctcccaaagaaatttttcagaactatgtcttcaaaccacagaaaagcacttctcatttgtctctctctccttttaccattagctttagtatataaatgaagtcataaccatcataattttaccaggaatcattacttatgatgtcttttccccatgatctcaccattaattattaagaatatgaatgcaaattactgtttgtgagacaaagtctgaagaaaacgtccatttttttaattttaagcaaacagccaataatctcacaaaaaatgacgtctgatcaatgaagttgataattcttagtttatattttgaacagtttaaattgtaattttgacatttttctaagagacagatgaggctttatattgcttacataagctatgtatgctctctatcctaacaaatagtgcaatagccatgaaagaaaacactagcatttaatatgctttaccttcagcattcattacatacacagttattttaggaaagtaatgttaccatttggacttactctacctatttcatctgagaatatcctctgttttcccctcattataataaaagaatagctctcaattattgccagtaatattagtgacacactcatgtttatatctcaaatatgcttttaattttctgaaacagaggcaaattgctggtgatatcttaatgttttaaggtagttaatgccaaaaggcttggatctgatcttaaactgaatatttcccagatgtttggtagggtgaaaggtggaactgctaacagaaaccaacttcctatccctgttatacttacttaggtgaattttaagtaaggattaattagacattgagaccttataagcagtcaacttcacagctcccagagataaaagctgggggcttgctcagttgtaacataagccatatgttgagaaagcgaagtctcaactgccactgtctccttgcaccttgtttataatgctcctttaactttcttttgaaaatgcaatacttttgaaaatgttgaaaaactactaaaggattagacaacttactgtttttgagtaagtattgggtaaatactaaagttgcagaaatacatccaaaatatttaactcacaagaatgagctcataaatataaaaggacagcttatgaatgaaaagaggaaactgctattaatgtggcttatcctagaccagctttgtactggcagataccctgaggacactaaggctctgaaaactctgtgtctccatgggaagccaggctgcctattataggaagaggaatttagcgcaaattcacagttgtttgcccagattcagtagggactaaagatgaactggaacaaggtcttgccaattacccgtgcttaagggttgggagctttagcttgacaagattttgccacctaaaacagctgttttgtgttggagaccagatggtaattttgccaaaaccacttaaaaggtccaagccatcaatttcaaagcaaatgtttcttatattgggtacatgctcatttttgtgattttttttcatttaaattttcatgtgaatatgcgttctagtttaggttggaggtgttgatgaaatagcagatagtgatgccaagttaagaaactatcaccaatctatgccagccaatgagaaagatctacttctacaaatatagaaaagactaggccaggcacggtggctcacacctgtaatcccagcactttggggtgccgaggcgggaggatcaagaggtcagaagtttgagaccagcctgacaaacatggtgaaaccccgcgtctactaaaaatacaaaaattagccaggtgtggtggcatgcacctgtaatcccagctactcaggaggctgaggcagaagaatcacttgaactcgggaggcagaggttgcagtgatctgagattgcactagcgcactccagccaggccagcctgggagacagagtgagactccacttcaaaacaaaacaaaagactgtacttggtaaaaccaaaaggaatcaatgaaatgcacctatttactaacagtaagagcacaatctatattattaattcttcaaatacgtcaactagttattctgggttggaatccacttgaaataatttttcttataaggttttcctcttcttaggctatttatttattcagagacagagtctcactctgtcacctaggctggattgtaatggcgcaatcgtggctcactgcagcttcaaactcctgggctcaaacatcctcccaactcagcttcctcagtagctgcaactacaggtgtgcgctgccatacccagataattttgtatcctctccacttatcagtgagaatacatatttgtctttttgtgtctgacttgtttcacttaaaataacagcttcctgttccatccacgttgctgcaaaagacactcagatggagggcagtaatgcaatcacagctcactgcagcctctacctccttggctcaagtgattttcctacctcagccttctgagcatctgggaccacaggcatgcatcaccatgcccagctaatttttctgtgtgtgttttgtagtgacgcggtctcactatggtgcccaggctgctctcaaattcctaggctcaagcaatcctcctgcattggcttcccaaagtgctgggattacaagagtgagccaccatgcccgaccattagactttttaaaagtattttatgaatatacatgagattgtcagtatgggttaagatctcatagataagataattgtaagggttaagggaaatgtacagaatctgataaataagtatcttgtaaagaaaacaactggttatatgtttttatgtctgtaataaatttgccagcaaatttgctacctaaagaatttgtgtcaccattttgcttcagtttcaaaggcaaaaatatctctgactttccaatgcggttacgttgtttagtagttagccagcaagggcaactgaacaaaagaaaactgttggttctaatgagcagtactctcctcactcaacatctatgccaggatttttggaggggttacataaaggtgaaaggaaaaaaacaaaacaaaacatgaaaacaattttcaagtgcagccatttaagagtatagtatgaatgtcccttgaactttgtgagtgggaagacatctaaggaaatgtctctgtagctctccttttgaaaatcaatcttaactggacaagacccctggccacaagcctatgcaattagactgcatatcctagtaccacaaatgcaattgttagcagctgtctttgtcaacaggcaagttggagaaacaataaaaagaggagctggtgatgatgaaagaggaagggtgtgaaatggttgtgtgcttcctagtagtctttaagtctccacatacagaaaagaatttgtgctcctccctttagctaaagtgttgaatgactgagaaggcaaagagggatgagaaagctgtttgttgtctagaggaagaaagataggatatcctaccatgtcagaaagctgttaaacactcaagatgaaaacactcatcaggattttagaatcaacaagcagttgtttatatttggatgtttgcagtggaccttattaccttaacatccttgaccaagtttgtgagacaaagaatatccagggtgtggactgagatattggactttgtggttaagggactctttttaaaaaccttttttaaaaggttattatgactgcaaacttgggtaagaaaagggagccaaagtggtccttggcttttgttgtggttgaagcaagtgaatttagaagaaaaagactgagcagaataattctggtttaggcttgggactcttttattagttctcttcctatagcatacaagtcacaagaaatccttcttatgtttcgtagatggcttttatacccagtaaacatcaaatattgtcagtgtgatttttcacagggatacatttagcagtcagtccctcatggtacacgtttattattttgagttgaatatgcatatgttaaataatgggaggattcagcctcaggctggaaaccacgctgaagactgaagaaaacttggggcagtgggtggggagtgctgctctatagtcctgcctaccctggaagggcttctgattttaccccactgagtaccctgggcagagttgagacacaattaaatagggaatacctgccaacagaggaacagcttcccttttcctgtagtgtcccctttcaacttgagaattgaacagaaagaacaccgagcacttctttcttctttcctttttctaggaaaaaatgagtttgccaagttgaaacaagtacttttcacatgagtttcttcagataaatttattaatttgtttacatatatacatatgaaatatgatcccggtgctggtagtacagcatcaggtaagagaggcagatgaggtccatatgaagaaagaagtatgctttcaataaactaagggtggtctcaacactttgggaggctgagatgggaggattgcttgatcctgggagattgagaacagcttaggcaacatagtgagacctctgtctctacaaacaatattaaaaaaaaaaaaattagctgggcatggtggtttgtgcctgtagtcccagctacttgggaggcagagttgggaggatcgcttgagcctgggaggttgaagctgtaatgagccatgatcatggaactgcactccagcatgggtgacagagtgagaccctgtctcaacaataaatacgtaataaactaagggcaagttggatctcttttaacttcaagctaaatatgccatcctcttcatcatacttctcaattgtactacatgatcagagatcagaatgttgaaagagtttgaaatctgcacactaaacatttctcctctaaactaaaagatacctagttcttgtatcagtgcattaagaaataggctcagctacacagtagctataatctatacataaggaaaaattgcttaatagagttctattcctgagttccatttccatggtttgccagagtttaattaagtttctcaagctttttaagggcatgtctatttttatttatttctgttttggttaagttttatttttatttttaaatgctttttgacctgtttttgtataagatagatgtgtatctattcatatacatacctattgaataatagtgactgtgaaatatatgctgtatgatgggtactgaatttgagtctattttgttgaaatatagagacttcaaatatatcttttcttttttttaaaattttgtattatactttaagttttagggtacatgtgcacaacgtgcaggtttgtaacatatgtatacatgtgccatgttggtgtgctgcacccattaactcgtcatttacattaggtatatgtcctaatgctatccctcccccctccccaggccctggtgtgtgatgttcccttcctgtgtccaaatgttctcattgttcaattcccacctatgagtgagaacatgcagtgtttggttttttgtccttgtgatagtttgctgagaatgatggtttccagcttcatccatgtccctacaaaggacatgaactcatcatttttgatggctgcatagtattccatggtgtatatgtgccacatttttttaatccagtctatcattgttggacatttgcgttggttccaagtctttgctattgtgaatagtgccgcaataaacatacgtgtgcatgtgtctttatagcagcatgattgataatcctttgggtatatacccagtaatgggatggctaggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgaccgccattctaactcgtgtgagatggtatctcactgtggttttgatttgcatttctctgatggccagtgatgatgagcattttttcatgtgtcttttggctgcataaatgccttcttttgtgtctgctcatatccttcgcccacttattatgacactaaatttgatgtctatttggatatcatttataagatccttatataaaaacaaataaacagggtttactttgaattttaccaaggaataatctacattgaaattatgttacacacagtttttttcctgatctttaagaattagcaaaaaaagaggaaacatttgcaaaagaaattgaatagtatgaaactgttggatgttgcttattccttatagatgtttacattaatttattaatctgacttgaaaaagtcaaccactttacctagaattaggttttgccattttggtggcaagttgaaaagttgttttcaaatttgtccagtcttttccagcctttgtttttccctgtctcatatttatgtaccaacattttaatcatcatgcattattataaattattttatttcagttgaatttaataattatctgacaacactttataagctagtcagatttgagaaaatcaatttaaagtccttcttacaattcattatatgcaataaataatattaagagagtctttcttctggaaggaatgccttcagattttgacgaataaatgtaaataaaaacatttcttcaagatatgatattgtgcggttttatctagctgaacccaggtacgttaaaaagaagtttaaggtaatgtttttctcaatattcttcttctaagttttaaaagttttgacagtttcagataaaatttgacgaggaaagttagacatttacagttaacatggcttggatatatattttaataatgcatttaataatgtaatatatacaaagtcaagtcagttcaataattttcttttttttcagtgtttcttctcttttaacttttagcttttgcctttccctttatgtcccttgtcctttaatctggatcccagcaatattttatgtgcatgagaactcaagtacatagtagttttaatctatcatctattcttaaataatgaaatttcaacatattccatttagaatcatttactaagacaccaagaggagtatgaaataacacttgtttgtgtgtagatagataggtagatagatagggatatacattatttttatccacttactattctctttgcatttttaaaactctcttaatgtttcctgttgattttgtagcaccaattcccacataaaatgtgtcccttacccatcagttttcattttcaaattggatcagatagatcatgttttttcttaaagggcatgagcactttctcaagaacatactactttaaaacaatgtaagcatttttaaaaagtaaaacaggataatgggataatttctggtcttttctatcaagaggaaacagatcataatgtgccagattgcactcatcctctctaggaatttctttatagatagtttgttaactcaagacttaataaaagtgtttcatgagctttagaaaaacatcttacctaacaatccatttcccacatttaattacaaaaaacaataatgcatatatgttggattctaatatcaatccttagttgcatcttactaaagaatgagtaatgctccctccccacatgtggttaaggtaatagtacctgttcttagaccatctctagcccagtgttgcttttcccatgttatctgtactataatgtcagattttcatgctgagttctaatatttgtttaattactttcttaaaatacaatttttaagcaccaggaaaaccctttaaactaatttctatgaaagtactttctctaacatttcctacaaaatactggctgcatgctttactagtagtcacattgtatttagtagtcagaaatgatgtgtgatgctctcttcttgtatttccaacctatgggttctgttttctttctttgccaagtgtgagttgtggcaaaaataggacatttccatggactttagggataaagaaccacttcagtcttggtaatcatcccaaagggggtgatctgtagtccagaaagccaggaccttccaaaacatattgattaaacatctcctttacagcagaagccaaaaatctttattgccaatattataagttatagcagtgttccccaacttttttggcaccagggactgattttgtggaagacaatgtttccatggaccggtgaaggagatggtgtcagggggattcagtcacattacttttattgcgtactttatttctattattattattacattgtaatatataataacataattatacaactcaccataatgtagaatcagtgggagccctgagcttgttttcctgcaactagatagtcccatctactccataatctcattttggttgctgtcactgcagaaaaccctgcttcacaaagatagaatgttggaaattgaagcaggctctttggtgcttttgtggcaattacaagatattctgccttgactttaatccagaacatatggagatttgaagttgtctcaaatatattttaaagtccactgtcatttgtgatctcaagcagttgatccttttctaacatggacaaagtccattcacctggcttattcataaatgggtcatggatccatttcttcccagtttggggtcttttgagtaatactcaaatgcttttgaaagctgaggtaagtgatcatgtaccagctgtgagaaagaaggccctggctcagcctctttataaatcacagctaatgtttaaaacatatcagaaatcccaatgttcactcatcacccccataattctactttggcttttaatgcagacccttttgctgacttgaacacagttctcattctcccctgaagtgacagattgagtttgttgactaggttgaatatgtcacacaaataggcaagttttgggacccattctgtgtcactgaaatgtgctgccagtggtgattgttgttctaaaaatctctggagtagttctcataactcaaaaactctggccagggatctacctttaaaaagccatctcacttctgtgtataagggaagatgtagctgggcgcagtggctcacacctgtaatcccagcactttgggaggctaaggcgggcagatcacttgaggtcaggagttcaatgccagcctggccaacatggagaaaccctgtctctactaaaaccacaaaaattagccgggcatggtgatgggcaccctataatctcagctacttgggaggctgaggcaggagaatcactggaacccaggaggcagaggttgtggtgaactgagatcgtgccactgcactctggcctgggcaacagagtgagattctgtctcaaaaaaaagagaagatgtgtgtgctctctgtctgtctcctcacagaactgtgcaaacagacatgagttaagagcatgtactttaatgtggttgataattttaatcacatcctgcaaaatgttgttaagttcaagtgacattttttggctagccagcatttctctgtagatgacacagtgcatagactcacattcagaagcgacctctttgacccgagcagtgaaatcagaaagccattttagtcacggcagctactctgtctatgcatatactgacacaaaatgaccaattcagttttcttgatatatattcattcaaagacttgaatgtttatgcagctgtggtgttgattgccaacaaaagtgcacataacaaatcctcatgcacatcctcctgaaaaatatattgcactaaaacaagcattgttgccttgtcaacatcaatagacacatcaacctagactacataccatggtgactcattagtcctctctaacaattgtgccctgatatcccctgctatttcatcaattggtctagttatggtgctagctgaaagaggaacatgtgccaacttttgaactgcagcctcttctgtaagttcatgacaaatgtccttagcagcaggaaggatcaactcttcaccaatagtaaagggtctcttagctgtagcaatgtggttagccactaagaatgatgctctcagtttagacacatttgatgaagtggtgtccttcaatgtttgcttctgttcttcatgttcatctttttttttttcttttgaaaaacttcaaaatggactggcactttgggaggcctaggtgggtggattgcttgaggccaggagtttgagaccagcctgagcaacatggtgaaaccccatatatacaaaaaatacaaaaatcaggcatggcggcacatgcctgtggttccagctactagggatactgagatggaaggatcacttgagtccgggaggcagaggttgtgccactgcactccagcctgggtgacagagtgagaccctacctcaaaaagaaaaaaaaagtagagaaaaagaaaaaaaaagaaaacctccaaagacttgaacttgacttttgacacagggtgcttaatctgcatgtggtgaagaagttttaaaggttttatggcttttttggatagccagtcatcacatattatacaaagcaggcttgcagaatgaatgtgaatcacctgttgcagtgaacccataatttaagtgggactcttgttattttcttttaaatgctgaatttttgtaggcagtcttagaagtcttccgctgttgcatcactgggtctttccctccttcaaagaagcactccagtgatgtttgttttttactcattttggctgggttagcttgagggcttaccaaaactgtgactgaaacaagtgcacagtgcaggaaagaagcatgggtggaagtggtaaatacaataatggatgggccatacatggactaaattaagtgctagattctgacttaaagcctgacaccagatgcagcacagatagggttttgatatgagtctgtaagcaactgatttatgatggtctctgtgcagtcaaatctgtctgctaacgttcatctatatttgcatctgctcctcagtgctagcatcaccacctcagcttcacctcagatcatcaggcattagattctcataagaagcatgcaacccagtccctcacatatgcagttcacaatagtgttcgagctcctatgagaatctaatgctgctgctgatctgatgggaggcagagatcaggcagtaacgactgatgggcagtagctgtggagtggctgcaaatacagatggagcttcactcactcaccaccggccacttcctgctgtgcagcctggttcctaccaggccatggaccagtaccagtccatggcccagtggttggaggcccctgagttacataaatatatagttatggcaaatgaatcaatgttgccatttgtcaagtatacataaatagataaattgtctttctgcacaatcaaatcaaaattcacataccacacagtggaatatatatttcttataagtattatgattacccactaagtaatcatggaaataatctttgaaggaattaagaggccaattatgtattattctataccatgttggaagcttgtcaaatttacaatacacatgttcaaagtgagcctacagcttgaacccctcaaacttattccatattaagtatttaaaactactcagggctgttcatgattagcaaatttgtgaacactttaatgcatcaagtaagactttttcttacaggaaacccaatatcaagatgtgctctactgacccattttattattttccttaaattgaggagaaaagatactctatattataattagttatattaaagaaattcataaaaacctgagtaaatgtggtagacagtttatagcaatgtctttagggtaaatgtctatattaacatgttgatcatttattaaaatatgccatgcagtaactcctctaaccctttatgtggcttaattttttttctctctttataaataaaatgcagtggccaagcccaaatagaatgaattgtttctgtgtaatgaacaagatataaaatctttgcctggctgccaactgtttgtaaatgttagcaggagcctcatggtgaggtagactaagtatttacttaaggctctaagtaacctttacaggtaagtccctcaatctctctggatttcccaatgtcatctattacgaaagagaattggatatgaaacagacaatatctagatttcttcgaaatcttctctgactctacaatttgctaagaccaagccttaaatgatctgaacttttctcactaaaataacaagtattttttaaatttagtaattttagctcaaattagattgatcagaggttttgattgaacatagaagatatctcaaaataatgtaaaataacttagtactttggggaaaaatatgacagttgacatgcttgccaaagcttctgtatcataatagatctaatctaggtagtaagttggcttctactgatgcataacatgtttctaacattattttgcattctggatatattttcccagaagtgataacattgcaatgattgtgccttatttttgcatggtcagtatatgaaactttctgtacagactggcagactttctgtccttccaatgctcgcgagaagacacaaaccacacaaagattcccttgggattttccttaaaatatgaaatgcattagataagaatagagacaaaagtgggatgtggccatgatgctctggcaaaaagccaggatttcgaacttttcagaatttttgaagggttgagttatctactaaaggaaatgaggggaaagaaaaaccaataaattgctacataaaactttatatagaaatatgttttctgatacagaaatgtttacctatcgggaagaattactctctgccttgctcatggctttgttaccattcaaatgaattgtgcaggacttttctaacgtaatcgttcaggcttcttttcttaacttttctgtcttgtaccatttcccgcaatttatcccattgcaaaatgggatcaaaagtcagttatcttgggtcacagcaaatgactcaaacatgtaagtgtttccagtagttgttgtttttttgtttgtttgctggattgctggtagttgggaataagggtagagtttctatctccaggggaacacaagcttttctagatctttattttacccaaaactagcgatagaatcatttcacactttgtgaattcaatttatatcagcacttattatgaacagttctcaagaattacaaatccatttctgtcctagacacgtgtcatttgtgtctcactgtgaatgtatcctaagaacagagaggataatgtttgaaaacatgacattattacaatattgataagtaattatttcctgaaatatttccataatgttaaatacatttaaaaaatctctaccagtgaggaaaaaattagaaaaaaaaagtcaagtttaccaaatctattgatctagcacagtgttgtgaagaaacctattagatggtcatctgcaaatatttgttcacttatgatcactgtgaaagatctggagtcatatttcatttgtaataaaaatgcagtaagaaattgatctttaacacactttaacaattaatttaccacttaagaatattgtccctatattgcattgtaagtttctgatacttttaatgttagatcaatgacaatggctgaatgacaatattggttaaatatagtcttaaattgacaagtgttttgggatctgccactgtactcatcaataaggctaagctaggcactgtatttatcctatgacttgaattatcaggtgagaatgtaaaatgtcattttggtatttagcatactgtgaaagatatatcatcttatccagagatagaaaggattttctgcaaattcagatctcatttctatctgtaattccaaatgcatgtcaagcgtattgacagaactgtggaagatagagaaactaaataactcaaatacattatactaaaaaggcaaccagagtgtataatggtaggaggtggactagacatagattactgattagcccagtctagtaccctccttttaatggcaatgagatcattctagagcaagtattaatacatgctttcaacactgggtgtagggtgaaggataaagtggagccctattgctttgagacaatttcttgaccatgtgcatatatttaagggggccatatagtcctttaattcttggtgttaacacagttagccctttgaaaaagcccataaaattcttatgagtagttgaaggcacttaagtttccaccaacatttccacacttttaaaatggagaagaaaataaagattctgatgactatcaacaacaatgcagtatatctgtacacaaatcccaaattcacaataccatagttatgtagatgttaaaaatcccatacctgttcaaaaatgaggttactaattttccacattgtttaaaatttttcttgttgttaagctgccgctattacttgtgtgtattcctgtctgtggttctgcttctatgcacacgttctgtcaatgcttttttgcatcaaagctgtgctttgtctctgaatcatattgtatagaacagtgtgtggtccttggaaaagcagaatcagcactgtttggaaatatgccaggaattctaattctctactccaatctagaattactaagtcaaaaatcccagcaatctgtctttaagcaagtcttccagatgattctgatgcacgttcatatttgagaactattggtatagaaggttggttaacttgccactattctgattgagcacacagtaaatatatatttagcacccactctctgagattctttgcaaccctatgagctataggccagcggtccccaacctttttggcagcagagactggtttcgtggaagacaattttttacacgaaagggaatgaggagatggtttgtagatgaaactgttccaccccagattatcaggtattagttagattctcatatggagtgtgcaacctagatcccttccttgcattgttcacagtagggttcgcactcctgtgagaatctaatgctgccactgatctgataagaggcagtgctcaggcagtaatgctagtgatggagagtggctaaatacagttgaaacctcgctctcgcttgcctatggcttgcctcccgctgtgtggcccagttccaatattggtccatgggacattacagttcccataatgttttgaggcttcacttcatttaactttgtttcatttttaaagagaggtaaaaccacatttagagccatttagactcacactatggtatggccacataatcccagaggtattagtgaaaatgtgataacaaccccaaggagctccctaagtccttctgtgctaggatataatagatgaacttaggacactgacaacaattcttgggagagagaggtttcatttagagaggttagtatttgtgtcttacattgtgctaactatgatatgtttcagcaccttgattaaaactatgaaactatatagcattataatcaatttcaagttaaaatgtttagagaaaaatagatgtgactgattctgaattaatgagactttccacgtttcacaataatttttttttggaaagtacattcctcacccagaaaagcaccactaccactcaatgaagcagaacctttagttttagctagtggccacctcaaagtgccattgggggaggtggggagaaatgtggctcaagcacttgagctctttctctctccaagcctgtttttatgcatgcactttctctccctggaatgttccttctcaacttcccaaatcccccctattaaaaccctgctcttgaaaagtcacctcaaacaccagctgtcttcttcaggatggcttcactatttaaagtaatgtataacatattttatctctcataccacacttaatatattttctttctggtttttttttttttttgtattgtcattacttatttgggtctttattttattgagctttaaaactccttgaggcaaggaccacatcttgtttgcctttgtaaccttcagaatgagagctaacacctaccctgcacactggtgcttaatacacattagctgaattaatttactcagtctatagaattccattgtatatttatgttctatttatctaggagtggatagaaggattttgcacttatttttcacatctagttttccttgtctatatccattctattaaatacaagttttatttgccatatactttctccttttgtgtttatggaaaaatatttagtgagaaacttaccctccagaccaatagctttttcattctaatagcaccaaaacagaagaagcctttgtccaacatgattgctagggggacaataggtcagatgctcctcttctggagaagaatgagaagcagcagctgggaaagatgcttgtgaatggccaccttctcagattaactatttagtcactcatcaaaacattaccagcccaaacaattatatatatgagtattaaaagaaaaaaatgcatttacacgaaaattgtgacttctaagttatttccactcagagattatcaagtcacaaaattttctccattactaaggtgatgatgcatcatgagggaacattcgcaaagtaatatgaactgatttttgtcataatcgcttttgtaatgttgactatcaaactttattttttaagattttaaatataatctaaaataagctttatagattgctactatttactgaagaaatttgctaaatattactttatttctaatgtattctttaaacaattttatatttgtagacaaaatccttcctagttgccaaaattcttagaatctgcacaagatgtttactaaactgagtctcattatctcccaacttcacttttcccagcttcctgacttgttccttgtactccagttggtaaatcaaacctcttatgatatttgaaaacaccatactgttttaccttaataatttgctcttgccttcccacccttcccagccttcccctggacacttcttaaccttcatgactcagttcaggtctcatctccaacaataatttgatcgtggaaccccagccagtatgacctgcctttacctttgccccatagtccccttgtcatcatcttaagtcatcacttactgccatgtaacatgttttattgtaattatctgtgtttgtcttttattcccaatagtacatagacttatcaatagaaaagccattacgtatttgactttatattttcattttctaaaagcgtacccttctcctcctaggtcttcctaagtgattgaactaaattgtccaaagacccttaaatagattcacaatactacctgggctattcatgttttaagggacataaaaactaatatagttacaacttaatataaataatagaatttcactacaagaatatgcctataaatttacaaaatatctgttttacatgaatgggaaatataattcatgtgtcctttcattaataatataattttcaggtgtttctttgagttaaaaaaaaaaaaacctttttttatagcttttaatgttaaggtaattgtagagtcataaacttgtaagaaacacggggagatccagtatgcccttaactcactttcctccaggaggctcttttaactggcatttagttttgattcaaaatatacacatatagaactataagctactgatccaacaatcctcaaacaaaattctggagctcctttccaaaaataatttgataggcaaacttgatcatcctcaccaaagaacagaaaaactggagtgattccttacaaaaagtaaagaagtcctctaggcttcagtccttcagaactcccctttcacattcacagatgtttataataggtgcagtcattgtccattactcacaagatgatcaaattataacttgcctgaccatacgctgcgtcccaaaattattttcaaaattcgaaaggatattaaatcacctatgtcttccctctattttgaaacaataactaaataataatataaaaataatagctaaacctttttaagcttgcctaaactagttgcaaagtggaaaaaaaatggttgattgagtctttgaatattgtgctcccatttcaggtaaagcagaaagaaacaaaggggtatctaagctaaatataatctacaataccacttgcagttcatcctcagaaataacgggtcaaaaattcagttgtatcttatactattactatagctcagtctgttagtatagtttaatcccaggacgttgcatgcaccttcacaaatattggtttattttttgcttaaaatcatccttcattcctctttgttctattaattttcagtttcaaaagtatacataagagaatatcttgcagtttactgacagtactttcttgtcttttggccagacaatgtaagcagctgcctaatcttttgcccctgaattctacctcctgctctgctctgtatcttctgcttatgacataaataaagtatgttagattttgttctctaagattcagacgttatcctctatggcatgccatcatccttgggaggaacagcacattaagtcattaaagaaaattatcttgatgagtcattttgtcagatggtttgcaacagggttcccttgtaggaatgggaaagaggaggaagatgtgatggagaggcaaagtagtcagagatggggagcaatagagtctaaaagtcagaggcttaagtgttaacatccattattaccgacctttatcaccttaccacctgtgtgtgtgtgagttaaataacctaagtatcttccgtttttatatttgtaatcgagactaacaacagtatccttagagggctattgtgtgaattaagaaaatatttttcagaatatgcaaataaatgtgcgtgtgtgtgtgtgtgtgtgtgtgtaccttagggaaactaccagcataagggaaatggatgtaaaaaaacacaaataatgtctccttcatccttcacaatctttccttggttttggcttgcaaatagagtgagatatatctcttttgatgaaaaggagtgctgtgttaggtcagagacttcctacagatacatggacagaagggtctctgacatgtagtcttggcaaagtctctggttatgtcaacttggcaacaggggaaactcaagcatttctattggcctccataaggctaacctgtgaaggaataggaaagaaggtattcatctctcgagaataagctaagccactctatctctatgggaagagtgaaaacatataatctgtagactgcattggggatggtgtttctcatgatacatgacaaatgataatatgctcaactttcagatttcatgtattaagccaatgggaatttgtatgtattgttcaggatttacatagcccattgaagaatttccaaaatctagcactgttggagaaaaactaccctctgatgataattaagaagatactaagctccaggcaaattctaataattttataggtactatctcatttaatattcacaacaaaattatgagggaggtactattatgttgcccattttgcaaataaaattgagtcatgggacacttcagtgacttctcctatggtaattcactaataaatgtagagccaggagttgaacccagacattttggctccagaggccacatgctaatcacgatgctacttctctaccctgaacaaactgctgagagttatgaaataagtagttttagttccctaggtcttcttaaactaaaatgggtgggcactttgagtagacgataaactgacttccctattgtgatctacaaacttttccgagaaaattatctttagatgcagcaatcgaaacttgtgtataaggggaaaaggagctcttgtctacctcttactacttccctcgattttccatttttcctaggaaaaaaaaaaaccttaaaaatccatgtttatggattttcccccaacacagagcagtaattctgctatttcagggacagtgcagatgttgggattagtctccctgtatctcagaatgtcaacacatttgccaaaaatgaatctatcagttaaatgtagccaagagatttagattatctatatcctagcaagaagaaatagtttatcactgtttttagagattgaggtaatctggcatattattgacatgtgctacagatttaatttaataccatagtacagatatgggctctgataagttattttgaaatctaggctaagatgagtagagttgtttcaatatttatagggttgaaaatgcagagttagcaaaggaagcattttaattaaaacaatattttctatgtatgctcagagtaaaatgaaggggaattcttttaaagccttattacttttttctatatatttgctggaaatacttgccgggttttaagacacattgaaaaagatttgcttgtttgcttgtttgtttaccaatgttttgtgccttttgtttttagaaccacacaaaaaacaactcaatagtttcttttgattttacttttcttccaaatatatttaggattctttatttagccttttaaaattgtatgttttaggcatcctggagataacatcagtagaaatcggagttgttgccgtcaaagccattaacagcaactattacttagccatgaacaagaaggggaaactctatggctcagtaagtattctgcttttgttttcaaatccactccagtaaaccattaccatagttttggaaagtttcctccagacaccgaatagctttgttatccttctattgctagtaaatagagccacagtgggttagtcaccactgtttcaagggctggcaaagcagctcttccaattctgtaatctcctctgttgttcacccattagtctaccacacaggctgctgctggcatttgtctgtgaatgttctaaactgctaaccaagtcaggctctcacggaagcatccggtcagattggcatggaaaatgaagacaacttggagaaaaaacactaaaaacaaagatcttgaattgagtagaaacccatgtattatatatgcgttacggctgaagatgaaacaagggctcagatgttttgcattttgttaaaatctgaaatggggaaatgtgtcaagaaacaccattttgcttgttgttcaatcaactctagaattttatttacctagacaataacctttaattcaaattatgcctcaaaatcatatatatatatgtgggaaatattctttgcaatagggtccttgtggagcaggtatccctgcagtgctttgggcacatccatgcctatattccataccaggtgttaagtatttggaataccacttctgcaatcttggatcaaactcttttaaaccaatttcttagaaatttaagatctcacttaaaatgccaaatagttgttttataattgcaattgtaataataattaaattacaagcagtgagacaatttatcctgctcaagtccttagaaaaaaatgcatcaatcaatcatatcaacatctactatatgccagatattgtttgacatatcaaagatgcataagaaagaagtatagaaatgggccttgacttcaaataatttataatatatttaggggaaatgttaacaaatatgaaataattacagcatgattggttgttacatgtatgaaaggatcagctatagcaaagcagccctataataaagttgggaactaggtttcaatctcttagctgtcatttgaatgatgacaggagtatattagtttgtgcatgtggatccatcttattgtgtccctcccagagacagatcaaggggatgctaactgaatttcatttttttctctggattctactgaaggggagtgtattgaaggcaactataaacttggaaaaattttaatttaattttttggaggacatgtaatattatatatggccagaaataaaacctgtgacacaaatcttttaaataatttttacttttgtaaacagatcctgtgtcatttttacatttttatgtaatcaaaaaggaatttcactttaaatttgtaaataaacttactttgttgattagcataaggctgagagaaccatttagaaccatttagtgaccatttagaaccagcagctcttaaacttgagtatgcatcagaatcagtggaagggcttattaaaagacagaataatgggacccacagccatattttctgattcaataagtctgtggtgcagttcaatttccatttctcacatggtcccaggtgttcctgatgctgctggtgcagtaaccacaatttgagaaccgctggtctggatgtagagtagccttgtattttactaatatcaggtccacttttaactggggagtcaggcatgctttgagttggtccctgggactagggcaaatgcttttttttgcatgggggtcagaggaattttagtaaaatttctccattaccattgctcccctaatgaacccagaggaataacagaccattataaaaagtggttccatttaggggttcacatcataatctcttttgaggcatgtttaatgttttcattaaacatgtccaggttcttccttgatctactatatcagaattattggggaagagaaccaggtacatattctttgaagagataacaacacacatacttagtctagacccaacgtcctaaagccagctaacactaatttagattaaggaagaaaatgtaaataattttaatgaatataaaagattttaaatacttttaattgataaaatatacttatttaaaaacatgacatcaaggagaaatggataactttcaaataaactctgacataaaaatatttaatacttttcttcacatttctcctctttttttcttctgccccaacacagctcatggactgtgcttatgcttcatcttgagctctaagctctgtgaattatttcattcaaattctttatttaaagtagagtccggtggctttctattatctgcagtggcacttatctgagatttctctcattaatgtgtttgttgttcactgtcttctcccaatagattgtgaccttggagagagtgaggtcagtcttgtcccccactatttgttcagcacttagaaccatacagagcacagttatacactgcataaacctaacctctggtagaagctcagccaattacagaacatactttccacttccagcctgtctcagaaagaaactcattctctaaccataacattcttttttgtgtaactttacatttctactaggaataatgaaaaattatggtttgttcaaattaaacgaaaaatttattcaagttcaatattctgctcagagtggaatagaactaacatcaaaatttataagtgcatatctaatataattctgtatattaggtgacaactcttgtaattcctaccttcattttttgtttcatacagtatccatcaattccgtaagccctcctaaaaatctgacttgggcaaagattcagactgactgattaaaccagttttatatctattctcttgaattatcttcctctattcctttttggaaactgtatacctttcttatattttcattattcattctctaagcaatttatctattgtattttgagttttctcctgactgatgggattcagtaaataaagtataaaactgaattaaatagaataggtcttcatagagcatgatttaaggaccaaagaaaattttcaggtagctggaaaaaatccaaacttcttttaaaaaaactccctgaaccctgcttttgagtccttgctgtagcctgaattttctttttatacataactgcttatgatttgcttagatcctgtcaacaacatatattttgaggcccctcctctagagatttggtacctttggcccaaatatttaaaacatctgaaataaaaaggctgatacatgtgcacttcaatttaagaaacattactctataaattaattttggggaggaaaattaacattaagcatacactcccacttttctatacctagcttcatctgaaatatgaaatcacctcaaacaatctcagtccttcattagtctctaaactgtaccccatttattgattgaaatgaacataattatccatattttaaaaattactctgctttgaaaagtatatagttttagacagactgagataaagagaataaaagtaaatccacactaaggatttatattcctttcaaatacagaattatttttgttttatcaaaatccttaccttaaataatttacctttccttcttactttcagccagttaaatcatcatttgaatgttatatttaaatattactttatagaagagaagcatttaagactaaaaaatttcaggacagataacttgagctggtagcattaacatagaatacatctgcttcttatggttctgataatgttctaaactgtgataaatcctacagacacctaggtatataaacatatacattttcaggaatttggaattttgtagaaatttcaaaaagtctcaaggtgagagaaactgccaagtacagtcctcaactgaactatgcccacggggcccttgctttggatgaagaagatagaaccagagggcaagtgctccaattccttagcttcttaactactttagtttgagtataagaaaagaagctacttctctttttctgtttgtttttgttttgttttgttttgagacggagtctcgttctgttgcccaggctgcagtgcagtggaatgatctcggctcactgcaacctccgcatcccagcttcaaactactctcctgcctcagcctgccgagtagctgagattacaggcgcccaccaatacgcctggctaattttttctatttttagtatagacggggtttcaccatgttggccaggctggtcttgaactcctgaccttgtgattcgcctgcctcagcctcccaaagtgctgggattacaggcgtgaggcactgcggaggctacttctaaagccagagtcttgagatcattgagctacttcctctttgttattaactccagagtaagaacctggatttgtggagtgagtgagagcgaagccttgtccaggaatgtctccttaaatccaattggcctcctgaacaaaaccaaagctctatggctatgggatggaacttcccaggatccaagtccttaagatacaatgtaggcattgctattcaccatgctcataatttcttcaacatagtagttcacaaaacgaggaattccatgtcctagttttcaatccctagagttcacgagcaaaatctgtcaaaattccaagctatagaatattgcaaataatttcattaaattaagaaatttgatatttggaagaaagacatcccccccttttggttatgcagaactattgtggttttgctataagctctgctttcttatgaatgtgtgtgtgtatttattatggatttgtaggtaaagtttgcaaacttgacaagcccatatctttccttcagttctattttttcccatggggcccctggttattactgtaaaagaagcattataacactattctttattactgactcatcacaaatattgttagtgagatgtctacttcttgacaatcactctaggcacttaaaccatataatattcaaagcacatcagctttttaaaagggctttcaaaaagtggctatgatgatcaattaaaatgtatcatgtgctttcaaacagaatgtgttttgtggttctgagatttacttttctattgttgacattatgtattaagtgcacaacttaggtacaaatggcaactacaaacagaatccttggactggagttctctggatggcttgtatcaaatgaaatcaagtacaatcaccataggaataaaagattctgtttttcctttgcagaaagaatttaacaatgactgtaagctgaaggagaggatagaggaaaatggatacaatacctatgcatcatttaactggcagcataatgggaggcaaatgtatgtggcattgaatggaaaaggagctccaaggagaggacagaaaacacgaaggaaaaacacctctgctcactttcttccaatggtggtacactcatagaggaaggcaacgtttgtggatgcagtagaaccaatggctcttttgccaagaatagtggatattcttcatgaagacagtagattgaaaggcaaagacacgttgcagatgtctgcttgcttaaaagaaagccagcctttgaaggtttttgtattcactgctgacatatgatgttcttttaattagttctgtgtcatgtcttataatcaagatataggcagatcgaatgggatagaagttattcccaagtgaaaaacattgtggctgggttttttgttgttgttgtcaagtttttgtttttaaacctctgagatagaacttaaaggacatagaacaatctgttgaaagaacgatcttcgggaaagttatttatggaatacgaactcatatcaaagacttcattgctcattcaagcctaatgaatcaatgaacagtaatacatgcaagcatttactggaaagcacttgggtcatatcatatgcacaaccaaaggagttctggatgtggtctcatggaataattgaatagaatttaaaaatataaacatgttagtgtgaaactgttctaacaatacaaatagtatggtatgcttgtgcattctgccttcatccctttctatttctttctaagttatttatttaataggatgttaaatatcttttggggttttaaagagtatctcagcagctgtcttctgatttatcttttctttttattcagcacaccacatgcatgttcacgacaaagtgtttttaaaacttggcgaacacttcaaaaataggagttgggattagggaagcagtatgagtgcccgtgtgctatcagttgacttaatttgcacttctgcagtaataaccatcaacaataaatatggcaatgctgtgccatggcttgagtgagagatgtctgctatcatttgaaaacatatattactctcgaggcttcctgtctcaagaaatagaccagaaggccaaattcttctctttcaatacatcagtttgcctccaagaatatactaaaaaaaggaaaattaattgctaaatacatttaaatagcctagcctcattatttactcatgatttcttgccaaatgtcatggcggtaaagaggctgtccacatctctaaaaaccctctgtaaattccacataatgcatctttcccaaaggaactatcaaagaatttggtatgaagcgcaactctcccaggggcttaaactgagcaaatcaaatatatactggtatatgtgtaaccatatacaaaaacctgttctagctgtatgatctagtctttacaaaaccaaataaaacttgttttctgtaaatttaaagagctttacaaagttccataatgtaaccatatcaaaattcattttgttagagcaggtatagaaaagagtacataagagtttaccaatcatcatcacattgtattccactaaataaatacataagccttatttgcagtgtctgtagtgattttaaaaatgtagaaaaatactatttgttctaaatacttttaagcaataactataatagtatattgatgctgcagttttatcttcatatttcttgttttgaaaaagcattttattgtttggacacagtattttggtacaaaaaaaaagactcactaaatgtgtcttactaaagtttaacctttggaaatgctggcgttctgtgattctccaacaaacttatttgtgtcaatacttaaccagcacttccagttaatctgttatttttaaaaattgctttattaagaaattttttgtataatcccataaaaggtcatatttttcccattcttcaaaaaaactgtatttcagaagaaacacatttgaggcactgtcttttggcttatagtttaaattgcatttcatcatactttgcttccaacttgctttttggcaaatgagattataaaaatgtttaatttttgtggttggaatctggatgttaaaatttaattggtaactcagtctgtgagctataatgtaatgcatt

SEQ ID NO: 14854 - DNA, 8848 bp, Human
aaataaataaataaataaataaataaataatataattttaaaaaaagatacaagaaaaggcaaacagatatgcttctttctgcattcagcaagccataaagattcctctaggagcggtaccctcactgtaccagggcaagaaaatagcccttgtcacctgagactaagaattggggactgcaatggacctgaataaatatacttaaccctgtcttccactaagtttatgcccctcatattatctcctagtgaatcccctagaatttactgccctagccagatcccctttgtcctgccatttcttctcaaatttgtcatcctttgtctaaaaagtataaaagcatcttgctttggccacttctctagacttcactctggtaaagatccccatgcgcatgtaaaactaataacacttgtatgcttttctcttgctaatctgcccagtgtcagtttggtttctagatctaggcaaagagcccacttaagagctaaaggaggattggggccaggtgtgctggcttacgcctgtaatcccaacactttgggaagccaaggccggcggatcacatgaggccaggagttcaaaaccagcctggcacacatggcaaaaccccatctctactaaaaaaatttaaaaattagccaagcatggttggtgcgcacctgtggtcccagctactcgggaggctgaggcaggagaatcgcttgagccgggaggcggagattgcagtgagccgagatcacactactgcactccagcctgggcgacagagtgagactccatctcaaaaaaaaaaaaaaaaaaaaaaaaaaaacagctaaaggaggagttcagggtgatctctagctcctgccaaatccccaaatccaaattagtaagtgaccccacagcttaatcttcccttctcctaaatcccattggcacactcccttcccctaattctctatttacttctctgcttcccgcagtggactccaatttccctgagggtggacaccatgtccgttctctttccttgtctccccagtgctaggcatataccaggaagctttcagtacatgtaggacaaatgaatagttaatggacttgaatcaagctttacagtataaaagcactttcaccatctcaggtgatccattgaaatagatagttgcgtttattttatagttgagtaaactgaggtgcggaaggtggaacaactcacctaagttcaccccctaagcctcaaccttagcagtgaaactcactaaaagacattaaacagagccaggtgtggtggcccttgcctgtagtcccaaggactggggaggctgaggcgggaggattccttgagcctcggagttcgagtccagcctggacaacatagcaagactccatctctttaaaaaaaaaaaaaaaagacatcaaacaccagcctccagcacacttagctttgaattgaagatgactgagttagatctgtgtaccaaggcttccatattgtgatgcagaaaagttaaggagctgaattaagtaggttctcaaactgaaccccggacttcgaagctggttccacggttttataagggccacaagaggccatctagcccaaaacagctaactttccaaaccgaaactagttcagaggaaatcactgactcaggtcagctttttattaaggaaattaattttgtaccgtgagctctagaagccaggcatatgatattcagacagcactggattcagaactatgcagactaaggtcagtagatggtaggcaggtctatcttctgcagctgcagggtgcttgactccaattaaacatcaataccacatcaggagctcttatgccataaccgcccaacctctcccagccgagctgatcaccagaacctgcgcgaatctctccacggtcagccccacccagggctcaggctccgcccccgggcctccatagccccgcccaccgcccacccatccagcaccgcccttgttgtcatggtgatctccggctctccagggtgtccaggagtctctctgctgccagccccgcccagactccaggcaggttctcgttgctatggtgatcgccggtgcaagctggatgcttggacgcgccgctgccagtccaacgcagaccccgcccacgacgtcgacgattcgtgtagcccgcaggtcccgcgtggctctcgttgccatggtgatcgccgccgctggctcaggcggaccaggccgcgcggagccccagctttcacagccatcgctggtgagtcagctcgcccactctgtccgaccctcccggtcacccaaccccgtgctggcacatcccgaggccagggccgcgagggcacagcgtccgcgcccacttcccgcccctataacttgaaagcggcctgcggccccggggcgtcctcatttccggagcgcaaactctgggccaggcccgcgctggttgtggaggagagccaggtcagatgcgggaagacaaccggactccgccaggaccaccccagcccagcctggagaggagtccggacagaaaaaggagacagaggggctgttgaggaggctcgaggagtcagaggcctggtgaagtgagggttttcagggaaaaggcctagttggctgaaagttaaggcccccaggcccacctagagccttcgtcctttgcagactgggagcaggagacccctccccactctacttccactgcctgagctgtgccatgcctcacagcccagtaaggtaagctcagaggggagctcctccttggtagacacctgtcaaggggagacccaggtcttctgactcccaggcagggtggggcaggcctggttcccccataccatgctgcctgctgtatgcagattgagagaaatggcctctgccccatattcctgacagagagggaagcctggatctggttttatttataattcttgagacaaggtcttactctatcacccaggctggagtgcagtggcaccttcacggttcactgcacccttgacctcccaggctcaagcattcctcccaccttcctcccaagtagctgggactgcaggcacaggccaccatgccctgctaatttttttgttttttttttgtagagactgaggtttcactttgttgcccaggctggtctcaacctcctgggcccaagtgatcctcccaccttggcctcccaaagtgctgggattacaggcatgagccactgcacccagcctggatctgatgaaaagttaggtggaaactcatgggtgaatccccaggtatttgcacagctccttaactgtctttctcctggttgggtccacaggactgtggaagaatgaggtcctccctgacacctttggggccccctgtgagccgcgaccgtgtcatcgccagcttccctaaggtagagagtcattacgtctgcagtgctctcctggccctgcagccacatcagctctccccactctacactcatgcctagaagtaaagcaggtgaatcaaggaggtctgtccattgtcagatttaccttgaggagctgggagactggtcactgactgcccaaggtgggaccacaagttaatggtgacactgggcagcagtgtggcctggaggttataagggctgggattttgcagccagacagtccttgatgtgaatccttcattctgattctgtcattaagctgtgtggctgtgggcaaattactcaacctctcagagccactgttacatgaaggtaattcctctcatattgggtgcctggctcatggtatgcaggagctcccctgcagtcatagttgctgttgttctcatcatcgttgttgttatcaaaacagcattccagttccatgaccccaaatccagggctctctcctcttgccattccgcctctgtgagcttgaaaactcacagctctcttgtgtctgtattaaaatccaatattaattgcagcagggaatacaaattgagtacaacctccatagggggcagtggacaatatttaccaatatagaagatgaccctgccctctaagatccagccattctgtttcttttttcttttttttttagagacaggatcttgctctgtccacccaggctggagtgcaatggtgccatcataattcactcctctaactcctgggctgaagcaatccttctgcctcagcctcccggagtagctaggaccacaggcatgtgctaccatgcctggctaatttttaattttttttaatagagatgaagtcttgctatgttgcccaggctggtcttgaacccctggcctcaagcaatcctcccacccgggcctctcaaagcactgggattataggtgtggaccaccacaactggccttgctattctatttctaggaatttacttggcagatattctggcatgggtttacaatgtgcataaggataggggttggagcagtttgtaagaatagaagataagatacaacgtaaacatcctcggagaggggactggttaaacaagtaatgcttcctggcacagacatgaggaagaatgaggcaacctcttcaggagctgacatgcaacgagagccaaagtaaaccgttaagtaaaaatgcagggcatggaacagagtgcagtagagtgtgtgcagcacactccggtgtgtgaaaacaaggagagggagaaatgtctatttgtttatatatgcagaaaatatttctggcaggatatataagcccctactctcagtggttgcctctgtggcttcggacaggtgcagagggatagatcctctccatggaatggccttttttgcatcttggattctgtggccaggctggtgaggaggaggtgactctagacaggtcctgggtatttggagtatgtggctattcctccttcccccttctttaccttcctccctaagttccttcttcacacacctacagagaaaggctttgtgtctcagacctgtggacagttccccatgggttttccatctcaacagaggctcaggcaattattctctctgcagagcttgacagtggtaactagggatgacagagactggtctttcttgagtcaaaaggaaggaaagtgtgattggcacaaaacagtccaggtatcatgagatgaagaacctcattggcagagcagacggcgaggatcagagttaaggagggttgcctgacatcacacagctgctcctggtacctctgggatttgacctggccgtgtctggctccagagcaccctaccccagggaagcagcttagggaatccatcctggtttcacaggtggcattctcccctcctgcccataatagtcagggatcaaggccactgctggtcaagttcatcctgcaccccagggccctgagaaattcagtcaggttgagcagggtcttcagactgcttgccaggcaagtccttccctttatgccatgtgcctcagtttccctgtctctgaaatcagctcacacttcttaccctgcagccttcattatcacagtcttccagccatcctgtaatgaccattgtgtctgggccagtccccagcttaaagctgtcatggaagctgacagaaagaagcagccagcttgttcatggtagctgctgctcttctgcaggaaagtagactatcaggctaagctgctcacctgcattattcagttactcctccaacgaccacatgaaaaggtgctattatgagcatccctgtttaatatttaaggaaactggagctcgataagtttctgtaacttgccctttgccagtctcctttcaccatccctgctgcctcaatcacagctggaactgagagggcagatgggccaggcagagcccgaatccatggttgagacactgcggctgagggaggggagctgtggatccaagcagtgttcagagggacagagcaggtggctgtggctgtgcaggggcgggacccttgccatacacagatcacaccaacagcctcaatggtgtccttctccccacatccttgccacattctgtatttagcctgggccaatccaatggcaaaaaataatggtcatctttagtttgtttaatctcatttttttctaattacagaccaggtgagggtgggtggggtacgtgcagttttttctgaccctgaggcccatgctcttaaaccactgctcaggtctgccttccaagaaacgtggacagcagaaagcgcctcctaggacattttccaggcacatgtatgcatgtttttaaaacaaaatgtcatcagagattcatagaaggtatggattagagacagggtctcactctgtcacccaagttggagtgcagtggcatgatcatagctcactgcagcctctgtctcttgagctgaagcaatccttccacctcagcctcctcagtatctaggaccacaggcatgtactactgcacctggctaattggatcttgggaggatcttggcaccaaaagagctccactcgtctcgccctgagagggttgagacccagagcagacaggcctgtcacatgcatgcagcaagggaactgcggccccaggtgagacacagatctccaagtccctgcctgggctcgcccctctggactcacaaggccccagagcctcaaggctgaggaaatagaagatacacatgacaaatgggtcagggaaagctaatgaggctgccagctgtgaggcctaggaaggaaggctgggaagatcatctcccctcactgcttggctacgagggcggagccacagctttgcaggatgatgtgtccgtctgtttgtctctttgcagtggtacacgccggaagcctgtttgcagctcagggagcacttccacgggcaggtcagcgctgcctgccaacgcaggaacacggggactgtcgggtgagcctgcagggtgtgggatgggggagcaggtggcaagaaggaatgagtgcatgaagcacgtgaaagaatgaacaaatgaaacacacacacgaggctggtgcagccctgtacaggcctgaagatgactggggttttcttttttttttctttttttttttttttgagacagagtctcgctctgtcgcccaggctggagtgcagtggtgcgatctcagctcactgcaagctctgcctcccgggttcatgccattctcctgcctcagcctcccgagtagcggggactacaggcgcccgccaccacgcccggctaattttttgtatttttagtagagacggggtttcaccatgttagccaggatggtctcgatctcctgacctcgtgatcagcctgcctcggcctcccaaagtgctgggattacaggtgtgagccaccgtgcccagccagatgactggggttttcatctggcttcagttaacacacctgccatatggaacaactttccctcttctaagtcacgcaggtgatttttcagcctcaggtcttggtacaagttcatttcctctgtctggaatgtctttcctaatcccctcgcttccccttccccttccccttcaggtctcagcgtgtcaagtcctctgggagccttctctgaccccccactacccttgcccctggactggggagggtacccctcctgggtgctcttgtgcccccaagaacttatctcacagaattgcaggctggattcctcactagacctagcccaagagggcgagggctgtgtctgtcctcttcctgccgcggcagctcctgccaccactggcagagggattgtgaaatagtcattccttcttttaacaaataggtacaagggcctgcttttgcccctcttcctaaggagctcatagtctgctcagggagttggctgagctcacaggggtcacagaggtgcgatgaggctgccagagagcgcagctagaggttcccaaactgcacagagtgggtgaggcagagctgagatcagaatagccgaagtggccatggtggtgggatgagagtaatggcatctgttggggaatgctggtgccatatcaggtgcttcacacagatgatctccctgatcccttatggcagcactggaggtggggaaactgaggatcagagggtacctgctgtaagaccttgtcaacacctttactcattcataggagaaatggagtcagaacgaaagggccctctgggagcagggtagacacaatccctgctctcacggacctggcaaggtgacctgcagcccaggtcaccaggtgacacagtggtgccctcttgctgtctgcaggcagaggaagtgcctgtcagatatttacccaggttggttgctgtgaccatttggctccttggggatgagctgcaaaaactcttaaagtgttgtcaacagtcccaggaagctgggacaatggcacctgtagtcccagttactcaggaggctgaggtgggaggatcactcgagccaaggagtttgagactactagcctgggcaacacagcgagaccctgtctctaaaaaaataataaacagtccgagaaacgcctctgcacagagtgtaggacacacagagggtgagggtggcggctgctcttggggaacagtgacccacagagagcccaagaacctcagagccgatttgcctcaagccacagcccggatgcatagagcctcagccctgttcggggtgtgccccttggcctgtcggacccttacagatctctaagtgagcagggcacggtggtgtcatggtcagggagtgcctgcttgcaagaggccggagcccacatcggcgcacagccccgggggtgcataggagggtgaggggctgcccgtcccttttgccggggtctccctgcacgtggaccctgtgtctgcaccctcagcacagctcccggacagcacagacgtgcccacggctgttggttggttaccacagccacaccctggcctcctgcctct

SEQ ID NO: 14855 - DNA, 72504 bp, Human
  misc_feature (1)...(72504): n = A,T,C or G
ctcgggaggctgaggcaggagaatcgcttgaacccgggacgcagaggttgcggtgagccaagatagcaccactgcactctagcctgggcaacagagcaagactctgtctcagaaaaaaaaaaagatatcactgagtgatgccttcatttatttatttactgcatttggctgctgtgtttccagtctcagttgcaattcccacactgaggctctcccacccttcctgtgtcccctgagctgagcaggcacttcctgtcctattggaaatgaaagttagagattgggggtagggtatgtatatttactctgcagaatactaatactgtctgttccattatcatagcaaaaaagtgacacggaaactagaatagagaccagaacttcatttgagggagggtttgggcttaatatttgttgtcacaaaacagacagggttaatttatatctcaagaaactacttaggatggcagcaaggtggccttatgaagggatttgaaggctttcatttaacatccctattgcacttggattggtaggggttactggatatcattcttaagtttttggtttcctttcttgttaaggttacgcctacaaagacattctttggaaactagtagaggtaagtgttgcaactctattaggttcttgactctgaaatttgtattccttcctaagaattttgtgtttttattctgttgaagcatatgcttcttaagtattttttttttttaaacagctcaaagacaactcaaagcagacatcccaactgtagacttcaatttagacataaactccaggtttggtgagttactgtaattgtttcagtttcatggatcttaaagatgaggaaatagcagggtaaagtgttaaataagatagcctgcaattgttagagaaataacaaggcaccaagtttcatgatatagtccagtctgataattccttcttaagtatgaactcattcctcggagaatctgaaataggagtgaggggcatcagcccattggtatgacccaagagaaacacatctaaggatctgaaactagttataccccatactctgttttgcttagctctgctctttggtgtgttcctctgtttgttcctttgtacattaagatcactataaatgggccaggggtggtggctcatgcctgtaatcccagcactttgggaggttgagtgggtggatcacttgaggtcaggagttcgagaccagcctggccaagatggcgaaaccccgtccctactaaaaaatacaaaaatcagctgggtgtggtggtggtcacctgtaatcccagctactcgagaggctgaggcaggagaattgcggaaggtggaggttgcagtgagccggatccgggattgcaccactgcacttcagcctgggtgacagactaaaactctgtctcaaaaaaaaaaaaaaaaaaaatcactgtaagtgtaaagtaggggaagccctgagcttatctcacacactctaactctgttttttttttttttttttttttttgcgtgttctccaaggcaatgtctcaggagcccctttaaaatcaagcttgaaatcttatagctgagatctaagggtggaaataaagccctcattgtctttatatgagaatcggaacttgttcatagaggaaaggggataaatttgaaaggggttagacctaagaactcttctttctagctttaactcctgagactatgaaaaacaaacaaaaaaaaacatcttgggcattaggacccagtggaagtgcctctgcctcattcagactctgttaacttctctcagtgacgtaaaggagcagcccgagctcattctctgcccgcagccccccttcatctctctcctcctgctccttttctcctcctttctcctccccctcccttttttcctccctccctctccccctttccctcgctcccctcctccctccctccccgtctttcttaccccctccctttctctctctctctctctctcactcgttccctaacattaaagagaaaatgctgctatccgtgacttccaggcccgggatttcgacttttggctacaatagaaacaacaagaaggtagggaaaagcgcttttttggtatctagctacttctttttctggggatcttgcaatgcccttggtttttacattctttttaaagaggggaaggggcttcctctctcaagattcctaattcctcaccgcgcttctcccttttccactactgctttctgcatctttcctcaactggttctggagttcagggaactttcagtctctgcgaggcctgaaaagacaggggaattaaaaacaaatcaagcttgcaagtttgtatccttatgaaatgaagttagtttgacttcctgctgatgtatcaatctccacaaggataatatgtcatttcagaccctgtcccccagtccaccccaccccacaagattattttattttttgattaactgtttccattctctccccaaccttccctcctacccataccaccagtagtattagatagctgaaatcatagatagtcagagaaaccacaacagtttatcaagagctgggtatactcttctagactacagatcctaccccacccagcctatagagaaggagtcttgagagacatcgcaccttgggattaaggcacagagcgctgtgatactttggatcttgtatttgaactgatacttggacctctgcagatagccagactttgcagtgatcctaggagtctttatgattaacccatggctgccagagaattgtgctgtccttgggcacatggggagagatggacaatcttgtccatatttgacaaggaatatatttggcagtttctggcatttcagggcgcacagcatactgattaggaggaatttcatgctgtagcaggaagaagactctttaccctctctttgtgttgtagctgttctttgaagaaaaaatgtgacatagacatttagggaatcttttgctcatctaatggaatgttggagggtgaggaacgattcctgctgctttctcatgtacctaatgagaccattagaggtggatttaaacacaagtgtctgatcaatgcagtgggtaaatgtttagacccaaaacacttaatgttgatttatgggcttagtctgtgtggtactcattttgtttatatcctgaagaaatatgggtagaggggagaggaaatggggagctataggtcagaggatacaaagtagtagatatgtaggatgaacaaatcctgagatccaatgtacaacatgaggactatagatgataaagttgtactgtatatgggattcatgctaaatgagcagactttagctcctcttgccacaaaaagaaacaaaagggacaattatgtgggatgattaatttacttcactatagtaacctttctactatctatatgtatcccgtaacatgttgtataccttaaatatacacaataaaatttactttaaaaaagaaatgaggctgggcatggtggcttatgcctgtaatcccagcacttgggaggccaaggtgggtggatcacttgaggtcaggagttcgagaccagcctggtcaacatggtgaaaccccaaattagctgggcttggtggcacgcgcctgtaatcccagctactcaggaggctgaagcaggagaatcacttgaacctgggggacagaggttgcaatgagccaggattgtgccactgcactccagcctgggtgacagagcaagactccatctcaaaaagaaatgaaatatgagtttatacacatttgttggttatcaatatatgtttatatgtacatatactgacatccctttatcaaatatatgtatagataatacattatatattatacgtatatatttgaaagggaaatatttcacatgtctttattcttttcaaaccttgtagagtaccatgtgaaaatttctttcctgatttttttccctcctagttctctcaggttacccagaactcattaaaataaaatgaattcccaaaatgaattgcttccctattagaggtttcacgtatttgaagctatctaaaaatctctttttgctctctgctccctctcccaccttggagtataggaaaaagttaattagcttctaaatctaggatagtataggggacaagaggtatggttgtgggtttgggttgaaatctcttagtaaggtttgacaattcaggaattgttggaattggttggggaggataggtagatacataattactaattactaatgtatttgtcaattctttgggttcttataagtcaatgttatgatcagatgtaaggatgctgtatctgtgcatcactctgtggccatgcatatgactccttttgtgcctatataagtttgtgaacgtggagggttttcatatttttatttttactttttttttttttgagatggagtctcgctctgtcacccaggctggagtgcagtggtgtgatctcagctcactgcagcctccgcctcccaggttcaagcaattctgcctcagcctcacaagtagctggaactacaggagtgccaccacacccggacaatttttttgtgttcttagtagagacggggtttcaccatgttggccaggctggtctcaaactcctgacctcaagtgatctgccctgccttggactcccaaagtgctgagattatactttgagtcaccaagcctggcccatatttttatttatttatttgagatggagtcttgctctgtcgcgcccaggctggaatgcagtggcgcgatttcggctcactgcaacctccgcctcctgggttcaagtgattctcctgcctcagctttctgactagttgggattacaggtgcccgccaccacgcccagctaatttttttgtatttttagtagagacggggtttcatcatgttggtcaggctggtcttgaactcctgacctcaggtaatctgcctgcctcggcctcccaaagtgctgggattacaggcatgagccactgcgcctggccccatatttttatttttattttacttaatttttttcctcaacactagatgaccagggagggtgtttttaaactatagcattattacgttgctctttgtcttgtcaagtagggcttactgtgtttctgttttggaaagggttgtagatgcatttgcttatgtaatttgtgtattttccatactcagttaaattttatttatttgtttatttatttattttgagacagagtcttaccctgtcacccaggctggagtccagtggcgcgatcctggctccctgcaacctcagtctcctgggttcaagcgattctcccgcctcaacctcctgggtagctgggactacaggtgtgcgccaccaggcccagctaaattttctaattttagtagagacgaggttttgccatgttgcccaggctggtcttgaactcctggcctcaagcaatctgcctgcctcgggttcccaacgtgctgggattacaggcgtgagccactgtctggcccatttatttatttatttattttgagacagggtatcactctgcagtctgggctggaggacagtgccatgatctcggctcactacaatctccaacccctgggcttaagcgagcctcccacctcagccaacttttatatataacttttttgttgtttgttttcgagacagagtctcgctctgtcacccaggctggagtgcagtggggcgatctcagctcactgcaacctccgactcctgggttcaagtgattcttctgcctcagcctcctgagtagctgggattacagaggcccaccaccacgcctggctaattttttatatttttggtagagatggcgtttcaccatgtcggccaggctgttctcgaactcctgacctcaagtgacctgcccacctcggcctcccaaagtgctaggattacaggcgtgagccaccacgccctacctatatataacttttatataaaagttactgtttcttactgaaactaatgaaagttattgtaaaaatttaactttggtgctcacgcctgtaatcccagctctttgggaggtggaagtgggcagatggctcaaggtcaggagtttgagaccagcctggccaacatggtgaaaccccgtcaatactgaaaatacaaaaattagccgggtatggtggtgcacgcctgtagtcccagctactcagaaggctgaggcaggagaatcacttgaacccaggaggtggatgttgcagtgagccgagattgtgccactgcactgcagcctgggcaacagagtgagactccatctcaaaaataaataaataaataaaataaaataaaataaaacataaaaggtaggattattttattttgaaatacatacttcacttatcaggaaagatgtttcctgaggagcccatgacagtcatagttttcttactctttattggctggtggtaaatatgggaatgccgtcaacaaatgtataatgcctaataaaggcggacttttttctcaggaagtagtgttaaatttttttttcctttctttggaattaaaatagttactgaaggggaaaaatgtggatttcaaagagggattctgcaagataattttgtgtttttttttttttaaacatcagttttaatgcccttcagtaacttggttcattaaaaaaaaaaaaaaaaaggctgaagtaaaaagagacagggtctcaacactgtttcttcaatgtttgaagaagttgccaaagtagagagatttgagtataggtgagatcgaaagaggaaatgtttgggactaaaggaatttcaaacttgtaaagggcctaaccacgcctttcttgacatcatctctctggcatgtgttattataatttaactcctcataggatcaacaaccatttcctttggaaaaaaagaaaagggactgtgtttaacttaggataatttgccttctccaacgtacttttcatacatttctatttcttctcaatgttaatatattgaagactgatggggagtaggaggtgatgaaagtaaggctgactggtgggtactgccagatcctcattctttgagaagcttgttacctgagattgtcatgagtgtttactcaggagagagaagtgacaaacagtgctggattcacttagtacttctaacaggatagagaattttctctgtgtatgtttactacttttccttctagtttccatcaaatcaaatgtaataggactgagaattaagaacttgtcggtctaacatctcttgactggggcagctgttctgttatcagtaataagttaactcaaatggttaaagtttagtggtaggccgggcgcagtggctcacgcctgtaatcccagcacttgggaggccaaggtgagtggatcacctgaggtcaggagtttgagaccagactggccaacaggatgaaaccctgtctctactaaatatacaaaaattagccaggcatggtggcaggcaccagtaatctcagttacttgggaggctgaggcaggagaattgctggaacctgggaggcagaggttgcagtgagccgagatcgcgccattgcacttcagcccggggccgacaacagcgagactccatctcaaaaaaacaaaaacaaacaaaaacaaaaacaaaaaaaaaactttaatggctatatattacctgctgaacaaagtgcaaatctctagcccaacacctactatctgtctggcctttcctttatcttccccatcccccgccacccccccaccatgcccccttgatactgttacatttgctctactggccagttacgttaatgcagttttctggatatgccctttggttgctggtttacatttcttattccataggagaatatgcaatatgcaatataacaaaaaatacagaacagaaacaggacaaaggaaaatatcaactggactaagaagtcagttggaattaaaaggcaagtatggccaggcacagtggctcatgcctgtaattccagcactttgggaggccaaagtgggaggatcacttgacctaggagttccagaccagcccggacaacatggcaaaaccctgtctctacaaaagatacaaaaattagccacatatggtggtgtgtgcctgtcgttccagctgctcaggagcctgaggtgggaggatcacctgagctggtagaggtcgaggctacagtgagccatgatcatgccactgcattgcagcctgggcaactgagcgagaccatgtatcaaaaaaaaaaaaaaaagtcaagtgtgcaaatcataaaattataatgctggaagatgaggattgaagaatagtctttgaatttgttagtgtaaaggtggttgatgactttgacaagcaatttcagaggtatggggagcaaaatcaaggttggaataggttgatgagtgaaaacaagtaaggaagtatagatggtatatatacactaatctcttaagaacattgattaagatgtagagcagaacccaaatagaaagtaggcaaaacatctgaatcgatgtttatccacaggctctatggcaagatgcttaacatcattagccatcaaggaaatataaaataaagccacaatgagataccacttcacacccagtaggctgtttataatgaaaaagacagataataaaaaagacagtcaataatcaaaaagataatcgaaaggacaaatatctcctcggcaccgtgttgcccaggagttagagaccagcccggggcaacatggtgaaaccccatctctacaaaaatacaaaaattagctgggtgtggtggcatacacctgtagtcctagctattcatacttggaaggctgaggtgggaggattgcttgagcccaggaggtcaaggctgcggttgattgccccactgtcttcattctgggtgacagagcaagactctgtatcaaaaaagaaagaaagaaagagagacataatatatgtggagtaactggaacctttatacacttctggtgggaatgtaaaatggtacagctgctttggaaaacatcttggcaggttctcaaaaggttaagcaaagacccaggaattccactcctagatatatgcccaagagaaatggaaacatatgttacacaaagacctgtacataaatgttcataggagcattattcataatagtccagaggtggaaacaacccaaatgtccatcaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatgcctgtaatcccagcactttgggaggctgaggcgggcggatcagaggtcaggagttcgagaccagcctggccaacatagtgaaacccagtccctactaaaaatacaaaaaaattagctgggcgtggtggtgggcacctgtaatcccagctacttggaaggctgaggcgaggaacctgggagacagaggctgcagtgagccgagatctgccactggactccagcccaggcgacagtgcgagattccatttcaaaaaaaaaaaaaaaaagtactgatatattttgtcgaattattttgaggattggtaatgtttataatcacatatcagcctgtatattggctgtttttctcttatttaaaaaaaacattgtgggccgggcactgtggctcaacgcttgtaattccagcactttgggaggccgaggtgggcagatcacctgaggtcaggagttcgagaccagtctggccaacgtggtaaccctgtctctattaaaaaatataaaattagctgggcatggtgatgcatgcttgtaatcccagctaattgggaggctgagccaggagaatcgcttgaacccaggaggtagaggttgcagtgagccaagatcgtgccgttgtactccagcctgggctacaagaatgaaattctgtctaaaaattgtgaacctatggagtataaaaaagaaaaaaaaattggccaggtgcggtggctcacacctgtaatcccagcactttgggaggccgaggcaggcagatcaccggaggtcaggagtttgaaaccagcctgaccaacatggtgaaactccgtctctactaaaaatacaaaattagccaggcatggtggcgcatgcctgtaatcccagatactagagaggctgaggcaggagaattgcttgaacctgggagatggaggttgcagtgagcaaagattgtgccattgcactccagcctgggcaacaagagcgaaactctgtctcaaaaaaaaaagaaaaataattaaattaaaaaaaaactttttcttcttcttctagccattgtttcatttctcttcttccctttacagtaaaacatcttgaaagagctatctattcaagaatcatatatacttgctgtctccaatttatttccttccattcttttttcttttattatcttgaatatattgtcagataatacaaaagtttacatgtagttataaagtgtaataatagaggaacacctgtaagaggtactctcaagtactagactagattcattgcctgtaaattacgtacacatgaatttctccatctcatcctctgcacctcttctagaggtaaccactgtcctaaattctgtatttattactctcttgctttttattttattttattttattttattttttgagactgggtctcactttgtcactcgggctggagtgcagtggctcgatcgtggctcactgcagcctcgacctccctggctcaagcaatcctcccacctcagcctcctgagtagctaggattacagatgtgcgtcaccatgcccagctaatttttaaattttttgtggagacagggtctcactctgtcatccagagtggagtgcagtggcatgatcgtagctcagtgcagcctggaactcctgggctcctgtgatcctcctgcctcagcttcccaagtaggtaggactataggcactcaccaccacacctggctaattttaaaatttttttgtagacacagggactcgctatgttgcccaagatggtctcgaactcctgacctcaagcgatcctcctgccttggcctcccaaagtgctgggattataggtgtgagccgcggcacccagccctattactttttttttttttttttttttttttgagacgggatcttcctctgtcacccaggctggagtgtagtggcgtgatctcaactcactgcatcttccacctcccgggttcaggcaattctcatgtctcagccttctgagtaggtgggactacaggtgcatgccactacacctggcttatttttgtgtttttagtagagacagggtttcaccatgttgaccaggttggtctcgaactcctgacttcaagtgattcgcccaccttggcctcccaaagtgctgggattacaagcatgagccactgcgcccagcagccctgttactttttaaaaacatagttttagttttctgtggaagaaagtgaagccagtttacttctatactgccattttggactgaaagtctttcccaaaaaacatagttttaaaatcatgtttaattaacttgtttgcactgttctaagtactttgtataactgtatataattatatctatataatatatagttatataactatattttatcttatttaatccttacaacttcattattattattcccatcttatagatgaggaaaagtgagttacagagagtttgaaaatcatactgctagtgaatggcccaactgggatttgaacccgggtaatctagttccaaatctgtgcttgcaaccactgctgtagtgtcttattgcagcacatagtcttctgtttttgtttttgtttttttaccttcagttttgtgttttcacgattcattcatgttgcatatagatgtggtttatccattttttcatgctttacaatatttcatttgtgaatatactgtaatttatccattctcctaccaagggatttttggattgtttctagattgtgtttgttcatttttgctgtttttgaaattgctgttctgaacattcttctgtatatagtatccttgtgctagagtttctcttgggtttctacctaagagtgggattgctgagccatcaggtatgcgaatattccactttgggagataatgctaaatttatttccaaagtattgtaccaaatctgtttccatcaacaatgtataaaatttgtcatagatttacatcctttccattttttgataatgtcagacttctctcattccctcttaaagcaaactaattaggcttttattcctaccactccaccaaaactgcttttttgaaagtctgcagtgactcatgttattaagtaaatgtttatttatttatttattttttatgatggaggctcgctctgtcgcccaggctggagtgcagtggcacgttctcggctcactgcaacctccgcctcccagcttcacgtcattctcctgcctcagcctcccgaatagcagggactacaggcgcccgccaccatgcccggctaattttttgtatttttagtagacacagattttcactgtgttagccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttttttgtttgtttgtttgagatggagtctcgctctgtctcccaggctggagtgcagtggcgtgatcttggctcactgcaacctccacctggtgggttcaagcaattatcctgcctcagccttcctagtagctgggactacaggcgtttgccaccatgcctggctaattttttgtattttcagtggagacggggtttcaccatgctggccaggctggtcttgaactcctgacctcatgatctgccccccttggcctcccaaagtgctgagtttacaggcatgagccactgcacctggcctatttttatttttaattgtgacaaatatacataacataaaatttaccatcttgaacttttttttttttttttgagacggagtcttgctctgttgtgcaggctggagtgcagtggcatgatcttggctcactgcaacctccgcctcccaggttcaagtgattctcctgccacagcctcccaagtagctgggattacgggcacctgccatcacacctggctaatttttgtatttttagtagagacgagttttcaccaggttggtcaggctggccttgaactcctgacctcaagcagtccactcacctcagcctcccaaagtgctgggattacaggcgtgaggcgcccaccttgcctggctcatcttgaacattttagtatacagtttagtagcattaagtgcatttacattgttgtgcaacccatctccagaattcttttcatcttacaaaactgaaactctatacccattaaacaactccacattctcctctccctccagcctctggcaaccactgttctactttctgtctcgatgaatttgactatcctatgtaccttatgtaagtggaatcatacagtatttctgtgactgtcttatttcacttggtgtaatgtcctcgtggttcacctatgttgtagcttgtgtcagtgtttccttgcctttcaccctgaataatgtttcattgtatgtacaacatatagcacatatttgtttattcattttcccattgatggatacttgggttgcttctaccttttggctgttgtgaataatgtcgctatgaacttgagtgtacaaatacattcaagtgtccctttgagacactgctttcaattcttttgggtatatacccagaagtggaattgctacatcatatggcaagtctatttttaactttttcaggaaccactgtcctgttttcaacactgcacaagggttccaatttctctgcatccttaccaacacttgttgttttctgcctttttttttttttttataagtagccatcctgatgggtgtgaggtggtatcccatggttttgatttctgtttctctaatgattagtgatgttgaacgtcttttcacatttgtgaaatgtcatttgtaaatcttctttggagataagtctattcaagtcctttgcttattttattttatttatttatttatttatttgagacagagttttgctctttttgcccaggctggagtgcaatggcatgatctcggctcattgcaacctccacctcttgggttcaagtgactctcctgcctccgcctcccgggtagctgggattacagacgtgcaccaccacgcccagctaatttttgtatttttagtagagatggggttttgccatgttggccaggctggtgtcgaactcctggcctcatgtgatccacccacctcagtctcccaaagtgcctggaattacaggcatgagccaccacacccggcccatctttgggattttgatagggattacattgaatctgcagattacaggcatgagccactacacctagcccatttttgggattttgatatggattacactgaatctgcagattgctttgagtagtactgatatcttttttttttttttttttttctgagacggagtctcaggctgtctcgctctgtcacccaggctggagtgcagtgatctcagcttactgcaacctccgcctccctggtacaagcaattctctgcttcagcctcctgagtagctgggattacaggtgcctgccaccaagcccggctaatttttgtatttttagtagagatggggtttcaccatcttggccaggctggtcttgaactcctgacctcgtgatccacccgccttggcctcccaaagtgctgggattacaggcgtgagccaccacacctggccctgatatcttaacaatgttaatgcttccaatccatgagcatggagtgtctttccatatatttgtgtcttctgcaatttcttttagtaatgtttttggctttcactgtacaagtcttttgcctccttggttaaccttattcttaagcatattattatttttggtgctattagaaatggaacagttttaatttccttttcaaatcattcgttgttagttatataaaattcagaaattcttttttttttttgagacagagtcttgctctgttgcccaggctggagtgcggtggcgcaatctcggcttactgcaacctccgcctcccaggttcaaacaattctcctgcctcagccacgcaagtagctgggattacacgtgcacaccaccacgcccagctaactttttgtatttttagtagagatgaggtttcaccatgttggccagggtggtctggaactcctgaactcaagtgattcacccacctcagcctcccaaagtactaggattacaggcgtgagccactgcgcccagccagaattcagcaattctataagtctatgtttgtgtattgattcagcaaatcagatattgcctttctgttatagagggtaaagatttatttctcttaaaccccgtgcccttatgttccagcttcccctttcttcacaccttctgtttataagttgtgtcatgatttttagttaaaccagtattcagtatttatattattatgattttataagtattatttctagctaagctatataatatgctatgataatagttcctttgttcaatttttgttttccctggagttaataattaccttgttttcttagttttattttgtataatagacagtatttttacataccagttactgttcttttattttttttgagatggagtttcgttcgctcttgttgcccagactggagtgcaatggcgtgatctcggctcactgcaacctctgcctcccaggttcaagtgattctcctccctcagcctcctgagcataccagttactgttctaagccctttataaaatttaactcacataaaccttctaaaaactgagaggccggatgcttcattacattccagcttcactggccttctattccttccaaagtcccaccttatagcttttaaccgtgtgctccctctttctggaatgatctctttcattctccgaatggctagtttcttctcatccttgaagtctttcatacttaaatgtcatctttctgactagtctaatgaaaataggccacagccttctttttgtcttttttttggtagcccatttatcacagtgggtaattattaaattattttatgattatttgattaatgtctctctccccactaaatactcctgaaaattttattagggccagagccatgtctggtttagctaagcattttgtccttggtacctaacgtagtacctagtactctaaagtgggcattgaatatttattgaatgaatagatgtcagctccttttatgtttcaggcagcatgataagagttttacatgtatgtatgtatgtatttatgtatttatttgtatttacatatatgtatatatttatttatttattgcaaaaggggatctcactttctgtcccaggctggagtggagtggtgtgatcatagctcactgcagcctcaaacacctgagctcaggtgatcctcctgccttagccttccatgtagccgggactacaggtgtacactaacacacccagctgatttttaaaaaactgttttttatagagacaaggtctcactatgttgcccagactgatctcgaactcctggcttcaagtgatcctcccacctcagtcttcagagtagctgggattataggcaagaataaccacacctggctacctgcatttattttaatccccacaacagtcctatttcataggtgttgttaactgtccccattttataggtgaggtcaagcaacttatccaaagtcacacagctaatacaagacaatggtagaattaaacctaaatattggctgggcttggtggctcatgcctgtaatcccagcactttgggaggtcaaggcaggaggatcacttgaacccaagagttcaagaccagactaggtaacatggcaagactaagtctctacaaaaaactcaaatattagccaggtgtggtagcatgcgcctgtagtcgcagctactcgggaggctgaggtgggaagattacttgagcccaggaatttggggctacagcgaaccatgattgtgccactacactccagcctgggcagcagagtgagaccttgactcaaaaaaaaaaaaaaaccccaaaaccgctaagtctctgcgacttctgagccagtgttttaaccattttctgttggttaatgggatttatagtcaagaaaaatactttttaaaaaattgagtaaacattgattccttgcctattcagttgctgaatgaacagtgaaaaattaagttagttatataaaaagtgaatctgattttccctcatttgtaaaatgaagacattaattaggaatgaaattgatttactttaactcaaattgaattactattaaattattattttacaaataataggatttgcaaactggtagggctgtactctaacctttaccccactatttcaattaccaaaaataatatttgcatagctcttaaagattgttggggtttgagggtttcaattggaagcactcctcttacttcaatccagttgagaaatacgaaaaagtttgacagaaataaagtaacacttactactaataaaactaatattcaagaagatagcttatatttgagggctagtagatgttctaatactgaatccagaattagacagatttatccacctaaatacaagcagtacttaaaaaccaaacaaaaacctatgcacttcttcgtgtgggcacttacccatgtaaaatttgaccagttcagagtagcaaagctgagtgtatactctctgcagctagctggatctcaaaataggaaagaaggagctgtgtttttcttctagtcactaagaagggaggggtgatatgctaaacgcttggctgtctacattgaaagaaacatctggagtagggaataagtgtttttccctaagatgataacaatccagagagaagcaagagtcaaaaaataaaataaacataaaaaattttaaaagatgatacaagattctcttgattgggttccattttcacttattagatcaatgcttaaatctagtagatttatttttttttgagacagggtctcactgtcatcctggtggagtgcagtagcatgatcaccactcactacagcctcaacctctgtggactcaggtgatcctcccacctcagcatccagagtagctgggactacttacgggcacatgccaccatgcccagctaatttttgcatttttctttcttttttttttgtagagacagagtttcgccatgttgcccaggctgatgtcaaactcctgggctcaagggatcttcccaccttggcctcccaaaattctgtgattacaggcatgagccaccgcacctggctctagtagactttttgatgattcaggtaaaatggtaaactaaatccctttaacctgttttttggtgtcattttagactactgatttgagcatatttaaagtatgggtttttttttttaaaaaatggggcttatagttaacgaaaaccattgactgtccctgtgtttcctttttttttttcttgtttttctttttttttttttttattcagggtttcactgtgttgcctaggctggagtgcagtggcccgatcttggctcactgcagcctcaacctcctcggctcaagtgatcctcacaggtcagcctcctgagtagctaggactataggtgcacaccactatgttaggctaattttaaaatttttttgtagaggcagggtctccctgtgttgcccaggatggtctcaaactcctgggctcaagcagtcctcccatctctgtctcccgaagtgttgggattatagccgtgagccaccatacctggcctctttatttattttttaaccatcccatatttcatttctttttattatttttatttatttatttatttatttattgagatgaagtctcactctgtcacccaggctggggtgcaatgatacaatcttagctcactgcaacctccgcctcctgggttcaagcaattctcctgtctcagcctccaaatttcttttttgaaaaattttatatagagacagtatctcactgtgtttcccaggctggtctcaaactcctggcctcaatgattctcctgccttggtttctctaagtgctgggattacagacatgagccaccacacctggcctagagtcacctcttttttttggaggcgggggtggagtcttgccctgtcccccaggctggagtgcggtggtgcaatcttgatctcagctcactgcaacctccacctcccaggttcaagtgattctcctgcctcagactctcaaatagctgggattacaggcgtgcgccaccacgcctggctaatttttgtatttttagtggagatggggtttcactatgttggctagactggtctcgaattcctgaccttaagtgatccgcccacctcagcctcccaaagtgctgggattataggtgtgagccaccatgcccggccatagagtcacctttaaaaccagctataggccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcttagatgtctgggatgatattagatttgcttttagaagtaagggatggtagcatatcatcatgtagcaaagaaatatgtaaagaaatccaataaaagagtattctaggtatgagtcttcttatgaagtagacttgtaagtgaatgagcaacattaatgggtttatatagagagaaatggacatgatcacatatacttgagaaggctaatgctagctgcattattggagggtggtttggaggtgtaggagaacagaggcagtcagacaagttaagagatattagaaataagggagttcaggaaaaggtacagaaattaattttagacttgcagaatttgagattacctgcttgatgtatatatgttgaatgctttcagaataaacatgggttaattcattcacttagtaaacatttgagtacttgaggccaggcatggtggcttacacctgtaatcccagcattttgggaagccgaggtgggcagatcacctgaggtcgggagttcaagaccagcctggccaacatggcaaaacccagtctctactaaaaatacaaaacttagccgggcatggtggcatgcgcctgtagtcccaggtacgtgggaggctgaggcaggagaaccgcttgaacccaggaggtagaggttgcagtgagccgagatcgtgccactgcactcagcctgggtgacagaggaaggcatgaaaagcctggtagtgtgatgacgagtcttgaagtatgatttattaactaaaagctaatgtattgccttagaaacgtaggcatgtaaaggaagtaatgtttttaaaaagttctagtatttcactgatttttttgtgtgaaatgcaggaatttcagttttattccctggaggtgggaagtagtctcaaggctggggcttttttgactttggatctgccagtgaaacctagacagtacccacttggttaccaagacagaaaaggaaactttgattgattattcaaattcaaagcaggatgctagggaacagcagatttaaggttagttggatgactggaatttagcatataaagatgtgtgaagacacccgtgtggaaaggacatttctattcccagaagcatcactcccttctcagagtgagcagccacacgtaaaagcagaaggaaagcaagagaggtaggataactgagatggtagatataaaatccttagcacaggccaggtgcagtggctgacacttgtaatcccaacactttgggaggcgaagtcaggaggatccctcaagcccgggagtacgaaaccagcctgggcaacatagcgtgtctctacaaaattaaaaaatgtagtggcaagtgcctgtagtcccagctactcgggaggctgaggtgggaggcttgcttgagcctgggaggtcaaggctgcagtgagtcatgatcatgccactgcactccagcctgggtgacagtgcaagaccctgtctcaaaaaataaataaaatacttagcaccatatacaacaagtgccaaatatcagtaatagttattcttttaaaattaagagtccttttttttttttttttttttttgagacagagtctcgctttatcccccaggctggagtgcagtggtgcactctcggctcactgcaacctcatcctcccaggttcaagcagttctcctgtgtcagcctcctgagtagctgggattacaggcgcccagctaatttttgtatttttagcagagacggggtttcactatgttggccaagctagtttccaactcctgaccttatgtgatctgcctgcctcggcctcccaaagtgctgggattacaggcgtgagccactgcaccctgccaggagtcttttttgagacagagtatcactctattaagccatcctcccacctcagtctcttgagtagctgggactgcagccatgcaccatcatgcctggctaatttttgtatttctttttttgtgtgtgtatgtgataaagattattctgtcgcccaggctggagggcagtggtgtgatctctactcactacaacctccgcctcccaggtttaagcaattctcctgccttagcctccccagtactaggattataggcgcacaccaccaagtccggctaatttttgtacttttagtagagatggggtttcaccatgttagctaggctggtctcaaactcttgacctcaggtgatctgcccacgatggcctcctaaagtgctaggattacaagcatgagccactgcacccagcctaatttttgtatttcttttagtagaggcgaggttttaccatgttgcccaggctggtctcaaactcctgggctcaagtgatccacccgccttggtctcccaaagtgctgagattacaagtttgagccactgcatctgacgaagagtctgtaaaaattgagtcttttttaaaaaaagaattcttgtaatttaatttctttgttttttttttttttgagatggaatctaactctatcacccaggctggagtgcagtgacacgatctcggctcactgcagcctccgcctcctggcttcaagcgattctcctgccccagcctcccgagtagctgggactataggcgcatgccactatgctcgactaatttttgtatttttagtagagacagggtttcagcatgttggccaggctggtcttgaactcctgtcctcaagtgattcacccaccttgacctcccaaaatgctgggattataggcgtgagccaccacacccggccgaattcttctaaaattagaacgaaggacaaaattctccttcctttgcagatatagataattcacccatattgagctgtcatctgtctgcagaggcttgatgtttcccctatcagctgtcaaggatccaggagaacttgagatgcctttgtggaaagcatatttaaagatttagagctttctcttcacaatagaaaagacatggaatcaacccaaatgcccatcaatgataggctggataaagaaaatctggtaaatatataccatggaatactatgtggccataaaaaggaacaagattatgtcctttgcatggacatggatggagctggaagccattatccccagctaactaatacagaaacagaaaaccaaacactgcatgttcttgcttataaatgggagctgaacaatgagaacacatagacatagagaggggaacaacacacactggggcctgttgtatggacaggcagggtaagagcatcaagataaatagctaatgcatgtgaggcttagtacctaggtgatgggttgataggtgcagcaaaccaccatggcacctgtttccctatatagcaaactcgcacatgtatcctgaaacttaaaataaaatgttttaaataaataaataaaataaaatagtaatattaacagtggtagtggcggtactaaacagcttagttttttcatgtagtagtatatttttagtatccttccaggaaaagatacatggatgtgccatattatttttaatggcttacatggtactccttttatgtatgcactataatttatgtaaccagttttctcattgatgagtatatgctttttcagtattttactattataacgaatgatgcaatgaatatccttgtacatatatatttgtgcacatatataagcatccctacaagtggaatttctgaataaaaggatatatacactttaaaaaaaaaaagatttagggctttgaggcaggcagccaagtacctggatacctacttagtgagctggccctcaacatcttgaggactacctctctctgactcagaaagttacttttgtttaaattatatagcaattccttctgttttgtttttttttaattgtctaggactgagactgagatctttcagacataatattaagaagaccttggtacaaaattagccaggcatggtggcacatgcctgtaatcccatctactcgggaggctgaggcaggagaatcacttgaacccaggaggcggaggttgcggtgatacaagatcgcgccattgtactccagcctgggcaacaagagcaaaacttggtctcaaaaaaaaaaaaaaaaggaagaagaagaccttggccaggtatggtggctcatacctgtaatccaagccctttgggaggctgaagtgggaggattgtttgaggctaggagttcaagatcagcctgggcaacatagcaagactccgcctctatgcattttattttattttgagaccaggtctcactctgtcacccaggctggaatgcagtgacacgatctcagctcatgcagcctccacctcctgggctccagtgatcctcccacctcagtctcctgagtaggtgggattacaggtgcctaccaccatgcccagctaattttgtatttcagtagagatgggggtnnnnnnnnnnnnnnnnnnnngtttcagacttgcagccctgcttgtgcgcctctgagggtaccccgtcttaccattttaattaggaacattttttcaaagtcaattttgggttcctgtgaacaggtccatgttattgcattctaacaaatattttaacattttaaattagccaggtcctccttgatgctaaggatataatggtgtacaaaacaggcatgggctctgtcctcatcaagtcttatgcttctggtaaaggctgctcatgactagtgaccttataactaatgtatatttatattttaacaattactttttcaggaccatatgaacaggaaaaatagcaaaaacaattatttgttacattcaaatctctctctctctctctcttttttttgagacagagtctcgctttatcccccaggctggagtgcagtggtgcactctcggctcactgcaacctcatcctcccaggttcaagcatttctcctgtgtcagcctcctgagtagctgggattacaggcgcccagctaatttttgtattttcagtagagatgggggtctcaccatgttgcccaggctggtctcaaactcctggcctcaaacagtcccctcactcagcctcccaaaatgctgggattacaggcataagccaccacaaatgttttttaaaattagccatgtgtggtggtgtgtgcctttagtcctagctacttgggaggctgaggcaggaagatcacttgagcccaggagtttgagattacagtgagcataatcatgccacagcactccagcctggaagacagagctagactctgtgtcttaaaaaaaaaaaaaaggagagagggagtgagaaataacctcaattccctataaattggtggtgtagtatttaaataatactacacagtggctcactcaggcctgtaatcccagcattttgggaggccaaggctggaggattgcttaagcccagaagttcaagaccagcctgggcaacatagcgagacctgaaaaataataaataaaggatagagaattatgctgtaagataccctataaaaatctctggggatcatatgatctaaagtatttaatgtaaaagtatgtcactgtaatctcctcttatactaaacatgactttgtcttttagcttttttttttttttttgatgacagagtctcactctgtcacccaggctggagtgcagtggcgcgatctgggctcactgcaacctctgcctcccgagttcaagcgattctcctgcctcagcctctggagtagctgggattataagcatgcaccaccacacccagctaatttttgtatttttagtagagacagggtttcacaacgttggccagactggtcttgaattcttgacctcaggtgatccacccgcctcagcctcccaaagtgctgggattatgggtgtgagccaccttgcctggcctgtcttttagcttttaagcagctgctgagaactaatactaaccacattctgaactatatttaaggccaaaataacatgaaagaagtatagaggtaaaactgctcccttggtagttcactttatcagtgattgaatggagctgagaaggcagctcattcatgatgatgatattaactgataatattaactgatgatattatttattcatcaataaagtcactatggattcaaagataggcaactcagacaattttctgcctttatggagcttacagtcagcaaaaacactgtgggactggtccctctaatcaggaggtaaattctttaggctttttgctctatagtaagccattgcctaccctagccttcatctctctatcaatttggaaataaacgcatttatgatgctctcttgttgaagaattagaacttcctcagctgagaaacataagaagggaatccatggtagggttctggagaaaccatagcttctttttattcttcccttctccggtaagaatatgtcagttccctgggtgctcatacgtattacccttttctctcttacatattataggtaaacatattattagtttacagggtctttgtctccaaagtgttttaggaagccagataagctttacttaggggctttcttaaccatttctccccccttgtattctcttacccttaaaagtgaatatttttccaccatttttctttggtgtcaaacctatgcagcaatttcagaaggtacgtaagaatagcaagagataaaagttgttttatagtaagcaatggcttactatagagcaaaaagcctaaagaatttacctcctgatgagagggaccagtcccacagtatttttgctgactgtaagctcaataaaggcagaaaagttgttttcttctgagccgtatcttcttttctaagaattttttcaggccttgtagtaagtttattattgactaagtcatatttttaaactatagctaagaccttagtattaaaaccaagatggtaagcatggcagcaaaccaatagcctcttttttcttttcttttcttttttttttttttgagacggagtttcgctcttgttgcccaggctggagtgcaatggcgcgatctcagctcaccgcaacctctgcctcccaggttcaagcgattctcctgcctcagcctcctgagtaactgggattacaggcatgcaccaccacgcccggctaatttcgtatttttagcagagacggggtttctccatgttggtcaggctggtctccaactcccgatctcaagtggatccacccgtctcagcctcccaaagtactgggattacaggcatgagccacctcgcccgggctttttttttttttttttttttttgagacggagtcttgctctgtcgcccaggctggagtgcaatggcgagaactcatctcactgcaagctctgcctcctcctgggttcacaccattctcctgccccagcctcccgagaagctgggactacaagcacgcaccaccacgcccagctaatttctgtatttttagtagagacggggttttgccatgttggccaggatggtctcggtctcttgacctcatgatctgccagcctcggcctcccaaagtgctgggattacaggcgtgagccactgcgcctggccttttttttttttttttttttttttgagacagagttttgttctgtcacccaagctggagtgcaatgatgcaatcttgtctcactgcacctttgcctcccgggttcaagcgattcttctgcctcagcctcccgaataggtgggattacaggcatgtggcaccatgcccggctaatttttgtatttttaatagagatggggttttgccatattggccaggctggtcttgaactcctgacatcaagtgaaccacccgccttggcctcccaaagtgctgggattacaggcgtgagccaccagctgcctctcttcaatttatttatttccccagtaacccttgtattcttgtttggacagtcctggcatcactgatactttctttcagaaacattatctcacattgagaatggggatagatgaacgccaactgaggcaggtggtctcttcatctgcttgtgcttggcacatagtatggtgctactaaagttgctttctttttttccctccctccctccctcccttccttccttctttccttcctttttctttttcctttttttttttttttttgagacagaatcttactttgtcacccaggctggagtgcagtggcacgatcttgcttactgcaacatttacacctctgccttccaggctcaagtgatcctcccacctcagccctgtgagtatctgggactacaggtgtgtgccaccatgcacacctaatttttgcattttttttttatagatgtggggtttcaccaggttgcccagattggttttgaactcctgggcttgagggatccgcctgcttcagcctcccaatttgctgggattacaggcgtaagccactgtgcttggcctctttgtttttttaagagttagggtctcactatgttgctcaggctagtctctaactcctggcctcaagccaacctcccacctcaaccccctgagcaggtgggattacaggcttgagctaccgcgccagctgacagttgcttttattatcattgttactgttgacatcgtggctatcatcatcatcaccctcatcactgacagacctacagtctcatattcagagaagcagctttgttttctcagctaaggatcaataatagcaactccttagagataaagaaggacattttttttttggagacggagtctcgctctgtcgcccaggctggagtgcagtggcacaatctcggnnnnnnnnnnnnnnnnnnnnnnnnnnnnnnnnnnnnnnnnnnnnnnnnnnnnnnnnnnnntctgggactacaggtgtgtgccaccatgcacacctaatttttgcattttttttttatagatgtggggtttcaccaggttgcccagattggttttgaactcctgggcttgagggatccgcctgcttcagcctcccaatttgctgggattacaggcgtaagccactgtgcttggcctctttgtttttttaagagttagggtctcactatgttgctcaggctagtctctaactcctggcctcaagccaacctcccacctcaaccccctgagcaggtgggattacaggcttgagctaccgcgccagctgacagttgcttttattatcattgttactgttgacatcgtggctatcatcatcatcaccctcatcactgacagacctacagtctcatattcagagaagcagctttgttttctcagctaaggatcaataatagcaactccttagagataaagaaggacattttttttttggagacggagtctcgctctgtcgcccaggctggagtgcagtggcacaatctcggctcactgcaagctctgctctgcctcctgggttcacgccattctcctgccttagcctccctgagtagctgggactacaggcatgtgccaccacgcctgactaatgtttgtatttttagtagagacggggtttcatcatgttggccagactggtcttgaactcctgacctcaaacgatccacccgcctcggcctcccaaagtgctgggattacaggtgtgagccaccgtacccggccataggtcatagtcttcttgactgcgttttatctttatgaaatatatatttatcacaaccttcataattttttttttttttgagacggagtctctttctgttgcccaggctggagtgcagtggtgcagtcttggctcactgcaacctctgcctcccgggttcacaccattcttctgcctcagcctcctgagtagctgggactacaggtgcatgccaccacacctggctaattttttgtattttaatagacagggtttcacctgttgcccaggctgatcttgaactcctgagctcaggcaatccacccacctcgacctcccaaagtgctgggattacgggcgtgagccactgcaccctgcctcaactaatttttgtattttttgtagagatggggtcttgttatattgcccaggctggtctcaaactcatgggttcaagcaattctctcacctcagcctcccaaagcgctgggattacaggtgtgagccactgtgcctggaccagtgtattattattattgcagaactagtaattaaatggaaatttcaaagtgattctttttaaaatttatttaacttttattttaagttcatgggtatatgtgcaggtttgttatacaggtaatcttgtgtcatgggggtttgttttacaaattatgttgtcacccagttattaagcctcatgacctattagttatttttcctgttcctctccctcctctcaccctccaccctcagacagaccccagtgtgtattgttccccttaatgtaaatatgtgttctcatcatttagttcccactttataagtgagaacatgtggtatttggttttctgttcctgcattagtttgctaaggataatggcctccagctccaaccatgttcctgcaaaggacaggatctcattcttctttatggctccgtagtattccatgtgtatatgtacaatcttttctttattcagtctaccattgatgggcatttaggttgatttcatatctttgctattgtgaatagtgctgcagcgaacatacacatgcttgtgtctttatgatagaatgatttctattcctttgggtatatacacagcaatgggattgctgggctaaatgatatttctgtttttaggtctttgaggaatcactacattgtcttccacaatggttgaaataatttacactcccaccaacagtgtataagtgttcccttttttccataacctcataacctcactagcatctgttatttttttactttttaatactagccattctgacttttgggagatggtatcccactgtggttttgagttgcatttctttcttttttttgagatggagtctcgccctatcacccaggctggaatgcagtggcgtgatctcggctcactgcaagctccacctcccagattcacgccattcttctgcctcaacctcctgagtagctgggattataggcgagtgccactgcacctggctaattttttttttttttttgcatttttagtataaacgggggttcaccacgttggtcagctggtcttgaactcctgacctcgtgatccacccccccccccttggcctcccaaagtgctggggttacaagggtgagccaccgcgcccgtcctgcatttcttttccaaacgtgctgtcgcccaggctggagtgcagtggcgcgatctcagctcactgcaagctctgcctcccgggttcacgccattctcctggctcagcctcctgagtagctgggactacaggcgcccaccaccatgcccaactaatttttttgtatttttaatagagacagggtttcaccatgttagccacaatggtctcgatctcctgacctcatgatccacctgcctcggcctcccaaagtgctgggattacaggtgtgagccaccacgcccagcctacagactgttatctgggaaatcctaatgtaagtgctggcaaaaagagggaaaaaggaataggaaatataaaggatgtattaaaagctacaacaggattttaagtctttgggctatctcacaatgtggtattaatttcttcttctctgctaaaatatagagctaaggaacaaactatgtgtgtccaagtgagtgcacatttgtgattatatatagtttggaatcattttttcaagaggtccaggatcttcctcactctccaacatgtaaatggataatccttctacctcttcctcatgtctccctgcagccatatgtgtcattggctcagcagatggcaccacctagcccaagcaacagtacacctaacagcagtagtggaagcaatggaaatgaccagctgagcaaaaccaacctatacatccgaggattgcaaccaggcactactgaccaagatcttgtcaagctgtgtcagccgtaagttggagtacatgtgcgtaggcttccagggacagtatagatttggttttgagacagggtctcgttatgttgtccaggctagtcttgaactcctgggctcaagtgatcctcctgtctcagtagctgggattacagatgcatgccaccactcctggccttgccagctcacttatcctaaaaggcaatggcattttgtttctactccatagacacaaactttctcagcagcctcttaaaaaattctacctgctactggccgggtgcggtggctcatgcctataatcccagcactttgggaggcctaggcgggcggatcacgaggtcaggagatcgagaccatcctggctaacatggtgaaaccccgtctctactaaaaatacaaaagaattagccgggcatggtggcgggtgcctgtagtcccagctacttagaaggctgaggcaggagaatggtgtgaaccctggaggctgagcttgcagtgagccgagatcatgccactgcactccagcctgggcaatagagtgagattccatctcaaaaaaataaaaataaataaaaatctacctgctactgatatatattataaagcctttatgtgtttctctaaggaaagccagtgtgggactggcctttaaagcctaatatccaactttatttccagcacctcccccaacctgatggtcttagtggaaagactgctgtccttacaccttgaatagagaagtttaatatctctatagatgttaattagaaggcatgagagagctggcagtggggatggaagaaagtgggactcgccaatcaaatcatgcactttggagactttctgctgctggagatattccttgggaatggagacctcaaattagcagataaagaaggtggagataggaacaattattctgtatctaccccatgaagacccttcggagttctttttagtagatttgattcatggaattgcccaattaggaatgttggaaaaatggcaagagtgcacagatgtccagctcaaaaaataataagcaataaaaaataaagtctggtgtatataaaaaactggtccttgggccgggcgtggtggctcacacctgtaatcctagcaccttgggagaccaaggcagaaggattgcttgagctcaggagttcaaaaccaggctgggcaacatagtgagaccttgtctctataaaaaatatagtaaaaatatatattaaaaaaaattttaaaactggtccgttatctcagcttaccttgctagaaaggtatgtaagtggaattaaggggactgtcttggactagtaatttttgagaggtgggaattagcagaaatgttggtttttgagggagcgaaagagtatcatactaatataggtccttgatttctaaattttgtttcttgtactaaatataatgtgctacaaaaattctctcacatcacaagacagagaagaatcttttttttttaagactgagtctcagcctcccaagtagctgagattataggcgcacgccaccacatccggctaatttttgtttttttttttgctagagatggggttttactgtgttgtccaggctggtctcgaactcctgaccaggtgatctgcccacttcggccgcccaaagtgctgggattacaggtgtgagccaccgtgcctcgctcagagaagaatcttgattagactaccatatattcgttcctcagtatctgggggggatttgttccaggacctcctctgtccccctgcatggataccaaaattcactgagctcatgtccctacgcttttttttctttttaagacaggatcttgttctgtcaccaaggctggagtgcagtggtgtaatcacaactaactgtagcctccagggctcaagcaatcctcccacctcagcctcctgagtagctaggactacaggtacacaccaccatgcttggctaattttttgtaaattttgtagagatgagatttcatcatgttgcccaggctggtctcaaacttatgcgctcaatcattcctcctgcctcggcctccccaaaagctgggattacaggcatgagctactgagcctggcctcaagtcccttagataaaatggtatagtggccaggcatgatggctcatgcctgtaattccagcactttgggaggccaagatgggtggatcacctgaggtcaggagttggagaccagcctggccaacatggttaaaccccgtctgtactaaaactacaaaaattagctgggtgtggtggtgggcacctgtagtcccagctactcaggaggctgaggcagaagaatcacttgaacccagaaagcagacgttgcagtgagccgagatcacgccaccagaaagcagaggttgtagtgagccgagatcacgccactgcaccacagcctgggtgacagagcaagacttcgtctcaaaataataaaaataaaataaaataaaatggtgtagtatttgcatataacctatgcacatgctcctatatactttaaaattatctccagattacttatgatacctcaatacaatacaaatgccatgtaaataaatgttatactgtattgtttagggaataatgacaagaaaaaagtctgtatatgttcagtacagatgcaaccatcctttcttttaaaaaacattttaacttttattttaggttaaggggtacatgtgcaggtttgttacataggtaaactcgggacttgggtatttggtgtatagattattttgtcacctgggtactaagcatagtacccaacagttatttttttagttttttttccctgaacctctcttagaagaaagacttttttttttttcctatatattttcaatccatggctggttcaatccacaagtgggaaacccacagatacagagggatttttattttgcctttctgaacaattgccttatcttttgctgtgtctgaagcataagtatagtcaagggcagcatgtaggatcgaagtaaggagcccaaaaggggactgtggagaggcaggagtgaggcaggaatgaaagaggtgccagaggagtcctgactaggaggctgagcagagcaggtgggtggagccctctgtccgctgtgagcagggagttaagcctttctaggaaggatgtttctcatgcgtagacggacttcctgcctttgtcccagttgtctctccctgggttgtagaggaagtaaatattgctggatcctaaagtctggcatgtgggaaggagaggcgtggagtctaggactggaactcctgtttctcggaggggctccttcaaggaagcagcagcagtgacccagctgttgccagctgcagtggaaattctgagctcaaagtctcagctgctagaccacagcaagctccaccctggggccttcataaggatagcagcacttgtgtcctctgccccacagtcagacttctcatgagtccctcccctgcctcaatttgggaatgaatccaagtgtgtagcctggaagggctaggatagccacatccatcctcaccctccttttaatgtgttctgttcccagctttcagggcattgcttggcttattctgtctaatcctttggatcacagaagttctactaaaaaagtcagtgagatgccgccaaggagtgaaaacaaatcaatcatcatatgttctttagggatggaaggagagatgggaaaattgcttgtttggggtattattctcaaattcattccctgacaactattttcagttagctcttgtacttctgactttgttagtgatttctgttctgtctctttaatattttcaccctcctggagtggaatgtagaggcttttttctagtggaacgcttctaatataatccctgatctgtgatacactactactcaagttttagaagttccacatgactctgctaccaaagtataattttcaaaaagttgaaaaacacaactgttaggctgggcacagtgcctcacacctgtaatcacagcactttgggaggctgaggcaggtggatcacttgaagtcaggagttcgagaccagcctgaccaacatggtgaaacaccatctctactaaaaaataccaaattagctgggtgtggtggcgcatgcctgtaatcccagctactccagaggctgaggcaggagaatcgcttgaacccgggaggcggaggttgcagcgagccgagatcacgccactgcactccagcctgggcaacaagagtgaaactctgtttcagaaaacaaaaagaaaacacaactgtcatgcaaatataaaatgaatatgtgtcaaagatttttataactcattaatgagggaaccagcaggatggcaaaatgagttcaaagagcatttgaggaactatttataggaaatgaagaaagaatgttggaataagattgctacattagataaaaactggtttatgtcctataggatagtaaagccactaacctttgcaattattttatctactgcacagaaataatttgcatttttactggacaaaaatctataacttggccaagtgtggtggctcatgcctgtaatcccagcactttgggaggctgaggcgggtggatcacctgaggtcaggagtttgagaccagcctggccaacatggtgaaacctcgtctctagtaaaaatgtaaaacttagctgggtgtggtggcaggcgcctgtaatcccagctactcgggaggctgaggcaggagaatcgcttgaacctgggaggcggagggtgcagtgagctgagatcacaccattgcactccagcctgggcaacaacagcaaaactccgtctcaaaaaaaaaaaaagaagaggaaggagaaggaggagaagaggaagaggaaggagaggaagaagaagaagaaagaagaagaaggaagaagaagaagaagaaaggatatgcagccctttggccttatcaccaaaatttagatggttttttgtttataagatgattttcttagagctgggcatggtggctctcagctgtaatcctagcacttttggaggccaaggcagcaggactgcttgaggccaggagttaaagaccagcctgggtagcatagtaagatcctgtctctacaaataatttttaaaattagccggacattgtggtacacacctttggtcctcaggaggctgaggcaggagaattgcttgagcccaggagttcgaggctgcagtgagccatgttcacaccactgcactccagcctgggcaacagagccagaccctgacgcacacacacacacacaattttttttttaatactacagttcccactcccctccctaacactctcaaatcttgacaatgagaaatagaagtcttagagtaaggcaaagagatattaaagttgaggttccttgaatataataatagcaattaaaaattttaagtgcttaccatgtggtacacattaatgatttctgtttattaattcacagtcctaacaatcctatctccattttacagatgatgaggctgagacaccaaaaggttcaatgacttgttcaagatcacgcatagctaaaaagtggcagaaccaggatttgaaccaaagcaatttggctcaggttgaccttcaattaaaggggtcagtggaggggtgatggaaataggatatcagagaagaaaaatgtctatagttttttcataggatcagtggtgttttccaaaagaaaataagtaatggcaaggattctttttagtcctcagggaattccagccagagctctgcctctacacactctttcgtgtggacattgccaagcttctttccccaaaagacagtcatctctttccaactagtgtgtgagtcttagctgggaaagaagagagaaatgtgttggtattatagggactacagttaccttatttcttttaggtacctttggggaggatgggtttatattaagtgtggcatttttaacccatttcttttttttctttttttttttttttgagatgtagtgtcgctctgtcatccaatctggaatgcagtggtgccatcttggctcactgcaacctccacctcacaggttcaagcaattctcctacctcagcctcccaagtagctgggactactggcgtgacgcccagctaatttttgtatttttagtagagatgaggcttcatcatgttggccaggctggcctcaaactcctgacctcaagtgatcctccagcctcggcctcccaaaattctgggattacaggtgtgagctactgcacccggcccccgtttcttttttatttttatgaaggtttgagtaggaaaagttagatcatggaaagggcatggatttgttgagatgtctgaatctctgtcctattcttagtctctgccccccagattattactttgcattttcctctcccttagatatggcaagattgtttccactaaggccatactggacaagaccacaaacaaatgtaaaggtgagagaacaactgtccttggtgttggagagcaccagtaagtgaggccatcccttgacactgccctttactgctgagagtcctgagtctacagtgtcagcgagaagtccctgaagtttttaggcttaaaagattaggagatatttagattctttggtgaccagatagctagagctgaaaatgctgtttaggggccccaaggccagaagactgtacaaaacacctttgagtctactgagcttattttggactttgtatttccctggatgaggtggtagaagtgggtaagtgagattttcttctgcttagcaaagtcatgtaaatgccttttttggggagtgttttggtgggtgttattttctgagggtgagtagttttattggggttttgagcagttctagatagagctggaagagtggaaggaagagaaagggctataagttggggtggtgagggtcttcttccagcaggtggctggtggtctgctctggagaggctgcattccctacatgcctagcatttctggggtatatcaagaaaagaggggagtgaattcttttagaggtataggggggctttgggttattagcagagcctagttcctgaaacctcaaatttcttaagggggagggagaagggcagggacaccagagtagctcattgccttggcattcttagccacaaagtagatcacatctcagggtttgaggagcatgtggataactacctgaaacctctcaatagctctttctccctcccatttctgttacatggatcataactcttcctctgtctcctgaaaagcctggacctctctgttccttacacctcccacttcctagtgatgctgtttcctctgttccaggctatggctttgtagattttgacagcccttcagcagcacagaaagctgtaacagcactgaaggccagcggtgtacaggcacagatggcaaaggtaagggtactaccccatgtctgttcctccaaggggtttgtggttagcaccaaagttccagttctaaggtttccagagggcttaagaaccatgaaattgagtgggcaagggctatccgtggtgctttctagacagtccatgagcacccctggctgctggaggaagatgtattcaaagtctatggcaggtagctctatcagctctcttcctttcaccaagttattggcagcaagaaaggtaaggtggcctcttccggtactcctgctgcttccccgtgttccctatattattcaccctggccccacttccctaccagacagcttgtggtggttttgcaacattctctgaacaagtcaattgtgcaactcagaatttcagaacaatgctctccacctcctaatgttgttccccatacgggctgggtagtgggctggggaggcaggagggaagccacatcaagggaggaaactgtctcttctcagatctgtctgaaactgttgtcttcacctagactactagaaatctagaagcttttctctcacttcttctgttaggtgggattgtctccttgcctttctattttattttatttatttatttattttgagacagcgtctcgctctgtcgccccggctggagtgcagtggcgcaatctcggctcactgcaagctgcacctcccggcttcacgccattctcctgcctcagcctcccaagtagctgggactacaggcacccgccatcacctccagctaattttttgtatttttagtagagacagggtttcaccgtgttagccaggatggtctcgatctcctgacgttgtgatccgcccacctcagccttccaaagtgctgggattacaggcatgagccaccacgcctggctgtccctttgcctttctgaagctgttatgagtattatacatagagcttgtgaggcaggcctgctagacacattttctgtaatggttaaagaaaaggaaaacaaaaggaaaaggcagaagaggattaaggttgctggtgaccactgtttagggcagagtgactgcttaaattcttaaaaatacaactattggatgatattgccattttgcacattctgtcccctggaagggctctcctacctcttcttccaggagtaaaaccctctgacaaaagctcaaaggtttaggagccttcagggtcctaggagactgtagctttcagggctccgtggtgacacagtgaactccgcatctggctctctccctgttcccttctcccctcctcctgctcttcctccatcagggagtgaacaggcattcctacttagaggattctgcgtggctggaagagaagtggggaggggctgctcaaaacaagccagccaaggagcaaggcagtctgagggaatccagcctctgggaccggctgctgggggagagcgggaatgctgctctgcctgtttctaaaagagacagccaaacaccatttatgacttgtatgatgggcttgtatagtactagaaatattaaatctgcacttctccctcctggaactcaatatacaacccgtggtagtgggactgggtgttaacaaatagaataatctttgtttatgtgggacccttcctatagtctcttttctgaaatgtcatttgtggggagggctgagggtgggagagggataagagatgtgagcctcattttctcactgttatttccacagcaacaggaacaggaccccacaaatttatacatctcaaacctcccactgtcaatggatgagcaggaactggaggggatgctgaagccctttggccaggttatctccacccgtatccttcgagataccagtgggaccagcagaggtgttggctttgcaaggtgaggatggcaggagtggggaaatgatgaggttaataacaaatgtcacttgggggtcaccagaaaacaaaatctatgcctttcccacacaaggtcaaaatactttactattattcaaaaatacttgatggtaagtcaaaagttcattttaggccaggtgcggtggcttacacctgtaatcccagcactttaggaggccaaggcaggcatatcacctgaggtcaggagtttgagaccagcctggcaaacatggtgaaaccccgtctctactaaaaatacaaaaattagccagacgtggtggcgcatgcctgtaatcccagctactcaggaggctgaggcaggagaattgcttgaacctgggaggcagaggttgcagtgagctgagatcgcaccactgcactgcagcctggggaacagagtgagactctgtctcaaaaaaaaaaaaaaaaaaaaggttcattttattataggttacaatactcaaaaacccattagccccacctaaatattttttttataaagatggggtcttgctgtgttgcccaggctgctcttgaacatctgggctcaagtgatcctcctgcctcagccacctaagcagttgggattacaggcatgagccaccacactcggctaagctccctactacttcctagggaagtactctaggctttgttcctttaatccagacccaaccagagtaaaaaattctgtatattcttatagtttactgagtatttctcatcttgtctcatttaatctttacaacatccctgtgagataaatattctctatcttacagatgaggaaagtgaactcttcagtagaaatgatttgcccagggtcttacaggagtgggtgttagagcagagccctgatccttctggctttgagagcagtaggatgaggtagaagttttgatcttccttttcagatctgttgggagacctgtattccagaacaattctgcacctgtgatatcagagcttgtgagccttggttcactctctgaagtggagattgattcagatgagtaattttcccacagtattccctatacctgcagttttcccaggtgcccttctttgggctttggtatctgccctcactgtcgtagggtatcagcctcccttagcccacttaagaaatggctctgcttttatttattttaagattttatttgaaaggagattcttttgactttttttttttttttttagtttcaaaatgactggactaagtgagccaagcacccctttttgctttatatcttgtctggtccgtgaacacccccttactctgagtgtttcagaccttgggaacaagaaatagtttctcttggctgggcgtggtggctcacgcctgtaatcccagcactttgggaggctgaggcgggtggatcacctgaggtcaggagtttgagaccagcctggccaacctggtgaaaccccgtctctactaaaaatacaaaaattagctgggtatggtggtgggctcctgtagtcccagctactcgggaggctgaggcaggagaatcacttgaacccgggaggcggaggttgcagtaagccgagatcgcgccattgcattccagcctgggcagcaaagcgagacgccatctcaaaaaaaaaaaaaaaaaaaaaaaaagaagaagaagaaaagaaatagttcctcttccccagctgactcaagcttagtagcaccacctgctggcaatcccgtgtatatctaaaggagagttcctaggcttgggaccatcgaacttattttgcaggttgagcagaggttcttaacctttctcagtttgtgccacccttagttatctaatagtttttcaccctagaccaaaagaaatacctaacagttcaatttattaagtaactgaatggtccacactttttttttttttttttgagacggagtctcgctctgtcgcgtaccacaggtgcgtaccaccacgcctggctaatttttgtatttttgttgttgttgttgttgttgttgagacgaagtctcactctgttgcccaggctggagtgcaatggcacaatcttggctcactgcaacctctgcctcccgggttcaagtgattctcctgcctcagcctcctgagtaactgggattacaggcgcccgccaccatgcccagctaatttttgtatttttagtaaagatgtggtttcaccaggttgtccaggctgttctcgaactcctgacctcaggttatccagccgcctcagcctcccaaagtgctaggattacaggcatgagccactgcgcccagccagtccacacaactttttaaaaaaatttcctgacagcagtaacttcatggtccatacagcttaagaagtgtttatgctttaacaactttgtagctgtttgaaaaaataatacacaaacattgaaagagagcatgtctttatttcattctaactatacttactaatggaatatgtgcctgttggaattgcacaacttctcaaaatttggtatcagaatggacacctacacactcatttcctgttacgtattggttttcttatggtatttgcttttgtcatagcaactatttaaacccagctttgtgaaaatatgatgttatctatcaaaaggattgtagggggaactaatgttgaagcagtgtacaattttgagttagtagtgcacacattctccaacagatattgctgtttttcttcaaagagttaaaataaccctcgttgtgaccctctgagttcaccacagccacccacagtgcctgagagcacagtttaggaactgtggctttagagacttttgaaaaactatgaaatctcttatatgtttctatgttaatgtctacaagttttcttcatatattcagattcatgcaaagtatgatttccagcaaattataaatattggcatttaaaataaaactgttacttcgtttaaaaatgtattcaaatgagatctaaatatcatagcaatctgatacacaaatcattcatttaaaaaatacctgactttggccggactccgtgactcacgcctataatcctagcactttgggaggccgaggcgggcggatcatgaggtcaggagatcgagatcatcctggctaacatggtgaaaccccatctctactaaaaatacaaaaaattagccgggcgtggtggcgggcgcctgtagtcccagcttactcggaaggctgatgctggagaatggtgtgaacccgggaggcggagcttgcagtgagcccagattgcaccaaggcgcttcagcctgggcgacatgcacttcagcctgggcaacagagtgagactcgtctcaaaaaaaaacccgactttgggaggctgaggcgggcagatcacttgagctcaggagttcaagaccagcctgggcaacatgtgaaaccccatctctacaaaaacaaaacaaacaaaaaaattagctgagcatggtggcacgtgcctatagttccagctacctgggaggctaaggtgggaggatcacctgagcccaggaggtcaaaactgcagtcaaccatgatcacaccactgcactctggcctgggctacagagtgagaccctgtctcaataaataaatcaatacaggaatatgggtagggctggaggcagatggggtgggtcttgccctggggatggagctatgggcccataggacccccagccacttcctagtcccccttacccctacaccccccctcaaaaaaaaagggctatttttttttaaattaaatacagtagtctcggccaggcatggtggctcacgcctgtaatcccaacactttgggaagccaaggcaggcagatcacctgaggtcgggagttcgagaccagcctgaccaacgtggaaaaaccccgtctctactaaaaatgcaaaattagctgggcatggtggcgcatgcctgtaatcccagctactcaggaggctgaggcaggagaatcatttgaacctgggaggcggaggttacggtgagctgagatcacgccattgcactccagcctgggcgacaagagcaaaactccatctcaaagaaaaaaaaaaaaatagagtggtccccccttatttatggttttactttctatggtttcagttacccacagtcaactgaaaatattaaatggaaaagtccagaaatagttacaaagtttttaaattgtatgccattctgagtagcatgattaaatttcaggctgggctcggtggctcatgtctgtaatcccaacactttgggaggccgaggcgagcagatcacttgagatcaggaggtcaagaccagcctggtcaacatggtaaaaccccatctccattaaaaatacaaagctagccaggagtggtagtgtgcacctgtagtcccaggtactcgggaggctgaggcagtagaattgcttgaacctgagaggcagaggttgcagtgagccaagatcacaccactgcactctaacatgagtgacacagtgagattctgtctcaaaaacataaataaataaaaaatttcatgttgtccgctccatcccaccctttgtccaaagtatccacactgcaaatgctacccacccattagtcacttagtagccattgtggccatcagatgaaaaagcgtagtatatctagggtttggtactatccatggtttcaggcatccactaggggacttggaatgtatctcctgaggataaggggggactactagagtcataaatctcatatcattcttatattccttttttcttcttgaacttgtgtttctattccatttctctatagaattttgtttctattccatttctctatagaattgtattctagtgtaaaatatttttataaagtctttatggatcatcttgtcatacttctctgcaacaaaaatatgtatataaattaaaaattttggccaggcatggtggctcatgcctgtataataccagcactttgggaggctgaggtgggcggatcacttgaggtcaggaatttgagaccagcctggccaaaatggtgaaaccccgtctctactaaaaatataaaaattagctaggtgtgttggtgggcacctgtaattccagctacttaggaggctgaggtgagagaatcacttgaacctgggagatggaggttgcagtgagctgagatcacaccactgcactccagcctggatgacagagtgagattccaaaaaaaaaaaaaaaaaaaagttatctttacaatgatgagctcacaattgcccagacaacataaatatattaaaatgttcatacaaggccaggggcagtggctcacgcccgtaagcccagcactttgggaggccaaggtgggtggatcacctgaggtcaggagttcgagaccagcctggtcaactcggtgaaaccctgtctctactaaaagtacaaaaattagctgggcgagcgcctgtaatcccagctactgtaatcccagctactcaggagtctgaggcaggagaatcatttgaacccaggaggcagaagttgcagtgagccgagatcacaccactgcactccagcctggacaacaagagcgaaactccatctcaaaaataataataataaataaaataaaataaaatgttcatacaaaattattattattattattattattattattattattgagacagggtctcactcggttgtgcaggctagagtgcattggtacgatcctggctcactacagccttgaccttctgggctcaagtgatccttacacctccgcttcctgagtatctggaactacaggcccccaccaccatgcccagctaattttttggtggggggatggtgggggcagcaaattttttaattttttaattttttttttggagatggagtttcactctgtcgcccaggctggattgcagtgctgcaatcttggctcatggcaacctctgcctcccaggttcaagcaattctcctgcctcaacctcccaagtagccgggaccactggcacatgccgccacgcccggctaattttttgtattttagtagagactgggttttaccatgttgcccaggctggtctcgaactcctgagctgagctcaggcaatccacctgcctcggcctcccagagtgctaggattacaggcgtgagccactggacccggcctaattttttaatttttttgtagagttggagtctcactgttttgcccaagctggtcttgaacacctgggctcaagcagtcctcctgcctcagcctttcaaagtgctgggattgaggcatgagctactgttcctggcccaaatttttttttttatttttttgagatggcgtctcgctctgttgcccaggctggattacagtggtgtgatctcagctcactgtaaactccgcctcccgggttcaggcgattcttgtgcctcagcctcccaagtagctgggattacaggtgcatgccaccatgcccagctaatttttgtatttttagtagagacagggtttcacccagttggccaggctggtctcgaactcctggcctcaagtgatccacccaacttggtttcccaaagtgctgggattacagaggtgagccaccacacctggccaaattattttatagaagtaaattttattgcatatacagaagcatctatgacatggataggttttgttttgtttagatttttctaattaggacaggtaagcataaattaatattgtttattactgtaacaagggagagtttaatgccagttctgtttctgctttttgttttcatgctgagaaaccttgttctcataaataagtagatgggagtggaaaggattttgttaaaacaggaattttaaaaatttcttctggccaggtgtggtggcttgtgcctgtaatcccagcactttgggaggccgaagcaggcagatcacttgaggccagaagtttgagaccagcctggacaacatggtgaaaccccatctctactgaaaatacagcaattagccaggcgtggtggctcatgcctgtaatcccagctacttgggagctgaggtaggagaatcgtttgaacctgggaggaggaggttgcagtgagccgagattgcaccactgtactccagcctgggcaacagagcgagactccatctaaaaaaacaaacaaaaaaatccttctgaattatatgccaagaaccaaggtgttctgtcatcaaaattgattttttatgtgtgaattgacaacttgctaaagtcccccaaatttgttgtttctaaagaattggaaaccatttgagaggagctattgtaagaggggacttcagccttgatcattagccgtcaggagctctccctcaggaagatcagatttaacagtttttgagaaacttgagattctgaaatgctccacggcctgcttaccctttggaaagactgtaaggggtagaagtacccaacagaagaccacagctctacgatacctaatgtgtggttttctctaaaaggctcaatttaaggacttttaacaatatcttcttttggctggttgcggtgactcatgcctgtaatcccagcactttgggaggatgaggcgggcggatcacgaggtcaggagatggagaccattctggctaacagggtgaaaccccgtctctactaaaaataccaaaaaaaattagccgggtgtggtggcgggcacctgtagtcccagcttacttgggaggctgaggcaggagaatggtgtgaacccaggaggcagagcttgtagtgagccgagatcacgccactgcactccagcctgggcgacagagcaagactcagtctcaaaaaaaaaaaaaaaatcttttataggaatggttcatatttctggtggtcattggcacagaaaatgtgagtcttactttaaatatggggaaatagattaaatatactgagttaatttaaatatggaaataggtgaaaatactgttccttgttctatatagtcccttataatttgtagaacacatttatatacattatctcctttgatctacacaacaccatgtggtagggtagatggatgttatctctaaagcacaaataaggagtagatcagaggggtttttttgttttgctttgttttttgttgttgtttttgagacggagtcttgctctgtcacctaggctggagtgcagtggcatgatctcagctcactgcagcctctgcttcccaggttcaagcaattcttctccctcagcctcccgagtagctgggactactggcacgcaccaccacactcagctaattttttttgtatttttagtagagacggggtttcaccacgttggccaggatggtcttgatctcctgaccttgtgatccgcccgcctcagcctcccaaagtgctgggattacaggcgtgaaccactgagcctggccttttttttttttttttttttaacacagattctcgccctgttgcccaggctggagtgcaatggcgtgatctcgactcactacaacctctgcctcccaggttcaagcgattctctcacctctgcctcctgagtagctgggactacaggcaagtgccaccactcccggctaatttttgtatttttagtagagatggggtttctccatgttgtccaggctggcctcaaactcctgacctcaagtgatctgcctgcctcagcctcccaaagtgctgggattacaggcgtgagccaccgcacccggcggatcagagggtttttgtgagtgtcctaactcacagagctctgggtggcgaagtggtgctggaatctcagtcttctgattccttatttctctttctccaacaagaaactaactcagtagactccaacattcctttttctatcactatgggccatgaactctttcttattgctttttccttccacagattcatgaaatattaatgatattatcaatagctaattagaccttgaccttaattacaacaaggagcaaaaaataaatattggcaaattcttagcttgtacaattttatcaaattaaaggaacaattttcattcagaattttctaataaaaaataatggtaacaacctctatttcttgtattcttatttatatggcagatacaagagagggcccatgttaatagtctgaagactgccattattcctatgaggatcccatacagggaccagttgaaagaaccttcgttacaagctggggttacctcttcaagaaccttgaatttgtgtggcagacactctgtgtttctgtagtcataacatttggagcagttgtggggctgggaacttagagctttgctttctctttcaatgtgtggagagcacagatcctggagaagctagagcctaacccctcttatgctccttaggatggagtccacagagaagtgtgaagccatcatcacccactttaatggaaaatatattaagacaccccctggagtaccaggtgaggcatctggggctcaggctgagagggccacaggttgttacttccagtgaagattctggagcagctttgcatgactgtgcctgggccacatgaggtgggactcagctgcccatctgccttctctctcggcagccccatccgatcccttgctttgcaaatttgctgatggcgggccaaagaaacgacagaaccaaggaaaatttgtgcaaaatggacgggcttggccaaggaatgcagacatggtaagaggacctctgaggagacaggagtactaacgacattaaagtggaacggaaatgatcatggcatgatttctgtgagcttaggtggaaagcttgagagctacagtacgtaattgagaaatgctggctgtgaacatactgccagtttgttctcgagtgtggctttgcggcctgcacaattagaaaaactctgaaacagctgtagtgggacttgtctaggctttaatttgttaaaccaaaacattcccagccttggacattctgggccagctcctattctcactcaagggctcacaatgtgaacactgtgttctttctttatagggcgtcatggccttgacctatgaccccaccacagctcttcagaatgggtaaggttttatataatcaagccacctgaaaatgataatggcctgtgtccagacactcaaatgattcatcttgattctctctatttgaaagtcaagggaacgttggctgtgcctatcagttgggacccttcccttgtggtttcctgtgactcagtactgattgaggttccttcccacaggttttacccagccccctataacatcacccccaacaggatgcttgctcagtctgcactctccccatacctttcctctcctgtgtcttcgtatcaggtatgttcatgcctgaaaaatggtgtggtggttttccctactactgtgctttaagtgaagtaatataaggctaggaactacttgttttttgtttttccttttaatcatattacacacaattttacataacagcgtaaaagatgatctgtgcatgtggtcatatatatggtatacagttttaatggtgtcctcttactccccctccaccacctccacaagtaaactcatgttaatgtcctactgtgtagcatttgtcatattttttcatatgaatacacatatgtatagcatttggggagttgtttattttacaaaaattggaccagattaaatatatttttacattcactcatctcacttaacagtatcctacaccagtgattctcaaagtgtggtccctgaacaagcagcatcagcatcatctgagaatttttagaaacagaaattttggactaccctccaaatctactgaattacaaactctgaggatggggcccagtgatctgggcttttgtttgtttgtttgtttgttttaagagggcgtctccctctgttgcccaggctggaatgcagtggtgcaatctcggctcactgcaatctccgcctcctaggttcaggcgattctcctgttttagcctctggagtacctgggattacaggcatgcgccaccacgcccagctaatttttgttttttttagtagagacggggtttcaccatgttggccagactggtctcaaactcctgacctcaggtgatccgcccgcctcggcctcccaaagtgctgcgccacgcccagccgtgatctgggttttaacaagccctccaggtgattctgttgcagctaatgttgagatcctctgctctaattttatcttttttaatggttgcattatatttcatgctgcagatatgccagaattctttagctatacccaatgggggcattcacttagattcgtttttttgctgctatcaataatgctccactaaacacccttgtgctatatttttatatatgaatgcttctatttctgggggctagagtcccaggaggtggattgctaggttgaatgctatatggattttcagttttatagatgttgccagattgctttccacaaaggctgtgtcacctcacatttctaccagccatgtatgaaagtacccatttccttccaggcataggtgctactgctcttttaaaattgttcctgtcttgctgggcacggtggctcatacctgtaatcccagcactttgggaggccgaggcaggtggatcacctgaggtcaggagttcgagaccagcctggccaacatggtgaaacctagtctttactaaaaacacagaaattagctgggcatggtggcgggcgcctgtaatcccagctacttgggaggctgaggccagagaattgcttgaacccagcaggcagaggttgtggtgagccgagatcgcgccactacactccagcctgggcgacaagagtgaaactctgtctcaaaaaaaaaacaaaaaaattgttcctgtcttgatgaatgtaaagtacatcgttattttaatttgcatgtcccttactataggtgaatttaaccatttcatttgtcatagtttgattggcttctctctgattgctattcatatgctttgtccatgtttctatttggttatttgttcttttcccatcaacttataaaaactccatgtaagtattaatcttctaaatgttatctttgttacaaatttttttccaattttattttttggctgttgaatttgtggtcctcaaactttagcgatgtatcagaatcatgtggaaagcttattgaaaactggattgctgggcaccacacccagttcctggttcagtaagatgggtggaaggcaagaatttgcatgtccaacaagttcccaggtgatgctgctgccactgctgctggtccagggaccatagtgtgggaatcactagtttttgccatataaaagtttaaaatttggccaggtgtgatggctcatgcctgaaatcccagcagtttgggaggcagaggcaggcagatcacttgagctcaggagttcgagaccagcctgggcaacatggcaaaacccctgtccctacaaaaaatacaaaaattagccaggtgaggtggtgcgtgcctgtaatcccagtaactcaggaggctgaggtgggagaattgcttgagcccggagattgaggtttcagtgagctgtgatcacgccactgtacttcatcctgtgcaacagagcaagaccatgtctcaaaaaaaaaaaaaaaaagtttaaaatttctatatagttaaatttgtctttttcttttataaataacttttgaggccaggcacggtggctcacgcctataatcccagcactttgggaggccgaggagggcggatcacaaggtcaggagatcgagaccatccagactaacacagtgaaaccccgtctctactaaaaatacaaaaaattagccgggcatggtggtgggcacctgtagtcccagctgctggggaggctgaggcaggagaatggcgtgaacctgagaggtgaagcttgcagtaagccgagatcgcgccactgcactccagcctcggcgacagagtgagactctgtctcaaaaaataaataaataaataacttttgaacttcttgtcttttttttttttttttttgtgaccgagtttcgctcttgttgcccaggctggagtacaatggaccaatctcagctcactgcaacctctgcctcctgggttcaagtgattctcctgcctcagcctcccaagtagctgggattacaggcatatgccaccatgcctgggtaattttgtatgtttagtagagatggggtttctctgtgttggtcaggctggtctcaaactcccaacctcaggtgatccacccacctcggcctcccaaagtgttgggattacaggcgtgagccactgcgcccggctaaatttcttgtcttaatttaaaaaagtattctctgtctctatactgtgtatctggtctctaagattttatgttttacatttacatttaaatgtgtaatcatcaggaatttatctttgtgtatggcataagataggagtctgttttctttcagagtgttaaccagttggcctagcgccaaattattaaataatctcactttttggattatttaatccaatattggattatttcaaatccaattttaattgaaatgtccttgcaacccattatatacttctgtgtctatggatttgcctattctggatataataggcaaagctcagaaaattgtatgattgtgtgattacacaaaagtaaaatcatacaatatgatttttttgcgtctggcttctttcacttagtatgttttcaagatgtatccatgttgtagcatttatcagtacttcattctttttatagctgaataatattccattatatggctataccacattttgtttatccagttatcaattggtcatcatttaagttgtttccttttgatcattatgaataatactgctataaacattgatatacaagtttttgtgtggacatatgttttcatttcacttggatatatacctaggagtggaattgctgggctacatagtaactctatatttaactttttgaggaactgccaaagcattttccagagtagctgcaccattttacattcccaccagtggcagtgtaaaacacttgttattctatccttttaattgtagtcatgctggccttgcactgtggctcatacctgtaatcccagcactgtgggaggctgaggtgggcggatcacttgagctgaggagttcaagactagcctgggcaacatggcgaaaccccgtctctacaaaaaatacaaaaagtagccaggtgtgggccgggcacggtggctcacgcctgtaatcccagcactttgggaggctgaggcgggcatatcacgaggtcaggagattgagaccatcctggctaacacggtgaaaccctgtctctactgaaaatacaaaagcaaaattagccgggcatggtggcgggcacctgtagtcccagctactcaggaggctgaggtgggagaatggtgtgaacccgggaggcggagcttgcagtgagctgagatcctgccactgcactccagcttgggtgacagagcaagatcctgtctcaaaaaaaaaaagtagccaggtgtggtggtgcacacctgtagtcccgctactgcactccagcctgggcaacagagcaagactctgtctcaaaaaatagaaataataattgtagccatcctaataggtatgaagtggtatcccattgtggttttgatttgcatttgaacctctttcatgtactcattggctatttgtatatcttcttagagagatatctttccaaacccttttttttttttactaatttttttagtgacagggtctcactctgtcgcccaggctggagtgcagtgtcagaatcatagctcactataattttgaactcctttttgcccttttttaaactggattatttattgagttttaagaattgctaatattttaaaaacagtttttcttaatgtttctattttgagtggggcattcaaacttttctgagctttgttgaacattattagatctgtgggctgaataatagtttccaggcaattaacatttttgtttttgcttgttttagagagtgactcagacatctcctctacaagtacctaacccatcctggatgcaccaccattcatacctcatgcagccttcagtgagtattcagaagtgggcagaagccaaagaggcaatttgatgtaaagaaaaaactggctgggcactgtggctcacgcctgtaatcccagcactttgggaggccaaggcaggcaaatcacctgaggtcaggagttcgagaccagcctggccaacatgacaaaaccctgtctctactaaaaatgccaaaaattagccaggtgtagtggcgggtgcctgtaatcccagctactcaggaggctgatacaggagaattgcttaaattcgggaggcagaggttgcagtgagctgagatcgtgccattgcactccagtctgggcaataagagtgaaactccgtctcaaaaaaaaaaaaaaggcctttgatgccaggagatgtgggtgtgagttctggctcagacccttgtgcaacccagcagtaagacctaagcttgttattcttagacgagggtccttccacactgacaggcagagttcctattcttgttgcatagttgggttgctgctcacttaccatttcccaggattcttaaatgtctgtctccagtggtcctgacagccaccgatcactgctttaggcagcctcacaggatgctgcagctaaccctgtcctttgttgctgcctctagggttcagttctgacaccagggatggaccatcccatttctctccagcctgcctccatgatgggaccccttacccagcaactgggccatctctccctcagcagcacaggcacggtaaagcaggatatttctgattgtaaactctcctactgagcaaggcatacctgtgtaatactcttcagcgtaagtaacttatgaataatgatggaattacttcagtgtcatccggggcacactcagaacaggacataaactacaatggtagtgctccatgagccaggaatacagccattctgctccccagcccaccccttttaactgattcctactcatgcaccttgtgaatagtgcttctgtctgcatattagtttaagatacacacacgtcctaggaatcctcatcaaaatagtacctggaaggatggaggaagctcattaggtttcttttaggcctactgcattcctttttgcatagaaagggctcaagggtagagaagggagtgtgttgaggaaaagcagaagaaagtcaggaaagaggaggaaaataagtcatatagggagacgtctccctaacagtgtactttagaaccacctgaagtgcttttaagatgcaaatgctcagaccaattaaaatagaatctctggggtagaatacaggtgtcagtattttttttaaagcccctcagctgcttcaaatgtagccaaaaatcactgctgtaagcctgttgatgtttctctttctagtatatgccgacggctgcagctatgcaaggagcttacatctcccagtacacccctgtgccttcttccagtgtttcagtcgaggtaagggtgttatcatttctttggattgagattaggaaaatgaacggaggcaggtttccccctgatcaagatctttctctcacaatgatgctgattctgtgttcacaaatagctggtaggtatacgaagaatgtaggaaggatgtgctcgcttcggcagcatgcatactaaaattggaacaatacagagaagattatggcccctgtgcaaggatgacatgcaaatttgtgaagcgttccatatttaaaaaaaaaacaacagcagatgtaggaaagaaggacttggtctgagttcatgaatgaggcccttccttacatttggccagccagtagttgacaccaggatgctggcttgtattgactaatgcgtcttgggaagaggacaggctgtaggaaggttggggaagtggtggtgtgggtggaaacactcacacatgagtgtggagagtgggtaggtttgggagggcactcgatgtagggtgggctttggtcaggctgctgtagtggaggtgaggaaaggaatgcgcaagatgacccccctccttggctatggcacaggagagcagcggccaacagaaccaagtggcagtggacgcaccctcagagcatggggtctattctttccagttcaacaagtaacagtgggtaagaaccacatgctggggggcagggagggctgcactggcagacagcagctcagcccggcctgaagtcagacaggttctcatgtttgtcttgtctcctctctggcttgtgccttctttaggattcccctccccatctttactgaatagaaatgaattcttggagatactcatgctcccagattccagagggttaaccaggaatggagaccatccgtcggccctgctaaggactaacacttagccatcgtttttcacaggcctgggcctggaaaaagaaatctctacgttcctgccctttactattgctgatggagcctgggggaaccatcactttttttgtgtgctacattcaaggagatcaaaaaaacttttcttcttttgcaaagaaagctttttgtttttaactgcaacgtacttttcccctaccttgaagagacatggtggtcgtagcttctcatctatatgaaaaagttttcgatgtattggaattatttgggaatgcttttaaaacaatttgtaattatttctttacaaaccaaaacagaacagaaaggtgtggtgctggaacatcgatgaaggagccctacttactgagcttagttatggacttttttgatgcatgtgtgtatgtgttttaaaaagtatgcaggctctaaaaatgttattttgtaaagctctcagctcatgcaccccatctcctcttcacccatattatgccttctttctcttgtccagattcttctttttctcttttctaaacagctgagcctgcctactttgcccttttacagcttttaattttatggatttttaaaaatgaaatttcatgtggaatttggggttggggggcaggctgggcaaggaacaaggcagaacactaagtaggccatggaagtggctgttctttcccccaccctgccacaccctgggagaaaaaactagactttggcttcagaaagcacagatgtgacccaggcttactaaagagacaactccacagccctgggaacacacccttgagccaaacttggttgaagactaggtcttccctggcaagttccggaagaatggacttactgacttttatcaactcttctcactgccaaggccaacagcatctgaggtatagctttttgggagtacctgctttcttgcctcctggaggatattttctgtcctgggcttcatggcccctctcttccctgttacacattgctgtgctcagagcctttgcagctgcgacctagttgaatccacataggctccttccacacggtggaagatctgctgcttcactcacagaccaggagttctcaatcagaggtggttttgtccctcaggcctttggcaacatctagagacagttttgattgccacgcctggaggtgggatgtgtgtgctactggcatctagtggctgctaaacatcctacactgcataggatagtccccactacccccagccaagaattatctgactccaggggtcaatattgccaagactgggaaacactgatatagacagtgttgtccctgcctcctgggttagggtaaattttcaccccaaccctggacaaacagtgccttttgacactcatgcaactgttggggaaggactggactgggatccttgaattctccccagactttgacttttgataactctgcatatagcaagagtgattcttgaaagagctgtggctccatgctgaatgcacacatgtactcagagggattcaggtgggcattgttctggtgtgtgctgtgcaatggtgggaaaggacaaagctctctaaactgtctagagcaacctgccctgccccggtgtgcttggaccctttgcccagggaaccaggacatcagaaataatgttccttctgtggaaggacaacggggagctagggtagcaaagagcaataaattccaactctttatgaggtcaggagtcctttaaaaaagcctatgtcttggtctttaactgtccccttctgcaagatgtgactctatacacatggagacagattgaagaaagacttcacccatcttctaggaaataaaatcctgctcttgtcttctcccagtcactcccttatgcactgaaaggagaatttgactcccttgcacttcaaggccaggtgcctctccactagacagtcagacaaaggcaaataatggaggatagagagacaggtgttcattaggctggccatagggagaggaagggggtgacagcaggggaaaagaaactgtagtatcagttgtcacaagtagagctcggcccagctttccctcccttcccagccaccctagaattgagagtcccagtgcccctagtgtcgactttctatgtacatcctaggggtgagggagtgcggggcaatggg

SEQ ID NO: 14856 - DNA, 63385 bp, Human
  misc_feature (1)...(63385): n = A,T,C or G
taaaaatacacattcacattcaggagacagcaggggatgggaggttgcaagtgagaagtgcatgctgactgaggccaggttttggaaagccatgactgaagaggagttcacatttgactggtctatagacacccactagaggttccccagcaaggaagagacaccgggaaagcagtttttggaagattcacctgacagatgggtagggggagggaggaaagccccttcaagccctcaggctacatgtggttgctccagataccgttttcctctcaaagctgtcaagctgtctaaagtctgtttcgacctgatttcacttggatcccaatactgggaggggccctgggaggaacctcgtaggcatttggtgagtccgcatagtgcgtctcacattgtgttgggccatgggagctggataaaaggagaaataagaccccgttcctgcctggagcaactctctggcagtggaaatggaggaaatctgagatatacttcagaggaaaaaaatgacaagcctggagcacaggctggcaagattggatataggaaggaaaggcccccttgagttggcataaagtctgaggtttctagcccaggagactaaaggcaggtggccaccgcgctgagcaaagccggctggaagaagctaaaggttgagctcactgtcattaggaggcaagtccttcgtgctgctcctgtttctgccaaggacagactggagtggggacttttccgtaactagaacgtaaaagggggaacagtccctcctctccagcgtcaatttttggcagccgacgtcgtctgccccgctccttgaactctgacatgcagacacctagaaagtcagacactaaggtaacagccataaaacgccgcccagaagggggcagtgaccaaaagcacgttcactggcccctgggaaccgcctggcgcctgccttctgcaaagtatcattcccgtgtgggctgagcctggggacaaaggtccggcgctcagcagacacctccttggaacccgaggcctggaaacgaaggtccagagtccctcatcttattccaaatcctggcgctcggaatctaaaaccctaacttgatggcaagccagtcagaaggtattaaaaaaaaaaaaaaaaaaaaaaacagaaaaataaatgagccccgacttcttgggcgaaagggggtggcctttcctcaaccccacccgctggtgactcacctccctccaaaccagggcctgcccctcccgcgcctagggctgggcgagcagggcgggcgggtactaaggtgggctccatccccgagccccacgcgggcggacaagctccggcgtgtcccctcgggtgtccctgtttactccgagcccgggagcgaggtgggggcgggtcctcgcggtccctccccaaccccgccccctccttcgcaggccccaatcccagtccggtcttccaaagtctccaaatcaaagctcagcctttccctgcaccttccccgcggactggcggtccctgtccccaccccgggcagaggaggcaccttcagggttcccctagaaaatcgagcctcggcccagaccactgagtcccggacgcccccggagggagcctgaaatcctagagtatgacactgagtttcaaaggggagccgctcagctctccgcccactgcccaatcccaccctcgaccccttctgctctctggagcaccagggaggagggcccagccaggggagagggcgccccaggccccaaactagccagcgagtccccgggaccctcactcttggaccgctttccagaactccgaaccctgtcgcgggtccgcgtcgccctcccccgggcagcgcgtcaaatcggcgcatgcgcactcactggattgccgcgtagctctttctccccccacccaccaaccttttttctttccccgccccttccctccctccctcctcaacccgtcccctccctctcccccatcagcccccccctcggcacttcagtccggggaacagcggtgcgagctccaggcccatgcactgaggaggcggaaacaaggggagcccccagagctccatcaagccccctccaaaggctcccctacccggtccacgccccccaccccccctccccgcctcctcccaattgtgcatttttgcagccggaggcggctccgagatggggctgtgagcttcgcccggggagggggaaagagcagcgaggagtgaagcgggggggtggggtgaagggtttggatttcggggcagggggcgcacccccgtcagcaggccctccccaaggggctcggaactctacctcttcacccacgcccctggtgcgctttgccgaaggaaagaataagaacagagaaggaggagggggaaaggaggaaaagggggaccccccaactggggggggtgaaggagagaagtagcaggaccagaggggaaggggctgctgcttgcatcagcccacaccatgctgaccccgccgttgctcctgctgctgcccctgctctcagctctggtcgcggcggctatcgacggtgagtgagattccgcgtcccccttggacccctgggggcaccctctccccagcccccactcctgcatacggatggggaagggagacgcgggagggggtgccttttgttatcccagtccagctgacacagcagcggcccgactgggggcggggatggggtccgatttgggggatgggggccctgggcaaatgatgcttccggggccccccagcacaaacaaagaccagaggcctgggtagagagaagagggctccccatttttctgatcctggggaggagaggccttcttttcctatctctgttcggggagggcctccgcctcccctacatcctcacaaccccccaccccccatctgaattgtgaaggaatccggatttgcaatgttcggctgcaaaagggggtgggggtggggggggtggcttttgcactggcctctgtagctcgaaaggggagccaggccaggggtaccctgccgggcagagggcaggcaggcccgggaaggctgtgggtggggagagggagggccccctgcttgggcgtggaatcgaccccagagccccggctggaggcctgggtgctgaagtaggctcttccccctctcagggcctctgtcagtagcctggggtagggctgtgttggggggcagagagggggagctcgccatactatgtgactttgaattttccttcttaattcctgggagctttgagatgaaaaaacgtcagatgtcatcactggggaaggggactggagaatggcctggaatgctggggtaggagggtgggggaggctgccttcttcctgacttctggcttcatcacagtttggattggaaggagagttggaggttggatggggattatggctgtgcccccacactcctttagtaaatctgtttattccctgcacccctccaagcccaaaaccccatacacacacactttgtatattgcagagttaggcttaggctagaactgcatccttttggggaaatggggtgcctctcttccctttttttgtcagctgtttttttctcctacttgtgagtcactggttcaagtcttgcccaagctttaagcattaagctggggtcatggggttgggctgggctaggtccctgatttgagaaggggtgggatctcatcccctcctgtcatcttagccctctcatccaaagacaaaactgggctggataccatcatacaccccctcctctgtcttgccagattgggattgggaaagtttttctctgaaaccagattatctccctccctctccctaacttgcttcaattgggggaggagacttacagggtcaggaagcagctgtgtccccaaaaaacatatttagtgtccctcagttgtgccatcttggggactctctaccccccacccccaccccaccaattagctgccccggaggaggagaggggcttttcctgaatatcctccagatgccgcacagccggcttctgcctataactcctgtcattatcatgtgtttttctcttgttctcagccctgtgaggtgagaagggaaatcgaggcagggagattggggttgcagccgcttctgggaggaatagaaaaaaaatttgagagagagagagacccatcaggagccccttgaaggagggtggctagagttaggcagaagcaagagggtttctgtggagagcagggaaggtcaggaagggaccccagatagcatcactcccagggctctaaaggagttctatttgccacaccaagttagtggaagagagagactggacatgttctccttaactatctccctaccctttcttaaaatgttcacccacgccccctctgtatctccagctcagatcaaactatccaaagccccaggagaggacccctccccaaacacacaccaatatttctgccttgggagtgggaatataaataatcagctccaccccactcttgggtacagggtggtgagaaaggggaattgcatagaaatgtaagttcaactctatccagaggcagcctaggggatcccttatccctaacccctgccctcttgcctcagggtccatcaacattgaactttcttgtttactttccagagaatggagatgacccagctcacctgacttagtatgttaccttcctcctgctatcacagccttgctgctttctctccagggcagcaatcctaggggctttcccacctcttctgctttctcttctatgcctgaaactgcctctggggtcccctgccctttggggagtaacgtcactccccactagcgacaaaattgagtgtacctgctgctggagaggttgcagaaagatggggtggagaatgggactattgagggccctgctgagattggggaacattttctagtggggagggcacccccagacaaatacagctcacagaataaggctgacttcctccctccctttttcctgaccttcctccacacacccccttgagccggcatattaccagttactagagtaggtacagtggaagtgagttatgaagctggggtgttagcttcctggatccctgagagaaagttctaaactcctttctccctgatcagactcacatcctaaacgtctccctttgcctcgttgtcttttaaagcaagaatgtgtaagaaattcattttggggttggagggatattttgatgtttagggctgcttcactagacatctttttcttctgatcttgttctctctcctctcttcattttctcaaccacccttccaccactgagcctcccaaaggatgacagcccaggtcctggccagagtcagttcctgtccagatgcccccattcttcaaaaccccttccttaccttttgggaagcccttccttactcaagtctatctctctttcctcctgctgcagtgtgagcccttgcacatcagaacccccaagcctaggtttattcccgcccagtactctcttctcagggtcctcctcactcctcagactctttacctttcaggtcctccagctctgcgtgtgggctcattgctcttggggcatctgggtgcagctgaatggtactgcaggaaggcccctgacttggtagtgctgggtatgagcgatagagaacctgcctccctcttctgtcccagatttcagcctggttagcaggatcctgcattgtttggagaaggaagcagttggctttggagtgtttccggtgcaatggcctcaggcaccaatataaaccctccctgggaaagaggtgaggggtatatgtggagagttgtccctcttgctcccctaggggagatgaaagcctctccctctcccaccaggccttagcttccctggctgaagagctccattttcctccctcctttctaccctcctgactccaggggtggtagtggtccctattctgggtctcccttgagtcaggcactgcctagggccgagactctgtctctccaagataggacagatcttgctcccaccctactctaggctcagcggggtagtcattctctgggttcatcccaggacaactgtgtcatccccttggcaatctctggactgagcccccttcctggcttttctggctgtctgtctgtctttctgtctgtctgtcattagtgtgcgctgtcttggctttttagaacctctctgtctctcaccctctcagttcatctcttactgccgaacctttgtgacattctctgccctgctttctgcgtctctgtcacttgtcttatttttctctgcctgtctccatttacccccatccaggcctcttggtatcccaaaagcttcttgggagcaagagtctctctgggctttcccactcaccccctggctccctcccctctgttttggctatttttcccccttcctggccagacccagtgtccagttcagcaccaaaagtttcctctccactttcctccgacttcctctttcttcttccccctccactaatttggggaatgggttttggagagaatgtttctggaagaaaggaacttgataccctttgtgggctaagagggagaaaggaggtatttcagaaggaaggagggaggttagacttctggcagaacttcctcctgaccaggagcctaagaactggagaaagatgtaaggagtgagtcaagaacttggagcttttactctggtgagcataagctgtgtgtgtggctggggtggggggagaaggagaggaggcttagaaatgcctggtgagtgatatggtgacctctggaggccttctgggggtctggcttttatttgtggggaaaggaaaagctggtgggggaggtcacgggtcaggctaatgtcctgctgcatcaatattgactcagaatggaagcggagacccttcccctcccctggctgtccaagccaccctgtctgtctgtctgtccaggccgcaaagcagaggcccagactcaggaatgacaaaaatgtgtctgagcctcaggaaagagccactgggcaacacccaaaatacaaaaaattcagtgaaaacctctcggtttgggtttgggaggcccttgctgccccacccccataaggtcgaaaattcagattcctgcaggctctgtccccgcgccgcccccccaccccaccccccgcaccttgagcatcctcctcccactctgttcccttagctatatcatgtggttccctttagagaacccccctctcacctagctcagaggggagcctatctctccttctgctgtgtccactcttaaaaagggccccaagagtccctgtcatgcttttgcagtccctgagtctccttgtcctttaagaagcacctctaaggtcttagctctcttccttgctctcgctccctcaagggggtatcaaaggatgggttcccctcctctggagaagactccttcagggttggacttcgctgtcaccctctctggccaggcattctcaccccacttccccacccccaaggtcccagaatgggacacagaatgacagccaagggtcaagcagggcagtggggtctgtgttgtgtctggacgcacacccaactctacacctcctgccctggctccagcttggtggccctggggaccgtggctgggctgggtgcctgggtttgggggggtggggcagggtgttggccaagttagcatggcagtcacattcatcttcaggcaaagccgagaacagacggcccctgtgtcctggtgttcttcctccaaactcgctctctctccttcctctctagatctctccttcttcttctcctgcctgtcttccccttcttctgtcccattcttgctcctctctgtctcccctatgcccttccctcctctctgaggagccctgaaggccaccccttaaaatcctctccccactgccagggccagagaacgacagcgttctccctgcaatttcccttccttgttttttgtttttgttttgttttgtttttgagacacagtctcactccatcacccagactgaaatgcaatggcgtgatctctgctcactgcgacctccgcctcctgctaatttttgtatttttagtagagacagggtttcaccatgttgcccaggctggtctcaaactcttgacctcaagtgatccgcccatctccgcctccacctcccaaagtgctggtactacagacgggagccactgcgcccatctggtttcctttctttctttcttttttttttcttttgagatggaatctcgctctgttgcccaggctggagtgcagtggcgcgatctcagttcactgcaagctccgcctcccctggttcacgccattctcctgcctcagcctcctgagtagctgggactacaggcgcctgccaccacgcccagctaatttttcatatttttagtagagacggggtttcaccgcgttagccaggatggtctcgatctcctgacatcatgatctgcctgcttcggcctcccaaagtactgggattacaggcatgagccaccatgcccggcctggtttcctttcttaacccggctgcatcccatgacctatgaggaaaccacctgctcagttaccagtcaccctgtgcctcagctcccccatgtgtgagaggggggccgcaagggcacccacctcacagggttatagtatctaagtgagttaatagtcaccgtatttccaatcagtggctggtggttagcaaggtgaaaaaggttagctcccatcggtcagggagacctccgggttctctcatgcgggccaggaggcggggaaggccttagttgcttttgaccttagggcaatgttgttctctcatctaaactgcaggccacaaaggtgggttttctgggtgctggattcagacacagaaggctctgctgaggggagtggggttggctttccctctaagcagattataagggtcctaccccgctcccaactcagctctctcccagctctgagtgaggcttcccttggctgtgtagactgtcccaaagtagtttatttgtttctttcttccctctccccctgaaggaaatcaaagacaggcctcagccttctcgctccagattcctgggcccttcaacaccagccctgacaggaagttctttcacgtatctctctgcaatccttgtgctggccaggccctcgggagatgtggccccctcccccggtgctgctgtgggataggggcctgggccctcctcttcctttcacttgtcccatcccccatcccctccctgcaagagcacatctggtttgtgaatctctctcattccagcttttggagtttgccagctgctgtttcctctgtggagttcaggccaaaaatgggggtgggggacagcgggggggactcagtgagggctaaaggagggggcaccatggctgggatgtggaatggaggggaggttaggtgaccacccggtgacctcaggccgtggctgtgcgctctgcccctgggaggagcagggcatggaccaagtcccaggtgggtggcacgggggtctgtttctgggctccaaacatctcatctgcctctgagtcccattccagcccccctcttccccctcagccggccacggctggtcaggggaagcggacggttctccggcatgctaactaggctggcgggctgtgtttcccgggaagacctcacagctggcccagtggggcaatgaactcagcattatccacctcctcaaggggcctttattccaggctcagggtgggggccaggggagggaggctgaagggggagcctggctaggccatccttgatgtgtttcctgaactcggtcattttggccaggggcctgagtgccgtctcccctgccagcggtgggggttaggagggaagacatctcagtgaggctcccatcagactccctccctcctaagagccccccccccccgccattttccttatacttctgtctctgccctgcatttgcattagttgggtacagctgtcttctcaggcgactctggctcctgcagggcagagggtcatctcaccctccttggcaccctgatgcctagtgcagtgcctggcatagagctggccttcagtgtgtgccagcagaatagaaatgtgatggcacagtctgaggaaaagccacgaaaggccaggagactgggagctcagccttgggtgggggagaaggggtgggtgactgttcctcctgtggaggatgtggtgatagaggttgggaggagtgggaattcggaggactggtgtggatttcactggttcagagcttggagtcagcttagctggttttgtcacttgccagctatttgaccctggccaagtcacctggctcaatttcttcatctgtgaaatggtggtattagttgtccctatttgtcatactgtggagggaattaaatatgatgatacatggaaaaaactgctttaccacagttcctggcacatactgagcccacaataagagttagttgtcagccgggtgcggtggctcacgcctgtaatcccagcactttgggaggctgagatggatgtatcagatgaggttgggagttcgagaccagcctgaccaacatggagaaaccccgtctctactaaaaatacaaaattagccatgcgtggtggcgcatgcctgtaatcccagctactctggaggctgaggcagaagaatcacttgaacccgggaggcaggggttgcagtgagccaagatcgtgccattgcactccagcctgggcaacaagagcaaaactctgtctcaaaaaaaaaaaaaaaacaacagagttagttgtcaccattcttaattcctccttgggggatgagggaagagaatggggtaggagtggaagaagcctgattggggtgggagggtagggccaagaggtcctgaatatagtagctaactagttggactggactgaaaccagttcctagagttcatttcagccatccccctgcctctgctccccaattctgatatcttgaaaatctttaggtgcttcttaactctaaggatgtctactgaaagtctccctgaggtctaaccaagggaggctgtgtctttagagaatggagaggacaaggcaggtggatcacctgaggtcaggagtttgagaccagcatggccaacatggtgaaaccccgtctctactaaaaatacaaaaactagctggacatggtgatgcatgtctgtagttccagccactggggaggccgaggcaggagaatcgcctgggcccaggaggtggaggttgcggtgagctgagattgtgccactgcactccagcctgggggacagagtgagaccttgtctcaaaaaaaaaaaaaatagggaatggaaatggaagcaaggctctctaccctgcccattcctgcccagccttgccctcctgtgcctctgctaataccatctccaactactactgtgtgtgccaagggcatccctccccactgctcccatctgggggcctagtgattaggggttgggaaggatggggtgatgggtcaggggaccaggagtgtcccagaaggcagggaagcagagaggttagataagaccagctcggggcctctagtagtaggagttagaggaagacaaagagaaaacatgtcaaggcctaaatgcaccccccttcaccatcactctgtcatcaaagccagggggtgctggtgtctgatgagagtaaccaagaatagcaaaggctttgaccctgactcccaggaacaggcagcctagaggacttggaggggtgcagtaaaatgtgcttctggatcctccccacccccaccgcagatacacagtgtctaggaactacccaaagccaccccctgacacccccaggcacatagaccatggctgagggtctgggccagatggagactgatgctagggaaggaagagcagtactaggggactttgggttcacagagttggcctccatccttcatttatatccccttttctttccttgccctagcccctaagacttgcagccccaagcagtttgcctgcagagatcaaataacctgtatctcaaagggctggcggtgcgacggtgagagggactgcccagacggatctgacgaggcccctgagatttgtaagtaccttttctggattcttctccccaaacccttaacttatccctcttcctttggcagatgtttgggaggaggacagctgatccctagcctgatgtggaccttgctcagtgattgtatttgtccatgacacagctaaaactgtcctttacaccccttcaaaatgcttggcatggtgcctgttgggcttagaaatggcacctcagatttctccctcaagtgctgcaccccaagacagtgttctctgggctgacagctttgctagaagatggcccggcctccctttccttccagctcttcccttattccacctctcagcctccctgacccttgatgattggccccaggtcttgtcggatcctcagatcttcctctgtcctttggctcccaggccagaggccactggcacttgctcagccccataccagaagccccacccctgtgctcttcccgctacccccgccttcccctgcccccagtaagtggtgtaatcggaggcagctgttttaactgggagaaaggtccccgcccagcttttgccctgccaagggaagtggagaacttgttggtgggaccccagagtcctgggtagctggcacagtcctggtggctccacttttagcctctcccctgcttggttaatctgggccagggtcaaagcgcccctgcattcctaggtccgtctctgttctctctcttgggctttatcctgctccagtcccatctggtgtcctgtccccacacccccacccgtaattatcaggggtaattttagggctggaaagggagccactagtgggctctgcctcacccctacactctgccctggagggtgggggccaggggtattcagcaagtatatctacggcatggtgcttcagcctggagtctcttcttgtctggtgccacctgcacccccacacttttgaccctgatgcttgggcgttagaagtaaagaaagccatgcagaagggtcagatctgcctctttttgttcattcttccttcaatttgctgtaaacctcaccttatatgcattaccactctgttcacactcataccccccggactcataacatcacacacagacccacctggcactgatgagcccacctcccacccaaaggcacaaacacattctcacagtaacacagagtcacactcaaatgtggatgcagaaacacactctatactcagagagatgtccccagacacacataccaacatagagacacacacacacaaacccagattgattcacatggaaactcactgaggccagatacaccagcatacagaaagacacacagatacactctcactacctaccgctgcatgctatacagccacaccatcagttgtgtaagcagactcccatccaggcacacatgggtcatagacactgtcactcacacaccgtgtccaggcttgggggccaatagacagtggtctctctatctcatccatcctcttgagcaacaaaggaagttgcagagatgatatgaccagttggccacaacctttttttttttctttttttgaaaggtgggatctcactatgttgccttggctgatctcaaactcctgacctcaagtgatcctcctgacacagcttcccagagttctgggactataggcgtgagccaccatgcctggccagaccacaacctttgattcttcccaaatccttctatcaggcttgttgctgtggggttggaagtctagaatagtgctgtccaatagaaatgtattgcaagccacatgtgctattttgaaattttcgagtagccacttaaaaaaggtaaaaatgaacagatgaaatgaatttgaatattttatccaatggatccaaaatattatcactttagtacagtgtattcatataaaacctttagagatcttttgcatttttctgacattaagtcatcaaaatccagtgtacattttatacttacagtttgaacttgccgcctttcaagtgcttgatagccacatgtgactgggctacgtattgggcagtgaaggtctagaagatttggcaccactcttggccctgggttctgcaacctgggagctatgggaaggagtttttctttatcattggagtttctctgccatggaccctgcttccctcagctcatcaaaacctttttttttgtttgtttgttttgagacagatctcgctctgtcgcccacgctggagtgcagtggtgcaatctcagctcactgcaacttctgcctcctgggttcaagcgattctcctgcctcagcctcccgagtagctgggactacaggtgcatgccaccatgcctggctaattttttgcatttttagtagagacggggtttcaccatgttggccaggctcatcttgaactcctgacctcaagtgatctgcccgcctcagcctcccaaagtgctaggattataggtgtgagccatcactcccggcatcatcaaaaccttttactgacctcagtcgtcatcaaaaaccaggctgtcttcagcctgtctcctgagcatagaatgttgaggcactggggtccatgggaatggggcatttggagggtggactctactgaaggcctagtttctacctccacctgtttgcctacaggtgtgtggctactgtggggaatattgtaaaagagttccaggtggaagagtctaactagccccgaggcctcctgagatctgaaaccccagttttatctcccctcatccccagtgaacagctgaccagagagccaccatagccagcttgttcatgcccacccttctgtctgccctcaggtccacagagtaaggcccagcgatgccagccaaacgagcataactgcctgggtactgagctgtgtgttcccatgtcccgcctctgcaatggggtccaggactgcatggacggctcagatgaggggccccactgccgaggtaaggacttttccactctctactctcccgtctggatgcagcatattatcagcccaccttccgaggactgtcctggcaccttcagtggggatgaggccttgtcctggtcccctgcctagatttaccttcagagagcagatgaaattgatgtgccccttgggcctggagcttggtcagacagccctgtgggcctcagccgtgggctgtagcctgggcacttccctctggctatgtgttcttggactagtcactacctctctccaggtggcagtttttcttctgtaagatgagagatcagtgttttcatacttttttaaaaatagtatgatcctttcttcaaaaggttttctgcatgaaacctgagtgtgaacacagggaggagcagaggtgctgtgactaaagcttagccatctagtttagtccacctgccgcccctacgggtgccctagaaggcatcccccaggagctgcagatctttgaggggccctaaatctgccttggtccctccctctctgacagtctagactgtctgaggtggttgataggaaagccatccaggccgaggtgggaacattaggatgacaagtcagactgcttccagcctgtggctcaggtcaccagctctacagtctttcccccaaagggccctgtgggccatggagagtccggtcacagcgtgagcatttaagagtcgtgtccggggaggcagagcctcaagcctgcgtgttagggaatagtggcttctcccttctcttttcttcggggtctgggcccggagcaagaggccagctttgagaggccatgagcgtagccctaggggaggggctgtgcttgggtgtgggggcagtgtcctgtgctgtgtgcctgagaaaacatctgtctgtgggaggagactcatctggatcctgttcactaggagcagggaggatggagcaaaggagtttgtggaagatttttctccctttctttggttgattttgcatgttttcatctgaagctcctgggacgggatgcagaatgcgggcctgggggctgacttaaatgaccacgcgcaccccttcctctcgtgtggtgtgtgttcaagcttacttccttttgagtacctttacagtctctaaaacaacagagaacttcaaaaacctcaggtctgaatttccttctctgatattacagaaatcggcctcctcattccctcaccctatatccagaaaagttactcttttctaggttttccagagcaaatgatattttccccctctgtggagaaaggctgggcaggcagcatgaatggctctcgggtggaagtggggaggagaaagaatcgctggggcctggccccccatcccaactcttcctggcaggcttagtgcctctaaacgtcttagcatcttgggcggctctctctcctaggtgggggtggagtgggaagccagggtgtgaggccgctggacaaaggggtctttgtggccaggctgcctggccccacgcaaggccattaactgggtcgctggtctgggggggcaactgctctcccacctctcccccctcctgtctcattcccttctgtctcccctgtggaagtgggtcagtggcaggagaaagattagaaaagaatccagaggggaccagttttgctcctccttcctgtcctctacctgggccttaggccttctctctgaggcctctagggctccggggatgggttagacaggtgcttccaggccagagctgggatcctgtggggacagacacgattccatgcccacttttcagccccagctgaagccaacattgtaatccccaggcagtgtagatgagaggcatatcaaagggataagactcaccatcccctcttcctgttgaccccaacaaagtgccagaacccctctccatggggacagaggtagcccagaacatccagaacagagacatgtgggttctaagccatcactggctgtgtgaccttgggcttgtcttatagcctctctgggcttcagtttcttcacttgtgaaatatggtagatgcttcctaaggcccttctgtctctgacactgcagcccttagaagtggtttctgaaggttgactgggtttaggggaaggttgtggcctgcgtggagctgccagatctggcggcctgaatatgtgtctctcctgcccccacacagagctccaaggcaactgctctcgcctgggctgccagcaccattgtgtccccacactcgatgggcccacctgctactgcaacagcagctttcagcttcaggcagatggcaagacctgcaaaggtatgtgagtgcatgtgcctgtgtgcatgtgtgtgtgccagtagccagttgaggtgggcagggaggggcagagaggggtagggggcctggctggaataagaaactagaaggaaggtgcaagagagggggtgccaccaccccagggcatgactgtgagccctaaccatttgcttccactagacttctaaaaattcaccttaaaattatagtttatatgtaaatttttctgttgtaaaaaattagagcattaacagataaaaccaaagtcccctttgacaaatccccctcaattccggtccccttcccatctccctggagttcaactctattatcagtttgctctctctctttcaggcccttttttgtgcatttgtctctgggtattcacagaaaatctaattggaagtactgctcaagagtactgcgtgctcttttttacataaacaatagtatactgtgtatattattttcaatgtttttcactcatcagtatgttccacaatttttttttctgtgttaatatgtaaagatctacatcattcttttagaaaccactatgacgtatgacttttaccacagtttacttggtcacctccctgttgatgagtgagatgttcccaatttttcactgctacaagcaatgcaaacttttctgttttaaatttgcctccctcgggtctttgtgcaaatgccaccttctcagtgaagccgtcccccgacccctctaaaactgcatccctgccatctgcattctctatccctgttctcttttcattgcactagcacctctaatgtatactttatttactttgtttcatatgttattatagtaactatatttcatttattatctgaatataagtttcatgaggacagcaatgtgggtctattttaaagttcactgatgcacccctggcacctgacccatagtagggactcaataaatcttccctgcgtggatgagtgatatgtacacgagtgtttctctagagtggattccaagactggacttgctgggtgttaaggtttgcacatttcatgctgtaatagattctgccgaactgtccttcaaggtagctgtaaggatggacatgttgatcatgtctgatgatcacccacttcgttgcccttgtcacactggaaatgaccacattcttgccctttcctcggcagattttgatgagtgctcagtgtacggcacctgcagccagctatgcaccaacacagacggctccttcatatgtggctgtgttgaaggatacctcctgcagccggataaccgctcctgcaaggccaagaacggtgggtggggttgcctctggccacagtgctaactaagccccctcaatgctgttccctggtgggtggtggcctgagaggtggtcctagagccctggctgcacggactcttctcttccccattcccagagccagtagaccggccccctgtgctgttgatagccaactcccagaacatcttggccacgtacctgagtggggcccaggtgtctaccatcacacctacgagcacgcggcagaccacagccatggacttcagctatgccaacgagaccgtatgctgggtgcatgttggggacagtgctgctcagacgcagctcaagtgtgcccgcatgcctggcctaaagggcttcgtggatgagcacaccatcaacatctccctcagtctgcaccgtgagtcacctgctctcagcttggagggctggggagggtaggggagacagggaaggtggaccctatcttgaacagaggccgggagttacacaggatggtcctgtctggggcaggagaagcaggaggctggatacaatggtgtgtgtttgaggcaggggcagagccaccggcacgctccctcccagctctctgagcaagtgtctggatggcccctgcatttctggccaagggctgagggggcagtgaatggtcaatctccagagaccagggactgtcccttctctgagaggggagtgttgactagactgcagagggactttccggtgcagtgggagccaaggctagggaaagaaggagcggaagcctgaggtgccctgttaggctgcagctgagggtaaaggagctggggcccagctgctctgtctccatgggccatcgtttccctcggggaccattgccaatggactctctgctgccatcgggggagggcagtactgaggttatttctctgtggctttgtggcagtgaatgaggctgggagaggagcgtgagccacatgagattttagaatatcctggatgcttccattcaggcttctccctaggctacacttttgctatcctagttgtggaagaaggggtgtcacagaaaggggcacgagcatagctgggtgtagacccactgccgggaacagccctgcccatctcagaggctgttacaccagcaaccttaaaagtcaacatctggcagcatcacatttccaaagaaatgcaccacagggctgagaggaagaatctggcctgtggttgatctgaccccctaagggagattaacttgatctgtaactgtttagtaaaccagaattcccatctctgccttggtttcctaatctgcataatgggtttgagcttgtctgtctagatcagattaactggagtgaaagccagtggtaaaggacagcacactttgaagttgaggattgtgaaccttgggcctctctagaagatcttcaagtttctttatttggttcttgtgatgaaaagaaagatcccaggaggttacaagggattcattctgggagagagaaaggcccctccccgggatggtggcgagcaggggttcctctgagagccctcactctccgtggcctcagcgtaaggttcacatttctgcctttggctcctccagagcatccctgatagcgtccttgggctgctgctgtccacagctcacctgtgatcagacatgtgtcctccttggggtgctgagctgggggctgtcaagcctggttggctgagctcttaacgagtgggcgactcagggaaccccatggctgatggggtgggattggtgctagaccctcttgtgcagctgccctccccctgttccttgtccactgacctactcaacaggcctgtctgggcagacagcttgtcagtttcctccccagccctgcatcttgccatacagtgggcttctgggtaggtggctatggggtgtcctggaggtaaccttctcaacttctactctggcctcatctccttatctgacttcctccccaggagaagctggtagccctcccttggcaaacagatttgccttgcctcccagtctgctaaactcactgggcctctcaggggcagagtccaggaggctagaagagtccaaggggaaatgcttgtggggtaaatgagtgggtttctctcatcccagcttctgtcccttcctccctgccctccccctgctccacgtccctgccgcctgaatgtctggctgtcaccctgaggatggttgttttgctctctcccacaaactaattatgggtcccaaactgaggacgtcagtgtctctcccctagcccctcccccagtttctgggtcatccccctccccaggagatgctgactggcctgccctggtgtgtagggtggctggtcccaggcactcacctgcacagtggctgctggcctgtaattagctccccaaggaggacgaagaagaaaggctgcagctttcccctgctttcactctgccctccagggcagccctccctgcaagccttccattctgtgctgtgactgtgacctctgttggacccctggggctgagcctcatgcagcaggggtgcacacagagggaggagtctgacaattgaggggtgttcgagccagcgaggccagcccgctggtgcaggcagaagggggagcctgccccagagaaaactctggaagcagaaatagaatagaaagaaggaaggaggccaggaaatgagcctggttcacatgtgtcctgggccatgtgagtcagacctgttgtggagtcctgagagcccccgagggcccccctgaggccctgcagtgtgtgaacattcctcttcaatgccccagggctgctgaccctcctgcctcaggcccagtgttatccccctggattgggtgggtcatctcttttcctcccacctgagattacctccccctcccctctgccgctggcccagtggtttggggaggtctatgaggctcgaattccaagaccagagaactccatggtgagagccggaagagaaggcaagacccttggccagtaccaagagcagccctggctttcactactgctttctcaaaggggctatgcattgatttgattttagatggtacctggacaagctttttttttttttttttaactgttatagttacgtttttatttgatatgcattaggaaactcctgtaactagcacatcaaatctgttacttcagcaattgtttagcatgcagcgaaataagaaaagtaagttaattgaaataactggtaataaacagtagcgcaagctgtacataagcatggtagacattttgaaagtgatacacaaaagactaaagttctgaaaattgaggcccagagggatcaacaggcctgatagtcccttagtcaggaaccaggcctgcgcactctcacccccacctctgaccagtctctcagctccagaggcctatggagcctgtaacccagctttgtccagcctcctgccaggctgcccctgggcaggcctggtggtgcagtctaccgaccccagcccagccctgcatttcctaagctgagctcctctgatctgtattcccttcaccttggaggatgccaccactgtagaaagaatgaggcagactgcaagattggggtcctgggaacatgggtgtgtatggtgaggggaggttctgaggttgtaaatagaggccttgaaggaaatcgggtttgctgaagtcactcaggagtttggactgtgtgtgaaaggatggtctgaaggggctctcagaggtctcagggttcccctccctgcaccatgctgcatggggaagaaggaggtggctggggagctcagcaaagggcccctaggctgcaggcagcaaggttgcgaaatgggtcccaggtccagctggccaacttcacttttcccttcctctccctttcttttatttatttatttttttagtgtgtgtgttttcgaaatcacaacaggaaatggggtagtgatttgtctagaggggaggcaaagaaggggcagacagcagtccctctgagtctaatgaactggctgctgctgctggaaggggtgctacctccccactgtgctgggcacccctggaccctctcagcctcccaccctgcctacaaagcacttccagacttcacatgtgaaagctaaccatgcccatccttggcctttctgacccatgggatgccaggctgtttggggaggggtgcctggacacacacagatacccacatactcacacagaacctcatccacgcccaagcatggtctagcaacacacacagattcccccacacaggcacatgcctgcccaccttccggtctgtgccattgagcagtatcgtctcgatgcggtcgtagaaggcatccacccagtagaggcgcccagccgggatgtccaggcttagcccattgggccaaagcactgtcttggaggtgacaaagatgtctcggtgtgagccatccatccacgccctctccagccgcccacgccgactgtccttggggtcctcctcccagtctgtccagtacatccacctgtgggcagcgactggtcagcatcacctgggnnnnnnnnnnnnnnnnnnnngggtgtaaaggacagttttagcaccccactctttggccttaggccccctgcatcctggcacttttgcttcccattcctgttctgagtttcctaatcatttaacagctcactcttgctcctcctctctcctggcccgggccagccctgtgtctcccggcccagatccagccctgtcctctcctcccccgctgtctccttgaaattgcctctccacccagactgctcccagcactccccttgctgttttcaagccaaaggaagtaacttaagcaagagagatgtgttttagagcccggcaaggatttctcaatagagggaagaccctaagatgggctgagtggaatccaggcatcatccctgggatctaggtcgaaatgcctcttggggacctaagccaggcaggggaaggtagcaggacataaccacaggctggaatcacaggcaggagcaggaagagagcccaggagaacgaggtgacacaacacggctaagctccagactggctggtggaaggaagagctgaagtcgggacccagcaggaaacaaggagcatgaggccacatcgtttagcagagcttctgccaggctcgccaggaggtctccttcccaccttcgaagtcctcagactctccgccatctctcccaggcccaggcgagatccctgagtaggattactagacagactgtcctctcccactgtcttggagtgtcccaaggccagagaggcaggatcctggcagtagaagagagggggaaaatgatgtcccagctctagaacaacagactcagtcttcaataaatatttgttcaatggatcaatacatgtgtgtcagacgcctgagacaaagacaaaaggcagcgctctccttacagtatttgcagtcaggtgaagaggccatgatcaaagaagctccagaggcctatggagcctgtaacaggaaaacttccttctttttttttttttttttttttgagatggagtctcactctgtcgcccaggctggagtgcagtgatgcaatcttggctcactgcaagctctgcctcccgggttcacgccattcttctgcctcaggctcccgagtagctaggactacaggtgcccgccaccacgcctggctaattttttgtgtttttagtagagacagagttttaccatgttagccaggatggtctcgatctcctggcctcatgatccacctgcttcagcctcccagagtgctgggattacaggcgtgagccactgagcctggccttgaaaacttccttctaatagggcaagcttccttctgggagcctgagccgagtcttgacgagtagtaggtgttagccccaaatggcccacctggagggcccacctagagtcaggaggccacagggctctggctggaggcacagagggcgacttggtggaaaaggtgggaaaggatgggttcagggaggggaggacatggtgggaaccgcagcccccatgtggggagtgtttatcatgcaccaggcctcatgctaagtgcagttagtgtaccatccagttttacaaatgaggaaacagagactcagaggcattaagtaacttgctcatagcctcagttggaaggtgacagaaccagaattcaaactcaggctgtcagtgtctagggcccagttggacccagggcagagcagaatgatatgaggagaggtggggaggttcctggaacaagggccagaatctagtgtgctccctggggatgtggatagaggtccagggacctctttggatgtgtatacactcttgggtgtgtagatgtgttgggtgacattttctcaggacataaaggcttcttccttccttccgatttccttattttagagcaggtgactagaatcctgcagctgaagctagagtctttttgggcatggggtgggtcccatgtgtttgggaaagcagccaccatgtatggaaatgcctcttgaacaatgggaatgatggagaagttgagaaaagctggagttgtagtgagtgcagatgctgagcagtgggatggggtgccaggacaccaggtctattctggggcctggaactgaaagtcctctgtgccataatgggcagctgtggtctctcgtctgactcctgcacctcttccctgcttcctagcctccctcttcatgcctggaatcccctgcccctctgcccctagaccacccccaactccttccacaacacagcctccctctctcccctttggtttatttgagattctcctgtcctcaggattttcggcctttggccagagcctcttcagaaggtgcgctcaggtggttggcccttagaaggctgggcgacaaggggacggctcccctcagggttggtggagccagaatgctcaggatctctgggctgaagcccaggactccacctggaccccaattcataagacagagaggggtggcccagatactgcctatagggcagccctggaggcaaggttcctcctctccctttgagcccatctctctacactggccttggagtggtggccaagtgtatgtgtgtgtgtgtgattgtgcgtgcatttgtgtgtgcatacgtgcgtatgtgcgtgtgtgtgtggtggggcaggcagaggaatctgaactttaggagagagaaaaataatgtggtgcagggggttggataacaaaggatttttgcttgcaactaatagtctccagctgcaaaaataccaaaggggaggccaggcaggccgaggactccagttcttgccaactcctcaccggcctgctgagtggggccctgcctggcctttggggaggtggaagggagaccggccaagggtaaatatctgagagcagggatgatctctctgccttccttcccggaattgggagggaatccaggccacatcctgaggctgggggggctgattgtggagctgcacctgggatagcggcatcagatctctgcaggtttcttccttctctctcttgccaagagaagggtggatagggggagcaggggcagggtattgccagccctagggctgggcagtgactcagggaagcctcaggaagtcggagagaaggccggccgtagctgcgccagctggtgctgggaaaacagctttcactgatgaagttcatacacatgccagcagcccccagacccctgccgtgcccaccaagtaaagggcacgcagccctgtttgacttccagccaccctgctggctgccaggggatgcaggcaggtccctgctttgagacttcgatttcctttggaggcagcccagcagcattcatttgaatctgttttctctgtggttacagcgtgtggggcaaagaatttggttgccttacccctgcactaggccctcttcctacagggccttggcctcctcaagctactcttccccctctctccaatcttgtgaggatgggacagtactgggggcccagaggaaagagtggctgggcttggggatgcatgaatacttacgggggtaatacctcgtctctgtggccttgttctccaggcattgggatgggatttagcagagaggacctgaagaagaaactagtttgatgaagccctcagttggctccttcccttcctgtcctgtgactctgagtcagtgtcagggcccagccaagttccttgagagcggcgttcctgttctttttgcccccaccccaccctcacccactgttagggagcagcccctgaatccctgtggggaggagggggaattagggaggggtcaagcagaacagcaagtcattatacctgtagctgtgtgggggcagaagaatccctactgggttgagtatgggtaatggaggatgagtttcagcccaaagcaggtagcccaaagatttctttacttgttggggaaactgttggagatggagttccaggcaggggtcccagaaagtcactgccttaggagtttcccagtttgcaagaggcaccatctctgatggtggtagttgaagggggtagtgagtagatggaaggaagccagtggtcctggagaggaggagcccagaggaggccagcatgtgtccctgtccccagacttcctgcctccttgacttccggccacccttgccctgcctctctttcctttggctcttcttggcttcttccatctcctccagaaccatgcctgaaactgagtctaggcagctgggctccatctccttcccccactcccatcatccttaagccccatctctttctgagccatgcctcagtttgccctgaggattctttcatggccctcctcctagactctctctcctccagccctatgacttattccccacctcttctgaccctccccaggacatgaggacattgagcaataaggacattgcaggaacaggggactggggctgagtagaggaagtttggcccatgtcactggtgcccaaccttttgcccccatggatcttccctttggcatctctgtagagttcatattttgaaatacttttctcccaaactgggtttattagcgtgtaccctgcttttccactttaaaaatttatgccatatgtccagcttccagtcagtgcttctggttagcatgagataactagatttactgtagatggtagataaaagtccagtgaaaagcaaagatgtgtaatgttttggtagcctcagtgctcttatcccaagtaaaagcaaagttaaaaaaaaaaaaaaactggactgagctagtggacctgtgctctctaccttttggtgccccaagaagatggtcccttttcaaggatgggctagaattgggaagtctgtcagtcaaccagccagccagcatttacgcaagccctcctgtatatccactctgagctaagcatgggggtgttgggtgggagggcgtccagagaaggtgggcttccaggtgtgggttctcaccagcaaagggtgggcatctctgcaagagggcctaccccaccccatggctctttcattcgtactctccagacgtggaacagatggccatcgactggctgacaggcaacttctactttgtggatgacatcgatgataggatctttgtctgcaacagaaatggggacacatgtgtcacattgctagacctggaactctacaaccccaagggcattgccctggaccctgccatggggtgagagtggcaggcggggttctggccctggaaggtgggaggctgaggctacagtggtaaggagggtgcccaatgtccagaccccatttaacatgcatcttcccacaggaaggtgtttttcactgactatgggcagatcccaaaggtggaacgctgtgacatggatgggcagaaccgcaccaagctcgtcgacagcaagattgtgtttcctcatggcatcacgctggacctggtcagccgccttgtctactgggcagatgcctatctggactatattgaagtggtggactatgagggcaagggccgccagaccatcatccagggcatcctggtgagggagctactgtctgaggttttgtgggggaaccatgatccagggccttctggtgaggggggaagcctctgtaggggaaccgttctctgagtctcctggtaaagagcgtggatgccccaggcctctagtgggagtggggtgggcttgaatactgcagagaaaggacaagatacgggttccactgtgatgggaacagtcattttagaaacaccacttctgtttacttcctgtttctcatttgacccttataataacccctagctgatgaacagggaggtggttcagttccctttcagcagatgaaaaagcaggatcaaagaggttaggtgatttgcctgtgtttacaaagccgggtgatagcactggaacttgttctagaagccttgctggctcagaggtggcatctccattgtgggataattagtgtgagcaaccagcccagtttgcctaggactgtcccagttttagccctgaaagtctggtaagccagcaaacccttacctttgtcttaggcaaactaggacagttggccaccgcagataagctatgtgggtagtcaggggtgttacaggacttgcttggggcaagtgtgtcctcttagccctcataacagactaagaatgtcctctgtggacagagtttagagcccatctctaattcagtctaaaatcactaaagtgtctaacgagtgcctaattctgtgaaggacagggtttctgccctcaaggggtctgagtagagtgggtgagataagtccacaaatcactgtgccagacacggatagatagcagtgtcacggaggatgtatagaaggagaaaacatctctggttagaagattccataaattctttaaagacatgctctgtagaggatgagtgggatcttggtaagcaaaaatcttcagaataggttagtccagccagaggagacaggagtaaagcattgagttaaaaaatggtggggccaggcacggtagcccacacctgtaatcccagcactttgggaggctgaggcaggagaagtgcttgagcctcggaggtcgagaccagcctgagcaacatagggaaaccccatctctacacaaaatttgttttaattagccaggtgtggtggtatgttcctgtagtcccaactactcaggaggctgaagcaggagggccgcttaagcccaggaggtggagactgcagtgagccgtgatcgtgccattgcacttcagcctgggtgacagagtgaggtcccgtctcaaaataaataaataaaaattaaaaactacaggatgaattggggaatgcaggtcatgaagtctggaggaagctgaggggatctccaggacagagggaggaacccctgtcatctcatgctgtccattcttgcctgcccgtctcagattgagcacctgtacggcctgactgtgtttgagaattatctctatgccaccaactcggacaatgccaatgcccagcagaagacgagtgtgatccgtgtgaaccgctttaacagcaccgagtaccaggttgtcacccgggtggacaagggtggtgccctccacatctaccaccagaggcgtcagccccgaggtgagcagggctccatggcccctccaaagctggctttaccccatgatggctctgggaccttgggatcacagcccctctctgggccctcctgtggggaccctggcttctttcatgtcatgaccgattctcctagccagccactcgggctacctgccctggcccctcagcttcccctgccagcccccatccacccactcagcctccagatcccactctgtccctcccattccccttgccagtctggagcagtagcacctggccatgggcaaccctggaactctcttccctgactactgaagcccccactccaagagtttgaaggctgggttgttggggggcagagggtttccacccctgtggcttccaaatcctaaaatgggatagcaagcacaaagaccacagcagcagggggtgtggtcagattcaggaagccttctcaaggcctggcacaggggctctgaggggtcctaacagctcttcaccctgcccccagtgaggagccatgcctgtgaaaacgaccagtatgggaagccgggtggctgctctgacatctgcctgctggccaacagccacaaggcgcggacctgccgctgccgttccggcttcagcctgggcagtgacgggaagtcatgcaagagtgagtgacagggaagggggtgtgtgcccattgggaggctgcgggagggttcctcaggtgtcccccacagcccggctgcctctgtctgacatgcagggagatgaaggaagtgtcccagagtgtacctgctagtgagggcagagatgggacttgaatccatattcgaaaaaagtgcttttctcactcacccaccggactctgcagaaaactaaactgattcattcagcaagtgtctagtgagcagtgagcactcactacatgtttggcactgttctggtcatcaggattaagcagcgaacgagatagatgttgtccctggcctcatggagcttatagtctagttggggaaacaaataaatgtaactttaggtggtaataagtggttatgaagaaaataaaacagagaatagtcaggcgtggtggcttatgcctgtaatctcagcactttgggaggccgaggcaggcagatcacttgaggtgaggcgttccacaccaggctggccaacatggtgaaaccccgtctctactgaaaatacaaaaattagctgggtgtgatggtgcgtgcctataatcccagctattggggaggctgagacaggagaatcacttgaacctgggaggtggaggttgcagtgagctgagatggcgctaccacactccagcctggatgacagagcgagacttcatctcaaaaaattaaaaataaatgaataaataaagcagagaatagagttaatgaggagagcaagggcctctctgaggatgtggtgtttgagccaagctctctgtgaaatgaagagggcaaccatgtaactccctgagggaggagcatgtccggcagaggaaatcaacagtgcaaaggccctgaggccagtgtgagtgtggcaagccagaggaacagcacgaaggccagcggggctgagtggtgtgagggcagagaaggaggcaggggttggattttattatatctgggataggaagctcatagtgacttttgagaatggaagtgacatgattggattcacatttgtataaaagtcacgctgctactgggtgggggatgggcagtagggaagtagccagaagactttcagtgtagtgggcaagaagtgatgtggtttacactaggatggcagcagaggaagtggtaaacagtgatgtgactccaacatattttgaaggtactccttttataccactgatttcatgactgatcagtgggcacttagctgaaaacctgctattcttccctcatttcctacccttggagtgcagaggtcagaccccagggtattgcggccaggacccatcgtcctgtatgttagcgtgtgcgtggtctgtccatctgacccagagcctcgcatccctaacgtctcctgacccatcacagctagggcattgcagccccttggccgcagcccctgggtggggatgatggtcatgtgtgtgtctgactgtaccctggcttgtgcctgctctagagccggagcatgagctgttcctcgtgtatggcaagggccggccaggcatcatccggggcatggatatgggggccaaggtcccggatgagcacatgatccccattgaaaacctcatgaacccccgagccctggacttccacgctgagaccggcttcatctactttgccgacaccaccagctacctcattggccgccagaagattgatggcactgagcgggagaccatcctgaaggacggtatgggctcctagggatgtggcccatggggatggaagggggctggggcccaggcatctgtttctcggtgccctctcagcaggatggtcccctgctgactggctggctgcactggttggcatggagatgaggggatagacagattgacccctgtgtgacccccttcttggctgagccaaagaggcagggttaggatgggttaggcagcatgggccgtccttgccagcccttgggaaaactcagggtctgtctgcattggcttagagccctggagctgcacacagcacacagccaggggacaactgaggtcttgaattggagacaggcctgccagatcaaaacagggcacacccacatgtatgtgcgcacacagggtctgtgcagctgaccttgcagtcgccaaaaactgcatgctaatgtgtcctgagaaaattgtgttttgtgagttgcatccaggtcttccctctgagctgcttgggcaggttcacagtgcattgtctttttaatgtctatgtgaaggattctgagctgtacgagttctgccccaaatctgcacttgggcctcaggatcaggccgcctccccatcaatctggtggatgccagttataacctttgccctgcaccccatccacactgtagttcagagaaaatcaacagtcagcaatcatatcacaagactttggggaaatcaaaagtaactcatcaggaaaagattaggggtccctataccaagggaactgctatttaaaggacacttggagtgaaggctttggctaagtgaaaaatcacttcctaatttattcattttgttagttcaggatttttaggcctaggatatgatgtcacacttgtgcccagagccacatgcccgttgtttcagctctccatgcaggcacgggccagatgccctcacacgagagcccacatcagccatgtagtttaccatctgccacgtgtggttttgagaggctagccctgatacaaatggcagcacacagggctttcccctattccttttccagcctcctgtccctacccccacccatctgtctagggccccagagggtccctgcacccctctgtagcccagactgctcaaaggtacctgagtccgggagggccagaggcaggcagctttgaacttcctttgaagctgttcatcactggtccctcttcccccaacaggcatccacaatgtggagggtgtggccgtggactggatgggagacaatctgtactggacggacgatgggcccaaaaagacaatcagcgtggccaggctggagaaagctgctcagacccgcaagactttaatcgagggcaaaatgacacaccccagggctattgtggtggatccactcaatgggtgagtcctcccaggccttggggtgggaggagctgggagtgtgtgggcctcagataactggaggatgaaatggacagggaagcaggggaaggcaggtgaggcgggatactttagcaggaatgagagtctgcaaggggagaaggagtccctgtcttcagggaaatgggagtgattccttaaacatagaagaaatctgatcctgtcactcccagttcagggccttccaccagctccccttaccctgagaatgaggcccacgttcttgtcaggcctgcacagccccacagtgtctgcctggcccttgtctgacctcatctgcatcccgcttcccacacttgaagttctgtccccactgcctgctgtctgtttctcaaacaagcaccccggctcctcctgcctcagggcttttgctcttggagttcctcagcctggaactcccagatatttgccggactggcttcttctctacatcaagtctcactcatgccacctcctcatggtggccttctccatcactcccctgacacccccacctgcagcccggtcactctccaccccatcaccctgctttatttccctcctggcctttatcgctctccatgtaaccttgattgacctgtttcttgtgggatgggagctccgtgggagcagggaccttggctgccttggtctccactgcatccatgaatgccaaaactgtgcccaacttacaggcactcaacaaatatttgttgaatggagtgaatgaatgaaatgtgtggtccagtgatgagcaggacaggagacccctgtgaggagctctgggacagcactcatggattgggatcacaggggaggctgttgatggcgggggtgcccaggtgatgctgaccagtcgctgcccacaggtggatgtactggacagactgggaggaggaccccaaggacagtcggcgtgggcggctggagagggcgtggatggatggctcacaccgagacatctttgtcacctccaagacagtgctttggcccaatgggctaagcctggacatcccggctgggcgcctctactgggtggatgccttctacgaccgcatcgagacgatactgctcaatggcacagaccggaaggtgggcaggcatgtgcctgtgtgggggaatctgtgtgtgttgctagaccatgcttgggcgtggatgaggttctgtgtgagtatgtgggtatctgtgtgtgtccaggcctgtgtgcctctatagatgtgtgcatctatttttctgtgcatctatagatgtgtacatctgtgagcttgcatgtcttatgtattgtgttgtttgtttgaggattgcctccatttgcgtctctttgtgtctattcgtgttgtctgtgaagttgactgtccatgtgccagtctctgcatacacaccatgtgcgcctcctcatgtgtgtgcatagatacacggcatgccttggtgtgtgtctgcactctctgcaagtgtgagggcctagggacggcatatctctacacttggtcatttgggttgtcatgtgcttcacgagtcatgtacgtgttctagtatataaggcccttcatgatatggcccctgaccccctctctggtctcttttctccccacttccttcatcccaacactctttgaacaagcagcactagacagcttgctcctcccagcacacgtcacagagcatctgccctctgtgccattactcatgcagttcattccacatggaatgttcaccccagctcctcttcccctggcagactgctcaggggctacctcccctaggatgtcatctccagacccctcttcacactggatcacccgtatgtgccctatctgagacagtgggaagctcaagggcagagatcgtgtcgttttcacctcttactacctactacagctcagcccctaacagatcctggtaaatgttgaagaaatgaatggatgaatactgcccgtctgctcattagtgtgtgtgtgtgcgcgcacgcatatgagtgtgtgtgtgtgtgtgtgcacgtatgtgtgcgtgtgtgtgtttggggactatgaatgaataggaatgagcccaggagaggaccatatggacaacctcaccatcagcatccttgctggatcactcgatcacccgctggcttcaggatctaccatcccactgtgtgcaaaactatcactctctggggctcccaggctaatgggggaaacaaagcaaaacccatgcccaggacatagacaaatgaatgtacaaaacagtgatctcacaggcctccctcaattttcttccaactccttagtaacatcctctccatccctagattgtgtatgaaggtcctgagctgaaccacgcctttggcctgtgtcaccatggcaactacctcttctggactgagtatcggagtggcagtgtctaccgcttggaacggggtgtaggaggcgcaccccccactgtgacccttctgcgcagtgagcggccccccatctttgagatccgaatgtatgatgcccagcagcagcaaggtacctccttggggctgggggcagcgtgggacctggaaggggtggtgggacttaggcattgatttgagacttcccctgggagtgaaggcacttcccagggatcctaggctctgacttttgaggatcctgagaagagaactcccccaacacaatctgattctctgttccccatttcccttcctgccccatgtctgtgtctcctgttcttcaacatgatcttcttcctctccatatttcctctttctgtccccacatcttaatgtgtctcctcccctatcccttctctgacctctcctcacctcttcctccctttgcctttccccatggcccttccccacagttggcaccaacaaatgccgggtgaacaatggcggctgcagcagcctgtgcttggccacccctgggagccgccagtgcgcctgtgctgaggaccaggtgttggacgcagacggcgtcacttgcttgggtatgaggtgcctggctgggtgggagtgggaagcagaccccatcaggaggatgccgaagagtggggaggggaggatccagggtcccagtcagagattaaggaggcaatgaggggcccttagggggccaacaggaagcaagggagggggagagcaaaggctctgggggctaggagggagtttagggaagatgggaggctgggagggacttgtgaggggatggcaattaggggaaactgagtgaagaatggacagctatggatggaaggaggaaattatccttcacttcttttaaatgtatttctccattactaaagtaaaataataaatagttccaaatattggaaattactttgggaggccaaggcaggctgatcacttgaggtcaagagtttaagaccagcctggtcaacaaggcaaaaccccatctctactaaaaatacaaaaattagccaagcgtggtggcaggtgcctgtaatcctagctactcgggaggctgaggcaggagaatcacttgaagcccggaggcaaaggttgcagtgggccgaaatcatgccactgcactccagcctaggcgacagatggagactctgtctcaaaaaaaaaaaaaattaacattaaaaaatacatataatatatatgttggaaattagagaggagaaaaaagcccaaatcccaccagtgagcaccatatattgttagcattgtggtaaagtgaacaccattcttttttcctcaggggggttataattgttttttacatagctgtaatcatctgtttataaaatgtcttctgcccttttcggttcaagtgtcacagcattttctgtgttgttattgcatgattttaacaagccttgttttttattcaaaatgggttgtgttcattgtaaaacggagtaagtaaggccgggcacagtggctcacacctgtaatcccagcactttgggagcccaaggcgggtgaatcacttgaggtcaggagttcgagaccagcctggccaacatggtgaaaccccgtttctactaaaaacacaaaaattagccaggcatggtgtcacacgcctgtagtcccagctatttgggaggctgaggcaggagaatcgcttgaacctgggaagcggaggttgcagtgagccgagattgtgccactgcactccagcctggcgacagagcaagacatcatctcaaaaagcaaaacaaaacaatgaaataagtaaacagtatagaaaaacacaaaggagaaagcccaaatcatcccagattccaccacctgtagataaccactgttaccatttgggggaaccacctcccaaatgtttccctatgatttactttcacataaatggagtcgtgctgcacatactgttctgtttcctgcttttgtcacttgacagtatgtaacgagtacataagcagcatttttaatggctaaaatatatttcatttgataaatttcacgtaatttactcaaccgtttctctactgttggatgtttaggttgtttccagttttttgatataatcacaacccatgtttgttgagcatggactgtgtgctcagcactgtcatggacatttcccttgcagtaatttgtttacccctaaaaacatcctggtgggaaaagtggttttattatccccattttacagatgaaaaaactgaggcccaaagttagagcaggatttaaacccatgaagtttgacccagagcctgttttgtaatcatgcctctgctatttgtcacatcatcatgcctgcccatattctggatggtttccttaggatagaatcccggaagtgaaaatgggtcagtgcagccatagtgtacacctaggagggagtggctggggtcaggagagggcgttggctgagagggttaaggaatggaggggccaaggtaatgggaggatcatccacatggaagttgaagtcaccaagaactgaaccaggagtgattttggagaaagtgctggtgagccaggagctaaaaacccttacagatgacagggtgcagcctgggagccttccagaagtagaggttggtacagaagcatgatgtaaggggaagaacagtccagggaacagcagtgaggagcaaggaggacacataccagcctccaggtccatggtccatgggatacgggaggggaaatcgccacccatggggccatgggaagtttcagagattagagaggggtgggagatgagtcagaccaggcaagcgcccagctgtgaggtctggagaccgggctcacacaggagcctgcacttgtggaggttaccaaggcacagacaaaggacgtcgtgatttagctgctaatgggccaagacagatagtgatggtgaggcatacgttctggggacaggatgggtggagcctgcgcggatgtggtgccatcttcacttctgctggtgggaccgatgaaactgtgaaataaaaagtccagggaccggggcagggccctggggttcccggagatgacttccaaggggaagttcatggagaagtcagggaaggagtggggagagcctgttcggtggtgacagaggtatagaggccatgggctctcttggacaccatttgattctcaggtcacactgaagtacagtaagcattaagtagagtaaacatcactattgttgcttgggaaagaattgcagtttccatccagataatttgtttcatgaggaagtttgtactagaaaaaattactttgtattattaaaaaatagtaaaacaaacaaaaatggtgcaaagggcttagtacttgtcccacgaccggggtctgactttccccctcacgatcctgtggtgcccacagcgaacccatcctacgtgcctccaccccagtgccagccaggcgagtttgcctgtgccaacagccgctgcatccaggagcgctggaagtgtgacggagacaacgattgcctggacaacagtgatgaggccccagccctctgccgtgagtcacacgccctgccccaccctgttggatggcaggcctgcagggcagctcggctctggcagtgcctatactggagcgggcaggaagctgggggcacccaacttctcgctgacccctgactcattccctccccagatcagcacacctgcccctcggaccgattcaagtgcgagaacaaccggtgcatccccaaccgctggctctgcgacggggacaatgactgtgggaacagtgaagatgagtccaatgccacttgttcaggtgtggagcggggctcagatcacacgaggcacccctcagtcaaggaggcaggggagacgagggggccaggttcagtggctcatgcctataatctcagcactttgggaggccaaggtgagaggatcacttgagcccaggagctcaagaccagcctggccaacatagtgagacctcccactctttacaaaaaaaatttaaaaaaactgccgggcgtggtggcgtgcacctctagtcccagctacttgagaggctgaggtgggaggatcacttgagcctgggaggttgaggctgcagtgagccatggtcatgccactgctctccagcctagacaacagagcgagacctgtctctaaaaataaaatgaaaggagcaaaagaatttagggcagaggggatggagccctgagcaggagtggggtctgctatccccttcccagcctgggaaactgagagggctgagcttgcaggggacagagcatagctctagactggagaggaggaacaaggcagggtagatctcctcctgggaggataccagagaccccttgagagaaagagtaaagcatccagtgagaccagagagatggttttgaattctctaagagaaatggttttggatccttggaaataagggacaccaaaggcagagaataatagggaagaagaggcagtgaagagagggtcaggacaatgagtactcacacccatccctgccccccagcccgcacctgcccccccaaccagttctcctgtgccagtggccgctgcatccccatctcctggacgtgtgatctggatgacgactgtggggaccgctctgatgagtctgcttcgtgtggtaagagggatgggcagagggagtcaggctgggcctgggggaggggcatcctgagagcatgccagttgggggtgccggagacacctgcaacccagcacttgggtggccttgagtgagttaatctcggtggcctctgtgagaggagagccccatcatcacagcattgtgtctcagcaaactcatgcaggaaaagcactcagcacaggtcctgtgtctgctgactcatggggatgagtgagtggagtttccagccgaggcactgctgcggggccttccccacccttcctgactgggctaagggctgctggttatgggagggccgctgcactcacctgcccagtactgtgatgctgtgtaatcgtgaaggccctactcagctactctttcttcctcacagcctatcccacctgcttccccctgactcagtttacctgcaacaatggcagatgtatcaacatcaactggagatgcgacaatggtaagagcttgctctcctcacctgctgattcctaagacagctagaggctacagccaggccctccagggaagtcaaagggcttcagaatccagcagggcctccctccaggacactgaatccctgctgggttgcctgggagaaaacaggagaagtcagaaatgcctggagggagccacgatggaccaaggggagaccatcaccttttagtgtcattcctaccccaggcagggcctgagctgcccaccctctagtagggctcggaggccagggagagatgagtgagatgggccagagaggcagagcaaggagaaaccggtgcctgactcctttctccttgcaaacccccatttcctggagtccttggtgcacccctcaggctctgggcttcaggctcagaagcccacctggcagatagccatggaccaggtgatgtcagccttgagccaccagggctagtatgtgtgtaaatgtgcgggcaggtgactgccgtgtgtggtgtctcagggctctgttctgtctgtgttgtgttgtgacgtgctgccccagtggttcctgtcccagctgatgtgtgagcggatgtgttgggtcagtgccacgttgcccctcactttttctgtgtctcgcatgccaatggttgccccggcggtttctgtgtttcagagaaggattgtggggacggctctgacgaacagacctgtcctgagcctgccggtcagtgcatagaagcacatgcaccatcacccagagctcagctggccccagccccctgcaggttctccaggcccctactccagagctgctaggatatgaagaaaaagcaacagagaggagggagagcagaaaacagagggagaaagcaaatagtggtcaggaaagaagcagagacggcagagggagcctctgaggaaaggagatgacagagaggtggtgacaaaaagcccaagatgcaaggggaggagagagttagagaagcaaatccagttggaaaagaggcaggaacataacccaaaccccagtctccaccacatgtcccataaatacagagggtcaagtcaagcagcccccacccaatgctgagaaagcaggagcttccttcagccagcctcagcgagcttggtccagaagtggcccccactcttgccagccacaggcagggcccctgtaagccaggcacccagagcatggtattcagcagtgccagcctcagggcaggcctgtaaagcttgtctcaagccggccacgcctgcaccccacctacctctctccctccaaaactagagaaacccctgcctttcccccaaaagcaagcagacccctgttcccacacctgccagaaaggggaaatgaaatgtttaatgttccctgcacccagcctttctgagcttcagtgaggggccctccaggagccttctcctcctcctcatcctgaccacgtgggccatggtgcatgctgcagtctatgcagtttctgtgtcttttctgtttgttattttcccagtgggggggttagggtgggctgagggtgggttctgggcagggggcccaagctgggatcacagagaaggctgctccaccaactcccgctttgcctctccccttcttcccccaccgccagacaatgactgtggggacaacagtgacgaagccggctgcagccactcctgttctagcacccagttcaagtgcaacagcgggcgttgcatccccgagcactggacctgcgatggggacaatgactgcggagactacagtgatgagacacacgccaactgcaccaaccagggtgggcaccaggggcccgtggggtggggatgagatcgagccccctgcatcagacacccagcctatccatctgtctttcagacccacggtgtgtcggccaccatctgggagccagaggtagcctaggcatggctcttgtccttcaggagctcccggtcctgtgggagagggaggttgccgaaaaatcattgccacacgctgttaatatcatgcgctttgcagttggtggccttgggtttgagctccagctctgcagcttattatctgggtggccttgagcaagttacttaatctccatgggcctctgtgagtttcgtctgcaaagtggggtaataatagcaccaacatcacagcgctgatgtgggagtttagtgagatcacgcacgaaaagtgctcagcacacggcctgtgtttggtaaatagtagcttgagaaaaggatgctgcaggcagggatgaatgagcctgaagagacagaggagagagggcctggctccacaaggctcccagtgccctggcctctggggcccagcctcgggggcggtggggacctagttttctggagggatgggccctctcaaggaatgctggcttcctagctctggaagatgtgcagatttttatgtgaaaactaccaaatttttaacactacagtattagtttctctcgtctcacagttctggaggctggaagtcccagacccaactgttggcagggtgggttccttctgaggccgtgtgggagattctgtcccaggcctctccccagcctccgcggtttgctggcaatctttgcagctccttggcttgtcgaagcttgacccgatctctgccttcatcttcacacggtgtcctccctgtgggcatgtctgtcaccagatccccatttcccctttctgtgaggacacctgtcatattggattaggatacacccttatgacctcatcttaagttgaccatctgcaaagacactatttccaaataaagtcatattcacaggtattatgggataggactaatatctttttagggaacacaattcaagccataccaactggcagttgattttagaagttttaaaaggctgggtgcaggccaggcatggtggctcatgcctataatcccagcactctgggagggtgaagtgggaggatcacttgaggccaggggttcaagaccaacctggttaacatagggagaacccatcttgaaaaaagaaaagaaaaaaaaaaaaggctgggtgtgttgactcacacctgtaatcctatcactttgggaggcaaggcaggaggatcacttgtttccaggagtttaagaccagcctgggcaacatagtgagacccctttctctacaaaaaataaacaaaattagctgggcatggaggcacatgcctgtagtcccagctactcagaaggctgaggtgagaggttgagcccaggaggttgaggctgcagtgagctgtgagctcgccactgcactccagcctgggtgacagaataagaccttgtctcaaaagaaaaaaaaagtttaaaaaaaactacagaccaaactcttcctgcaggcctcatctgacccatggaccactagattacagcctctgccttatagagttagggcacattcccaccctagtaggagaagactggacagcgttgagtgcccaccttgagccctgccctgagagggaggacagagaaggccacaggaagcttgggaaatagtaattgcgtctccagggctatctctgtgaaggggagggtgaggggcacaggtgatatcccttagggttctgagaaggggcctctggaggctgtgtggtgtggtgagaagagctccctgccgctcccagataagctgggcaaatttggacaagttgcttcccctgagcctgggcatcctcctttatgaaatgagctgaggtatgtgaggcctggcgtggaggagcagggtgtcactattggtagcagttgttaactatggtatgagctggatggtctgggaccattcaggaggagttgtgtttagactgcaggtaaatggacaggagggagggtcttccagtggggatggcatggtccggagaatgctgtcgtcaagacttagagggtgaaactgagcacttccgtagggtgacagtggggccaggtggagccgttcagaccgagggaaaggctcgtgcagggacagtggggaatgaggctgtcctcaaagggggcagatgatgacagcaggtgtaaatcgtgagaggcttgatttgggaggcactgggaacctttgaaggatttccaagccggaaggtgctgtgatgtaggaggtgatttcggaacacagccctagaggaagattagattgagaagaggttcaggggccccaagaaaggaaaatcagttcagagactgctgctgaaagtcccggcatgagatgagagcatcagctgggtccagggtagggaagggggaggagcggggtgtctgtggcagcatgagtgtatgagtgtggggctccaccaggcagtgctcctgctcctctcctggcctcctgagtcagatctcaggacagcagccagagtgatcctgacaacataagtcagatcatgccctggccctgccctccagcctgtactggctccctgcacccttggaacaaatgccaagcccctctgcacggcctgcagggcccccacccctacccctctgacctgcattcctgccctcccctccccctgcactctactccagctgtggcgttttcttttttctttttttttttttttgagatggagtctccctctgtcgctcaggctggagtacagtggcgtgatctcggctcactgcaagctctgcctcccgggcagctgtggcgttttcttttctttcttttttttttgagatggagtctctctgtcgcccaggctggagtgcagtggcgcaatctcagctcactgcaagctccgcctcccagttcacgccattctcctgcctcagcctcccaagtagctgggactacaggtgcctgccaccacgcctggctaattttttgtatttttagtagagacagggtttcaccatgttagccaggatggtctcgatctcccgacctcgtgatccgcccgccttggcatcccaaagtgctgggattacaggcgtgagccaccgcgcctggcctgtgtgctgttttctgaagtgctggcgtagtcctatctcggagatgagactttgcagcggctgttccccttgcctggagtgtgcctccagggatcctctgggctcactcgctcttcatgcaggcctctgctcagattccttctgcccagaggtcttccctgaccatcttacctgacagatcacccccatccctctcagcttctacccagctttatctccatagctttatcaatacctgaaattacagtctagatttatgggttatgtcttgtctctcttccccattagaacctaagctccatgagggtagggactttgtctggttcagtgctggccccaggacagcgcctggcacacaggaggcactcagtaaacatttgtggcatgaatgaatgaaatagaggctaaggaggtgggcatttgggctcaggccttagcaaattgcttctccagctgagatctccggtgtcaatggggggattagatgaggtgattgtggggcccttggaggtgtgatgcctcctgactctactactgagttggtgcttccaaggagtgtcagcaaagcttggcagactctccaggcctgcctctgctcatatccccaggctgggcttaccggggtggcagggcacagggatgaggagggctgacctgggcaacccctccctcctgaggccctccactgtccctctgcagccacgaggccccctggtggctgccacactgatgagttccagtgccggctggatggactatgcatccccctgcggtggcgctgcgatggggacactgactgcatggactccagcgatgagaagagctgtgagggagtgacccacgtctgcgatcccagtgtcaagtttggctgcaaggactcaggtgaagaggatggttggagggcgtctggaacagcacaatgtgggcaggaggagaccgtgttgagagcagagtagcggcaaaggggatggcactgtgctgtgtggagtggtgctggggacagtgcaaggcaaaaggcagtccagaggaagcttgtgtgtcatgggtgggggaaggcatgaagggccagagcctgcacagaggacctgagaagccaaaaccctaccagagttgagcttcagcacctcctgctgcagattcctgccttgtttgttgcctatgtgaatttgacccaaaaagcctcggggttcctcgtggaccccacagcgttgcaatcctgaccctattagagaagcccacagggtctggaaggaagggcagggggagccccagtccccgggcctgggccctcatagtgcacctgtccctcagctcggtgcatcagcaaagcgtgggtgtgtgatggcgacaatgactgtgaggataactcggacgaggagaactgcgagtccctggcctgcaggccaccctcgcacccttgtgccaacaacacctcagtctgcctgccccctgacaagctgtgtgatggcaacgacgactgtggcgacggctcagatgagggcgagctctgcggtgaggcctggtcccaggagaagggtagggagggtggctgggtaggagtctgggccaaggacagtctttgggggacctgagtctaggagagagcagctctggcagccgggcaggcgagcagcacccagagtggtcaccagcagcctgtgtggacctggcgctccccatggcgctgtgctgagtgagccacgccattagagcagtttatccacaaggcatccctgggggccaggtgctctgttttctccgtttgacagatgggagcactgaggcatggaggggttccatagtggtcccccagacttgggccaaggtagtacagctcctaaactgctgtggagactcagaccccttgcccacatgcataccacagagagatgcggagtgctcttgtggagacaaaggcaccagggttgactgctgatggtcagggcaggcttcctggaggatgtggggattgcatggggttcccaaggacaggcagtacttgcagagtgagtgagaaggcatgggggcaggcgcggtggctcacacctgtcattccagcactttgggaggctgaggcgggcagatcacttgagctcaggaatttgagatcagcctggccaacatggtgaaaccctgtctctgctaaaaatacaaaaattagccggacatgtctgcagtcccagctacttgggaggcagaggcaggagactcgcttgaacctgggaggcggaggttgcagtgagccaacatcctgccactgcactccagcctgggcgacagagcaagaccccatcccaaacaaacaaacaggcaaggggaggagggtgcccattcaagaccaaaagagatgaggttgggggagtccaggagtcagggaggaccatgtggtgtgacttggggatgaggagcagagcagccttatctggtcctcttagccaggcagagcccccagttccttggaagggaggagtggaagataaggccacagggactggctgggagaactgccgacaggctatcagtcaggctggcagtttccagggtgtgccagaggaccaagggtggtataggccctgctgcaccccaccccaaacccctccaaatcaggagagatcagcacaaggggactggacctaaggacctcccagggtccctcccagggaggcaaaaagctggggcccccgccctgggcccaagaaggcaggaacatatcgagaccagacagagatattgaggggtgctccctgtgggaaggggaggtatggtgccagctggtgggtgcaagggtcccaactctggtcctgagggagcccaggaagtcctgggctgaagctcagcctgaagctcagcaggaatggagacgaatggggccgtgggcagggcacaaggacttggtccaggctgcccaggacttggggcccagcagggccgtggtcttgcctcctctcagcttctgaccctgggtctgttccatgcctgcccctcccctagaccagtgctctctgaataacggtggctgcagccacaactgctcagtggcacctggcgaaggcattgtgtgttcctgccctctgggcatggagctggggcccgacaaccacacctgccagatccagagctactgtgccaagcatctcaaatgcagccaaaagtgcgaccagaacaagttcagcgtgaagtgctcctgctacgagggctgggtcctggaacctgacggcgagagctgtcgcagcctgggtgagacaacagtgaggtgtggtggggcaggccgaggcaggcctctgagctgcagtgggttgggcttggtggccaggtgccaaaggctgagttttccaccctagcccccagtgcccggaccagcagagacctgcctgcgccaggacgggtggcacacaggcagctagccccttgctgaccccatcacatccctcccatcccagaccccttcaagccgttcatcattttctccaaccgccatgaaatccggcgcatcgatcttcacaaaggagactacagcgtcctggtgcccggcctgcgcaacaccatcgccctggacttccacctcagccagagcgccctctactggaccgacgtggtggaggacaagatctaccgcgggaagctgctggacaacggaggtgaccaccgattgctgccaggcaggatgcacacaggcggagcgctcaggcgctaggggccacaggtcccatccaagtggccccaaagcagaggcttggctcccccatcccccacacttctgttcattgggttagattttgctgtgggtctccatgcctgacgccccgtaattatcgtcagcagaactgccagcctgataattaacaaaatgatcagccttacctttgaatggcctggagctctgctccccagatctagaattgcaggcttgaaagaaaaaagccacttaggagtggcgtacctgaacgctgctttctgtcccaggcagcgtggtgcaccccagacttccttcagtcacacacaatagtgagtgcccactgtacacactgggcagtgggcatgcagcagtgatcaaaacaggctgttttcagttgtgtggtcaaggaaggtcccctgagaaggtgacatctgagcaaaggcttctaagaggcacattttactagagaagtttgtattgtttgtaataatacaaacttgaatttgaaaccattacaaatgtccatcaacgaggggggaggctaagtaaactgtgatgatatccacactgtgcaacagtctctaaaacaatgaggcacacacataatgtattagcatggaaaaatctttatggcagtcacttgagctcaagcagttgaggctgccgtgagccatgatcatgccactgcatccagccttggtgacagaagaccctgtctcaaaaaaaaaaaaaaagttggggagacaataggagtcctactcttgaatatgggcacatcagaaactttggcagaagtgccagggttgagggtgggtcatcgagggctcccaggatttcacacattcatgcacagctccccaggagacgctaacctttcactgccctctcttctccagccctgactagtttcgaggtggtgattcagtatggcctggccacacccgagggcctggctgtagactggattgcaggcaacatctactgggtggagagtaacctggatcagatcgaggtggccaagctggatgggaccctccggaccaccctgctggccggtgacattgagcacccaagggcaatcgcactggatccccgggatgggtgaggaccttgcccagccttctcctggccccatggcccccctgaagtcccattcagcctggccagggacaccttactcctcagtgccatctgcctcctcccaccctctacctacgatcccaccacagtcgctccctgagggccctgactttagccctcctgacccctccccactccccaggatcctgttttggacagactgggatgccagcctgccccgcattgaggcagcctccatgagtggggctgggcgccgcaccgtgcaccgggagaccggctctgggggctggcccaacgggctcaccgtggactacctggagaagcgcatcctttggattgacgccaggtcagcaccctctgtgccctgagaaggcccaagtctgtggcaccaggacggggtggggaggaacctgtggtgatgagggtgatgagaaggaccaagggatctagaactaggaacggtggcaaaggactgggcacaggaggaggaggacggaggggcgtggggaggccagggccgaggggagggggcaggtagaggaggcggaagcagggccatcagctgtggttattcacactgtaccatcctctccactcacctgtcctctccactctgttccctctgctggggctgtgtctgcccagagggaggggaaacttctttctaattggtctgcccagggagggtgcctttttcttttctttttttttttttttttttgagacagagtctcgctccgtcgcccaggctggagtgcagtggcgcgatctcggctcactgcaggctccgccccccggggttcacgctgagggtgcctttttctgactttcatcaaagccctgagtgctgacagcagccctggggagaagtgaccgaaagattcccttggggcttgggaatcggggcctgagaggtgaaacctggacctgttgggttctcacaccttggtccttctgtctgtctgctctggccagcaaggcttaggggagggaatggtcccatgctcttcgctgggagggctgtggccagggcccagagggtgggcacctgggcagagctctgagggctgagatcccagctggcatcctcattctgctccatcatgctcttaggtcagatgccatttactcagcccgttacgacggctctggccacatggaggtgcttcggggacacgagttcctgtcgcacccgtttgcagtgacgctgtacgggggggaggtctactggactgactggcgaacaaacacactggctaaggccaacaagtggaccggccacaatgtcaccgtggtacagaggaccaacacccagccctttgacctgcaggtgtaccacccctcccgccagcccatgggtaaggggctcggggcctcgagcagccggaagggagccagcagcctctttagaagctgtagaagctcttaggagaggagagggcagtgagaacaggagcaagtctgtgctgggatggcaggggtaggccggctgttgacagaggcactgtctagcagcagagaagggtctagtagtagcggctgctggaacagggggaggagagtgggcgaggaaggggtggtccatgtagggagcagcaagtcacaggatgctctggcttcttctcttctccaccctgcccccagctcccaatccctgtgaggccaatgggggccagggcccctgctcccacctgtgtctcatcaactacaaccggaccgtgtcctgcgcctgcccccacctcatgaagctccacaaggacaacaccacctgctatggtaggagcccctccctccagagccagtgagcaactgaggctggagggaaggccgcaggccccaggatcccggttgtcagctaaggcagagtcccagtcgggagggtcccgataggagaggctccagagacagccactgtgagaaggggctgcaggtctgccaggggggctgcacccagcggggtatgtccacggagccaagggccagtagcaaacagacggatccagaagaaggcagggcctgaaaccggattggtgggaagcacagaggcagggactgccttcagtgaccagcccatgccccacagagtttaagaagttcctgctgtacgcacgtcagatggagatccgaggtgtggacctggatgctccctactacaactacatcatctccttcacggtgcccgacatcgacaacgtcacagtgctagactacgatgcccgcgagcagcgtgtgtactggtctgacgtgcggacacaggccatcaagcgggccttcatcaacggcacaggcgtggagacagtcgtctctgcaggttcttcctggccctggatgcccaccagtggacatgggcacctccacccgccccttgctcccaaccctggtctacttggtccgagtggtccttctcccagtcctgttccccctcagtgctccagcctggtttcctgatcccttttctccagaaggcacactggctcccctcctgacccactgccctgcagacacccaacaactgactccctacttgtgcccccagacttgccaaatgcccacgggctggctgtggactgggtctcccgaaacctgttctggacaagctatgacaccaataagaagcagatcaatgtggcccggctggatggctccttcaagaacgcagtggtgcagggcctggagcagccccatggccttgtcgtccaccctctgcgtgggtcagtctagggcccagggccggggagcatggggtgtggggctgggaagaagaggaccctgacctttccctcttggcaccctccccccaggaagctctactggaccgatggtgacaacatcagcatggccaacatggatggcagcaatcgcaccctgctcttcagtggccagaagggccccgtgggtacgagcttccctgcccacccccacagcccctccctaattccttgaccagcaggtgcttgcagggtccttcagttgcccctcagcctccccagagccctagcttagtgcctgttctcaccatctgctcccttccctggatccccagccctgggccagactccccggcagtgactcccccttttccaggcctggctattgacttccctgaaagcaaactctactggatcagctccgggaaccataccatcaaccgctgcaacctggatgggagtgggctggaggtcatcgatgccatgcggagccagctgggcaaggccaccgccctggccatcatgggtgagggctgctgggcgaagcagagatgacgcagagcaggccaggccagacctactgggagacaggggctggcttggggcagtctctcaccatgtggggcgggcctgatgacttagggccaatgggcccttcaggagagctgggtgtggggccttcccaagggtctcatcccctcctgctgccccaggggacaagctgtggtgggctgatcaggtgtcggaaaagatgggcacatgcagcaaggctgacggctcgggctccgtggtccttcggaacagcaccaccctggtgatgcacatgaaggtctatgacgagagcatccagctgggtaggtgcgaggccgggcggccgctgggggctcaggggcaacaggggagccgtccagagctgcaggctgcagggccatggggcaagggagtaagtgggttaggctgtacccaccacccaaaggggctccttgtttccttaccacaaaggcgccttgtaggctcccagcagccctgttcacaaggccaggggcccaggaggacagaaaacctgagagctgggtagggtggtgacccccattaggtccagggtagtcagtgaccatcctgtttctgagcagcccaagcctgaccctgaggtcccaaggagggccacctaaccctttccctctgcctcccacctgcccccagaccataagggcaccaacccctgcagtgtcaacaacggtgactgctcccagctctgcctgcccacgtcagagacgacccgctcctgcatgtgcacagccggctatagcctccggagtggccagcaggcctgcgagggtcagtgcctggctttcctcccagccttgtcccagctccccaaccctgacccctcctaccctacagccccaccttcctcttcttaccttggggacaagactacattcgtcgtgtaggggacactggactatgaagtggctatgactctccagtgcctccagtaggattttggaaaaatagatgtcagcaggcagatcggggcagctgcatggaagaggcatgctctgagctgggttttctaggacaagtaggatttggatgcattgttcaaaggagagggaactatacacaaggcaaggtgtgtgcaggagccccagccaagagtggtgggcaaagtgtggggaagtcctggagataaggctgtgagctaggcggggctcctgtgttctgagccaggagtgcctggaaagtgatgtttggggaagatcaacctggccgcaatggtggtggggaagaaacagaggcggttaaaccagttaggaggccattaggagtaatcagagtgtgagatgatgggcctgggctgggctcagtaagggttgaagaaaagaaatgaaacccagacgcatttcacaagaacctgctaactgatttatgagcttgctgggggacagcatttcccaaaagtgcattcctaggagcctccctctttgatgtgggtagattttaccaaaagaaactctgagttgaacaaagtttaaaagtgttttgtgctgcagaacttctcagagccttgaatatgtttatgtgtgccaagaatttttcaagcgtttggggttttccaaaactcacttgaccattcatttttttttcactgagtctgagcaaccagggaccatgtggggattcactttgggatgtgctgtatcaaagggataaaggcaagggaggattctgaggtgcatgggtagtggtgcctcaagacatgggaaaactgggccaggcgcagtggctcaagcctgtaatcccagcactttgggaggctgaggccggccgatcacttgaggtcagaagtttgagactagcttggccaacatggcaaaactccgtctctactaaaaccacaaaaattagctgggcgtggtggtgggcacctgtaatcccagctactcagaagacctaggcaggagaatcacttgaaccgggaaggttcaagggttgcagtgggccaatattgtgccactgaactccagcctgggcgacagatcaggactccatctcaattaaaaaaaaaaaaaaaaaagagccaggtgcgtggctcatgcctgtgatcccagcactttgggaggctaaagagggcggattaccttgaggccggggttcaagaccagcctgaccaacacggagaaaccctgtctctactaaaaatacaaaattagccgggcatggtggtgcatgcctgtaatcccagctactcggaaggctgaggcaggagaatcacttgaacctgggacgcggaggttgtggtgagccgagatcgcgtcattgtactgcagcctggggaacaagagtgaaattccgtctcaaaaaaaacaaacaaagaaaaacaaaagaaaagaaaagaaaaagaaatgggataactgggaatgagactggcttcggagtgaccttagggggttgagtttttgatgttggagagagggtgtggcatagaccagacagagggaggacaaagaggaaactaggatcaggctgagcaccaaactggaagtctagattttggagtcacctagtcctgattgtctggtctgaactcccagactttccctaaggaacttgcaggggtgcagggttgggttgtgctgggtggaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatgatggtggggggggatgatatcaaaggagaagcagagaacagttggagggtgacaggaaccaagtttaagggagtgttggcgatacccatgccttaagtttccttgtctttcaggcgtaggttcctttctcctgtactctgtgcatgagggaatcaggggaattcccctggatcccaatgacaagtcagatgccctggtcccagtgtccgggacctcgctggctgtcggcatcgacttccacgctggtgagccatttggtggcagagggagttgggcgtggcgtaggagctttaggggtggtgtggtgtgccctgagggtccagtgagaggctgcctgaattggcctgaggtggggcacttgctacagctgccaccctgactccacctccccttcaagcacctggcccctccggcactctctcacctctgtcttgagccttgtgagattttgacccctcaccttacccctgccttattgggcatccccatgtcacctcctccacctccagaaaatgacaccatctactgggtggacatgggcctgagcacgatcagccgggccaagcgggaccagacgtggcgtgaagacgtggtgaccaatggcattggccgtgtggagggcattgcagtggactggatcgcaggtgagcagtgggcaggtttgtggggcttggggtgtggcagaggactgggggacgaagtgagaggaggagttggcgggagcaggaagaggagctgtaggggtgcctgggagcttggagacaccaggtccacctgtcctcacctaacctccctgagccccaccaactccctccttaggcaacatctactggacagaccagggctttgatgtcatcgaggtcgcccggctcaatggctccttccgctacgtggtgatctcccagggtctagacaagccccgggccatcaccgtccacccggagaaagggtgaggagctggaaagactggccttgtcattctgcccatggcccatgctgatgaggccctgtctcctccagggtctgaggactgacccccacttccacccccaccctacaggtacttgttctggactgagtggggtcagtatccgcgtattgagcggtctcggctagatggcacggagcgtgtggtgctggtcaacgtcagcatcagctggcccaacggcatctcagtggactaccaggttcgcacgccaacttggccttggatccgatggtagacccctgacccaggctcctgttccctgtgatgagcccattctgggaggacttggagcccaggggaagtcacagggtctcccagcccagccctccacccagagtaggactcctgctaccacagagatgatgggcaggggtcgctcagaagtggggagtgggggagtggagagatgcctggaggtcaccttatcagcagggcagtgggcaggagtgtatgcaggaggcaggagtgagttaggggaggctgaactgagggcctcactctggcccaggcactccctgctgccccagacatggggctggcagcgagctcagccctggaggtgaggtgggtgcctctggcctgtaggatgggaagctgtactggtgcgatgcacggacagacaagattgaacggatcgacctggagacaggtgagaaccgcgaggtggttctgtccagcaacaacatggacatgttttcagtgtctgtgtttgaggatttcatctactggagtgacaggtgagggcttctgtcctggcctcctcagctgatctcttccttccctcctgcctccactgatgccctgcttgtgccctgtccttccctcaggactcatgccaacggctctatcaagcgcgggagcaaagacaatgccacagactccgtgcccctgcgaaccggcatcggcgtccagcttaaagacatcaaagtcttcaaccgggaccggcagaaaggtgaggctggggctctgggctggggtggagaggtgagggggactctggcctgggagagtgctccccagggaacccagtgtgagagggctgggagacaagttagacccatggggcaacttccgatggcccgagagacccagggatggggaggaaaggctgaggtgctctgggacagatcttggcattgggctctgggccctggagggtcattcaagctgggaataccgaggcagagggcagagctttcgccaaagcctggatgacaaaggcaccagtgagcctttcccaaggcaggccctgccctctgtaccctcccctcccccaggcaccaacgtgtgcgcggtggccaatggcgggtgccagcagctgtgcctgtaccggggccgtgggcagcgggcctgcgcctgtgcccacgggatgctggctgaagacggagcatcgtgccgcgagtatgccggctacctgctctactcagagcgcaccattctcaagagtatccacctgtcggatgagcgcaacctcaatgcgcccgtgcagcccttcgaggaccctgagcacatgaagaacgtcatcgccctggcctttgactaccgggcaggcacctctccgggcacccccaatcgcatcttcttcagcgacatccactttgggaacatccaacagatcaacgacgatggctccaggaggatcaccattgtggaaagtgagcccagaccctaagtcttcccaggaagtgggacatggggcggggagcagcacagactcttagaccccagccaggcactctaccctaggtctgaatcccagcagctacaactcagctgaatccaactgcacccccgcagttacatgactcctgatttggagtcagcgtcagcccccgacttcctcccgccactggtcctagttctgccttcagagctgcacagaacaagcgagaggtctctgtggagcccaacgctcacaaacccaggctgcagacatggggctgagctccagtcacttgggctttcaataacttgggtcagtttcctgctcttgccaagcctgagccttctcatctgcgtggatgagtgtctcatctgagacaggattcctcgagctgctgcgcaggaaggcttagctcagtgatgctggggacggagtgtgtgctctggaaagagcagttacagtgtcagggctgtcatcacaggacagcctttcagctctttgaaaactgcatcctgctacattttctcttcttcagcctggttaccaccgggtcccttgactcattcatttgctcatatattcattcagctggtccataaagacctgccaggcaccgaactaggtgctacgtatacagacctgtcctttcagccttttctgggacattttctgctgcacgtagtccagcctgcatgtctgtctaaaaatgtagcacccgaagctaaactcggtactccatgctcgtagcttgatcaggagagactggcacatcaatccccagacccctggaagggatgtcccctcacctccggctgtctgcaggccataccacagcatggccctttggcagccaccatcgcttatagccactaacactctagtcttttctcttacactgctgttcggctgtgtctctcactgtgccttggttctttaacctgagtttaagatgtctgctttataaaataatcaatccagctcagggtctttttaagtagggggctccccagtacagcccaagcaggatttgatttacagaaatctacattgcactcagctcagcagaactgcagctccaggaaagtgcaaacacaccagaaagcccgattgccctcagtgggagagggttgagaggtgaccacaggtcatttgagtgaggacagcagaggttgggggcactgagtcagaccctggtgcccccgagccctctctgctgcacctcttgcactcccataccccacacttcgccttccagccaggagagcacctgccccaggctgtcccccacggctcctgtgcaggctgccctctgggccctcctgacaaatggctgctcctgtctcttcacagacgtgggctccgtggaaggcctggcctatcaccgtggctgggacactctctattggacaagctacacgacatccaccatcacgcgccacacagtggaccagacccgcccaggggccttcgagcgtgagaccgtcatcactatgtctggagatgaccacccacgggccttcgttttggacgagtgccagaagtgagctgctgcctggggatgggggtagcagggagaggtgggactcggggtggcagaaactccccaggcagatccaagcgggggtgcaggagaggcaggccctcacttgagctccacccttccctgctgtgtgatctggggagaggtgcaaaagcttcctaagcttcaggttcctcttctgtgatacaagctggctaagattccagctgcctgcaccaaagggagcatcaggactgtgggggacgctctgcctttgtgattgattcattcatcagagcaccatgttggaggcacagggtagggcctctagctctgggatccaaagcttcaggcaaagaatgtttgtcgaacccttcgtacagaagcctaaggctgggcctaccaagccacctagctgggttgagaagtcatacttgtgggaagtaatggtaactggcacagggctgtatacgggtgaccacaggtgtcatgaaggcagtagattggcccagagcctggaactggaaaagacaaggaaggccagctcggacaggggaagtgctttgagcaaaagcctgaagaaaggcaaattcaaggcagggaggacagagggggacctctgcatgccatagagcataggcaggcctgagcccagccaggaagtgaggtcagggtgcggaggagttaggagcacaagccaggacaggtggcagaaagcacccgggggtgggtgctccccctggagggttcacccgcagtcagcctgctctgttctcccgcaggggcagccctcatcccggctgtttgggcctctagtgagccaccccctcgccttagggatccaggcccacatgttagcaacatttttttcccaattcagcagtgcttggaatgtttttcaaaagctttactaggaaactagtaaacacaacccaaagcagctgtatagatacgtgagtgtcccgaacccagattccccccaccagtcccccaatgtcagtcacctccaacctggctcaaggaccctctgtttcctcctgcctctgtcatctggcacatctgcagctgatgatgaaggtccagtccccccttccatgaccctcggctgcctcacctgtctggggatggcctcagagcctgtccctcatgagtctggagcttccctggagggtccagcaaggctgcctggccctcgtcccagaggacgtgaccccctggctgcccaccaagctcctttcttatgaggccaggggattccatcacgcattcagcgagtggcttttgagggcaaagaaggtgcagaggacccagtggggagcgcgaggggcgtcatgaagagcttcgtggctgtgtgctgaggactggccccacctggaagtcagggaacgtgtccttgaagaggcggcatgttagccagcgtctgaggatggcaggagtggctgggtgggagcatggtcccagtgcccaggagaaagagctgagctggcaggaggggccctccccctggccacaaggagcaggcactttcggggaatcagaaggagccagtgtggaccccagtggagagggcaggggcaagtggagactccaacaacccagcctcctcctgagccctccccgcgtcagcactggagcactgatggccctgtagagctcacagtaggatagttagaaggtccgccatgttcctggacactgagcacctaccccaggaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14857 - DNA, 127280 bp, Human
tgaaatgtgtgtgtatcacacttcactaagatctatatcaaagacagacatcaagtctaatgccacactaaaggccatcggacaaaaccaataaaatatgtcaaataaaatgtcattttaagtgttgtaattggcatttgtgacataggcaattacatgttttaacagagaattccagtatgttgttttagtggtacagccagatgaagtgtgtctgtgggctatcaaagtgggagattggggatactggctttgtttcaactgtctcacgtactcaaaccttagaccatcttatgtacacagatcctagaccagtagttgattttatttattaggtctactgaaaaattcagttggaaataacccaatctgggattaactacttccatattcttttgtataacattttagtaaagctcagtatatcaagtgattgtcatccagaaggggtggatgacaaggtaatcttgattccagagacctttgagtattaattaaaaacacacttttagccaggtatggtgttgcaagctgtagcccacctgcatgggaggctgaggcaagaggacagcttgaacccaagaattggaggcccacctagataatataacaagactctgtctcttcaaaaaaagacttctttttagactagtgttgtatttggtagtattttgcacatgatagactctgtacaatagtgtgggggatacattttttttttttgacatggagtctcgctctgtcacccaggctggatacattttacaagttctgcagtgttcacatttcagatgtacaatcacttggggtagaagacaatgttgctgacaccaacaatgttactgagggaagatcctatggcagaactacggttataaggtattttgtaaaagaaaatctcctgaccaaaatttattagatgcataaaattgtttttaagcaatggagagacataatcactaaactcagtgagctattgcaatcaaactttccagggattgtttccttcaattcagaggtcaccaaggaatgtaaaataagtgcagaggtaggaagcagtgcttcagtgcagcagatctcagtgactttgtgttttgaggctatgtattatccccctgataactttgaagatgaatgttgtatttcataaccagtaaaataattgtgtaatgaggagaggagtaggctactgcctgtgatcatcgaaatgagaatcacataatattcctgtaatgaaatcactgaaactattgggaagggggtgtatttgaagataagtataaattgcaccttctaaaaggcaattttggtattactgatactctccggaaaaagttgaaataaatcaacttggaggtacttagaaaagtggagaaaatgttaggaacaatgaaagaaagataaaatgtatccagtatatttctaatgagtaagtatggaaaattactgtactctgagacggtttaggccaagtctgtgttatggctatctttatatagatagtgcatgtttgaagattggggaaagcttatgtcaataaatgtttatgtacttaatctacatgatttgcctaaaaatcctcaaagttgggatgaaggcattcctaagagtacatttttagacgtcattaaatatacagacgtatccacgtagtttttgttctttcagttaggcacacaattataattattgcactggttaacttgaagcagcagaggctgtagtttcctagtgctgactctgggcgccgctgttggccaaagtggagagcttggcgctccagatctcctcgcgcagccgcagcgcgctttccagggcagccccagctcagactccccagcgccagcctttacaccgcttcctcctcggaaaaagaagaattttttcttgaactggaactgcaactaaagtccgttcggagatccaaaaatctgcaatacagaggttatttgtaacccggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacacgatttatattaggatctgcccatgatgcggatattggtagcaacacactgcagaattaccaactcagtcccagtgatcatttctcactgataaataaagagaaatcagatggcagtaaataccctgagatggtattgaagacacctttggacagagaaaagcagaaatcctaccacttgactttgactgccttggactttggagctccacccctaagcagcactgcacagatacacgttctagtgactgatgccaatgataatgctccagtgttcagtcaagacgtatacagggtgagcctttcagaaaacgtgtacccggggaccacggtgctacaggtgactgccacggaccaggatgagggtgtcaatgccgagattactttctctttcagtgaagctagccagatcacccaatttgacctgaactctaacaccggggaaattactgttttaaatacattagattttgaagaagtcaaagaatattccatagttttggaagcaagggacggtggaggaatgattgcgcaatgcacagtggaggtagaagtcatagatgaaaatgacaacgccccagaagtgatattccagtctctacccaacctaattatggaggacgccgagctgggaacacatattgctttgctcaaagtccgtgacaaggattccagacacaatggagaagtgacttgtaaattggaaggtgatgttccatttaaaatattaacttcttcaagaaacacgtataaattagtgacagatgctgttctagaccgcgagcagaatccagagtacaatataaccgttacggcaacagatcggggcaagcctcccctctcctccagttccagcatcaccctgcacattggtgatgtaaatgacaacgctccggttttctcacagtcttcctatatagtccacgtggccgagaacaacccgcctggagcctctatttcacaagtcagggcttctgatccggacttggggcccaacggccaagtctcttactgcatcatggccagtgacctggagcagcgggagctgtcatcctacgtgtccataagcgcggagagcggggtggtgttcgcgcagcgcgccttcgaccacgagcagctgcgcgccttcgaactcacactgcaggcccgcgaccagggctcgccagcgctcagcgcgaacgtgagcctgcgcgtgttagtggacgaccgcaacgacaatgcgccacgggtgctgtaccccgcgctgggtcccgacggctctgcgctcttcgatatggtgccgcacgctgcagagcctggctacttggtgaccaaggtagtggcggtggacgcagactcaggacacaacgcctggctgtcctaccacgtgctgcaggctagcgagcccgggctcttcagcctggggctgcgcacgggcgaagtgcgcacagcgcgtgccttaggcgacagggacgccgtccgccagcgccttctggtcgccgtgcgtgacggtggacagccaccactctcggccactgccacgttgcacctggtcttcgccgacagcttgcaggaggtgctgccggatatcactgaccgccccgacccctctgacctccaggctgagctgcagttttacctagtggtggccttggccttgatctcagtgctcttcctcgtggccatgattctggccattgccttgcgcctgcgacgctcctccagccccgcctcctggagctgcttccagcctggtctctgtgttaaatccgaatccgtggttccccccaactacagcgaggggactttgccttattcctacaatctatgtgttgcacatacaggaaagacggagtttaatttcctaaaatgtagtgagcagttgagttcaggacaagacatactttgcggtgattcatctggggccttatttccactttgtaattccagtgaattgacttcccatcaggtgagtttcctttaagtataatttaatgctcattgcctacccatttctccatattcacaagaaaatatacatatttgcaggaaaatatataatttttagatgtcatggatcattttaggaaagttgtagtcagttaaaaagctgtcatatcattctacaaaggaggagtaaagtaggagcaattgtgtggcccaacatttgtttgttttttagccaagcttagatttataaagcaatgagggtgtggttttaaccacaaagtgaaagtgttagacagttgttggctctctcctaaaaagtgaatgagatttttcctatacattttccttcttgttgactaatatatgatgaatacttttttcagcttggatataccataaatataaaaataataaagccaaagaatttaagctaaaattcaacacttttcttaactaatttaactggtatggtctccatagtagtccactgttttgtttcctgtgttaacttcccttttgtttcaaaagctcttagaataaggagtcaactggatttttatgtccatggaccccttgtgattatatgcagtgtacgctgtgtgtgcgtgtgtgtgtgtgtgtgtgtgagagagatccttttacttagaaaaaggtctactatgctcattagaagatcaaaagcagattctccttacttgtaacataggagtttcaggattaatctgtattcaagctcattctatatccttcatcaaagaaaagacaatgttttgtgtctgttgtccctctcacacacagccctaatatataatgtgtaactgccttatctgcagccctaaactaatatagctagaggtcttctaatcattctcctacctctaggaaagaaatatagtcttgaaaactgccaatctggtgtgcatacaaaatatatacaaaataccaaggaacattatatgagccttttgctaggtatatctaagcaactgcttcagttaatggccactttacaaattgctgaaagaaggaaacgtctttcgattcttttttttttctttttttttttttgagacagagtctctgtctgttactcaggctgtagtgcagtggcacaatgatagctccctccagcctcaaactcctgggctcaagcattccttctgcatcagcctcctgactagctggaactcaggctcatgccaccagacctggctaatttttctgttttcagtagagaaaatattttctttcactaatttaactggtatggtttccattgtctacccagttttccatatgcataagaaaatatattcacaggaaaatataaagttttcagatttcatgagtggttttaagaaagttttagtcagtgaaaaaactatcataccagtcttcaaaggaagggtgaaataagttcatctgctacgttgcccaggctggtcttgaagggaaacagacttttttgtagtcatacttatcctttggcttcttagtaagtattatatagtcattactttttgcagttttttagatcaaagtgttaatgtaggtaaagttaattttagaatatatgtaaaagtcaagtctgctttaaatttaatcatctctttggtgaaagggatgggatggagctttgctttttatcatatattcatctgtacctttcaagtattcaaatagaaaaatataaacaatgtaaataaaatagcaaaacaatgtaatatctcataaaactgcaatggtaaaagcatttatcctattgaaattccacaatttttatttgaaaatattatcgacatgtaattcaagtggcatttagaagaataatttaaaagcaacaactctatagaaagcttgtaaaatgattaagtagtttaaaccaaataaaacaatttctgagtcagtcatctccagtaggtctattttagtctcaagataaattcatttctggtgacaactgaagttcttagttatttgttagtatatattggagacatttacaataaagcttagagcacaatgggaaatgaaagtatcatgttttttttaagaccaaatgtattgcagaaatgtgagtaatttaatccgatgctacaatctgatcattctgatctaatctgatcatttaataacactaaataaaaccttcatctcacattctttggctgtttcttttaaaatatgggtttacggataaatcaaataaattcaaaacaaagtaataagcaaatgatttttttttctcagtaatctagtagagtattacatttagaagtaatctgtatctcagtgcagtaactatttaggactgtaagcgccgctgttcacctactggaagacaaatgcaaccgaaaacactcagatctcacacctcacgaagacccgcagatgccacaaactaactgctggactgcagcgaaacccgacccctgtttggaggcactccaggtttccggaggattgtcatctccatagctgcggcaagaaactaaataagacccatttatgcacagtgaagattctgagaggattctgcagcaaaacaacaatggccgctccacagagtcgccccagacgcggcgagctgatcctgctgtgcgcgctgctgggaacgctgtgggaaatcgggaggggacagattcgctactctgtgccagaagagacggacaaaggctccttcgtgggtaatatctccaaggacctggggctggacccccggaagctggcgaagcacggagtccgtatcgtctccagaggtaggacgcagctctttgctctgaacccgcgcagcggcagcttgatcaccgcgggcaggatagatcgggaggagctctgcgctcagagcccgcggtgtctgataaatattaacaccctggttgaggataaaggaaaactctttggggtagaaatagaaataattgatattaacgataataacccaaaattccaggtcgaagatctagaagtaaaaattaacgaaatcgcggttcctggagcacgttatccactcccagaagctgttgacccggatgtgggcgtgaactccctccagagctaccagctcagccccaatcaccacttctccctggacgtgcagactggagacaatggagccataaacccagagctggtgctggagcgcgccctggacagggaggaagaggctgctcaccacctggtcctcacggcctcggatggcggcaagccgcctcgctctagcacagtgcgcatccacgtgacagtgttggatacaaatgacaatgccccggtttttcctcacccgatttaccgagtgaaagtccttgagaacatgcccccaggcacgcggctgcttactgtaacagccagcgacccggatgagggaatcaacggaaaagtggcatacaaattccggaaaattaatgaaaaacaaactccgttattccagcttaatgaaaatactggggaaatatcaatagcaaaaagtctagattatgaagaatgttcattttatgaaatggaaatacaagccgaagatgtgggggcacttctggggaggaccaaattgctcatttcggtggaagatgtaaatgacaatagaccagaagtgatcattacgtctttgtttagcccagtgttagaaaattctcttcccgggacagtaattgccttcttgagtgtgcatgaccaagactctggaaagaatggtcaagttgtctgttacacacgtgataatttaccttttaaattagaaaagtcaataggtaattattatagattagtgacaaggaaatatttggaccgagaaaatgtctctatctacaatatcacagtgatggcctcagatctaggaacaccacctctgtccactgaaactcaaatcgctctgcacgtggcagacattaacgacaaccctcctactttccctcatgcctcctactcagcgtatatcctagagaacaacctgagaggagcctccatcttttccttgactgcacacgaccccgacagccaggagaatgcccaggtcacttactctgtgaccgaggacacgctgcagggggcgcccctgtcctcgtatatctccatcaactctgacaccggtgtcctgtatgcgctgcaatctttcgactatgagcagatccgagacctgcagctactggtaacagccagcgacagcggggacccgcccctcagcagcaacatgtcactgagcctgttcgtgctggaccagaatgacaacgcgcccgagatcctgtaccccgccctccccacagacggttccactggcgtggagctggcgccccgctccgcagagcgtggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagatgcgctcaagcagagcctcgtggtggccgtccaggaccatggccagccccctctctccgccactgtcacgctcaccgtagccgtggctgacagcatccccgaagtcctgaccgagttgggcagtctgaagccttcggtcgacccgaacgattcgagccttacactctatctcgtggtggcagtggctgccatctcctgtgtcttcctcgcctttgtcgctgtgcttctggggctcaggctgaggcgctggcacaagtcacgcctgctccaggattccggtggcagattggtaggcgtgcctgcctcacattttgtgggtgttgaggaggtacaggctttcctgcagacctattcccaggaagtctccctcaccgccgactcgcggaagagtcacctgatctttccccagcccaactacgcagacatgctcatcagtcaggagggctgtgagaaaaatgattctttgttaacatccgtagattttcatgaatataagaatgaagctgatcatggtcaggtgagtttagttctttgcttgcttttaatttccagatgaattttatttggcataaattatgttttgaaaaacattgtgaagatagttgaaaataatttttaaggtgtatcacagagttttgggtttattttggtggtgttactataaaattgaactctaatagtcataggttattgtttcatttgcttttaaacgacttggaaaagattgttcaaccattttaagccttccagtattttattcctattatcactcattcacttaagaagtagctacccgtccatactggtaattttgctattgtttgtttgtgtgtgtgtgtgtgtgtgtgtgtgtgtgtgtgtgtgtgtgtatcccaaactagaacttcagaaaattatcaagaagtctaaagccttgttattagcttagcaaaagtaaaatatatctcagaatttttagggttatgtttagcatttgaacctgtaactaggctcttgtagatttcttcactttaaacctcttttctgagccctgtttctgtaccagtgcccttcaaaactttaatacttcttaccatccttcaaaacatgaacaaactttaaagatggatcttggtgggagatgagactggttactaaatattaagtatgtgagtcagtggtcacctgggctccatgcccatggagacatgaaatctaaagcctagaatgtccattgctcccccaaacaaaaaacaaaagcaaaaacattagatctgaattaaaatgtaattttaaactgttgaaagtgacttttgtaaaatatgtaagaacatatttcaatacaattccaattagctgtttcggttgtgcattgatgtgaagtggtgagaatgttgatattaagaaccaatgtttcaggtacacaagttctaaataagctgatcaattcaattaaagttattcagtcttggctggacacagtgcctcatgtctgaaatcccagcactttgggaggctggggcaggaggaccgcttgagccccgggggtttgaaactgcagtgagctatgatcatgccactgcactccagcctaggtggcagaactagaccctgtctctaaaaaaactattattaggccgggtgcggtggctcacgcctgtaatcccagcactttgggagactgaggtgggtggatcacctgaggtcaggagttcaagatcagcctggcaaacatggtgaaaccccgtctctactaaaaactacaaaaattagccaggcatggtggcatgcgcctgtggtcccagctactcgggaggctgaggcagaagaatcacttgaacccgggaggtggaggttgcagtgagcctcgatcctgtcactgcactccagcctgggcaacagggtgagactccgtctcaaaaaaaaaaaaaactaatattaatagtaaaaactcggtataggctatccattattgtattcctgcataccttcttgtagcatttgaataaagctaatacctgaattgattgttgtaaggtagaagtagatgacccaataaatgtttgttattaatgaaaaggacatttcctaaggattgtgtagtgttctactgtatggtgcatattcagtggagtgggagttaacttcatagtttgtgtaccatttggatgcacatttgagaggacaacatattattggcactttgcaattttaaaaactcggatgaaagttgccctggtaggaaagaaaatccttactctccctaaaaatgttggctagttgtttttattaatctgacaaatggactaaagaaggttgaccaatgtccacaaatttatgtaaatgaacttatgagcttcatttatccaattccaaagtcatttcagataggataataatgcaatccactagaatatccctttgtaccttgtattgcagaatagataagcatttccccaataactcttaagaatgaatttatgtactgtaaaagatatgacataagagaagtattttgagatatgaagaagagcaacgtagtagggtatatcatttcttagctacatcatatgggcagtatacttgaatgaatatttcctgaagtagaagagtaaagaaaaattatttttataaagaatgttaatatagtcaggaagaggagatgtttggggattggtataaaattgccacaactttacaaaatagttttaaatagtatagatttccctaatatgtgtaatataaaacactagaaatattggggagttggaaatcatagaaatgaacagaagaatgataaaattgtttccatagctaataaaaaatgaatttttgaaatcagtatagtatgaaggctctgagagcaagaactgtatcatattaattattatattgccagtgacaagggcaatacttagttctagctaagagttcaaggtatgtttgcagaatggtgaaagaatggaccaatgtatgcaggtttgtataaaaacccaacgtgatatttctaacaatttggaaaacagagaaagataccttaaagaagttgttataattttttattaagtatatggacgtaaaaacttggcttgttaagttaggcacacaaaaacaattactgcactggttaacttgaagccgcagaggctgtagtttcctagtgctgactctgggcgccgctgttggccaaagtgcagagcttggcgctccagatctcctcgcgcagccgcagcgcgctttccagggcagccccagctcagactccccagcgccggcctttacaccgcttcctcctcggaaaaagaatcgtttcctaaactggaactggaactaaagcccgttcggagatccaaaaatctacaatacagaggttatttgtaacctggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacaagatttatactagaagtagcagaagatgcagatattggcttaaactctctgcagaagtataaactctctcttaacccaagtttctcattaataattaaggagaaacaggatggtagtaaatacccggaactggcactggagaaaaccttagaccgggaacaacagagttaccatcgtttagtcctgactgccttggacggtggacatccacccctaagcggcaccactgagctccggatccaggtaaccgacgccaatgataatcccccggtattcaaccgagacgtgtacagagtcagccttcgggaaaacgtgccaccaggcaccactgtgttgcaagtgtcagccactgaccaagacgagggcatcaactcagaaattacttattccttctacagaaccgggcaaatctttagtctgaattcaaagagcggagaaattaccactcaaaagaaactggattttgaagagaccaaggaatattcaatggttgtagaagggagggatggtggtggactggttgcacaatgtacagttgaaattaatattcaagatgaaaatgacaatagcccagaagttacattccattctctacttgaaatgattctggaaaacgcggtgcctggaacactaattgctttgatcaaaatacatgaccaagattctggggaaaatggggaggttaattgtcaattacaaggcgaagtcccttttaagattatctcttcatccaaaaattcgtataagttggtaacagatggaaccctagaccgagagcaaaccccggagtacaatgtcaccatcacagccacagacaggggcaagccgcccctctcctccagcataagcgtcatcctacatatcagagacgtcaacgataacgctccggttttccaccaggcgtcctacttagtcagtgtacccgaaaacaaccctcctggggcctccatcgcgcaagtctgcgcctcggacctggacttggggttgaacggccaagtctcctactctatcatggccagcgacctagagcctctggcactggcctcttacgtgtccatgagcgcgcaaagtggggtggtgttcgcgcagcgcgcctttgactacgagcagctgcgcaccttcgaactcacactacaggcccgcgaccagggctcgcctgcgctcagcgcaaacgtgagcctgcgcgtgttggtgggcgaccgaaacgacaacgcaccgcgggtgctgtaccccgcgctgggtcccgacggctctgcgctcttcgatatggtgccgcgcgctgcagagcccggctacctggtgaccaaggtagtggccgtggacgcagactcaggacacaacgcctggctgtcctaccacgtgctgcaggctagcgagcccgggctcttcagcctggggctgcgcacaggagaggtgcgcacagcgcgtgccttgggcgacagggacgcggcccgccagcgcctgctggttgctgtgcgtgatggtggacagccgccactctccgccaccgccacgctgcacttggtctttgctgacagcttgcaggaggtgctgccggatatcactgaccgccctgtaccctctgacccccaggctgagctgcagttttacctagtggtggccttggccttgatctcagtgctcttcctcctggccgtgattctggccgttgccttgcgcctgcgacgctcctccagccctgccgcctggagctgcttccaacctggtctctgtgtcaagtctggacctgtggttccccccaactacagtcaggggactttgccttattcctacaacctatgtgttgcacatacaggaaagacggagtttaatttcctaaaatgtagtgagcaattgagttcaggacaagacatactttgtggtgattcatctggggccttatttccactttgtaattccagcgagtcgacttcccatcctgagttggtgagtttcatttatgtctattctttttcattacccacccaattttctgtatttacatgaaactatcgtacattttcaagtccaatgagttgtcttagggaagtcagagctgctcagaaagctgtcctaccattctttaagaggagcagtaaattgtgagtttttatgtcgcataaaagaagtagccttatagatttacaaagtagtgagagtttgctcttagcttcctctctagcaaaaacatttggtgcgtttttttgtcctctttctcaaagctaatgaattttacctattcgttgtctcattctttaacatgtttatattttattgtatgtagataaaccattaaatttaatgtatgtaatcatttaattcatcttttaaagcaaagaaactgctagtagatgtctttcttcactgatttcactggtagttttcatctctttcttatgttcctcatatatgctttcttattcctacctaatggatttatgattttttgaatctcctaaaattttattaaaaatactatatgttggctgggtgcagtggctcatgcctgtaatcccagcactttgggaggccgaggcggttggatcacatggtcaggagttcaagaccagcctgggcaatatggtgaaaacccgtctctactaaaaatacaaaaattagctgggtgtggtggcgggcgcctgtaatcccagctactcaggaggctaagacaggagaattgcttgaacctggcaggtggaggttgcggtgagccgagatcactccattgcattccagcctgggcaacaagagcaaaactccatctcaaaaaaaaggaaggagaaggagaggaagaagaagaaaaatactacatgttatgtgtatgagagagaaagagagagactgattcactgaacttagaaggtccaaatcatccaaataattttctaagtttatccaggttttcttggatgcaaaatccttttccacctctatataattaccagaagaaacttacaaaaaaaaggaaatgctattgcctgaatttctcttgctcggaatcctgacatattcttgaagaaggggaaaaagacaccggatttgtcttatcgtttggagctttaaatataaatgactggatgttttctcaacatccttgtaggatggaaggtgaatacaggattattccatttttaagacaaaaactactagtcttgtgtacatacaaagctcccattacatggtataagtcttttgcttggtttcccttagtatgtgattcagtaaatgggttccttacaaagtgctgagatttcttataataccacttacttttaacctttcagtagttttctttgttgtatattttgtgttctttttcccaaattattatataagtttaagtgatgcttagaataatgtttaagaccactttaaaattgcataatttattgatgaaggattaaaatagaaacttgcttttcagtgtatatgcatttgaatcattgaaacacagtctgtgcatgcattacatattcacattaaaaaactaagcatttttgaaatagcagaaaagtttaagcaattacaaaaatgtgaaaatttccaactttaatcctgttaatatttagcaatattaggcgagaacatctgtaactattgctgaattaatattacttttataatacaaaaatttaaaataaacgtttttccaggaattttatcatcaaaataaaccccagaaaataatttcaaagtggataatctatccttatatatgtattaatacaattatatattttacatttacaaatatataggtataaaaattaaaaatgaatgtacttccaaacaagattgcacataaaaattacttcagaaaattgttaagatacacagaaaaaattgaagcatcataaaaaggaaattataatagtttacatatctagaaatagagtgcaaagttctaccaagaataagaataaattaatattaagcaatggtttgtgattttataatacacttacagaaattttattccactttatttacaactcagatatctaaaaaatagattgcttttgaaatacaaatgcaagaaacaattggagaaatctaaaatcataattagaagagagtagtgttttctttatcagccatctgatataatgttacacatcagtgggtgtagtaacggcttaggactctgagcgccgctgttgatcaactctaagcgaaaatcaggactccatccggatttccagttctgcggctacacaaaacccggcagataccacaaacctgctcccaggctgcagcaaaactcagcctctttcttctaaggaaaagatcaccatactttgcagggtggaagaaagaacctgatgaagcagcgcgcacagagatccttttgagaaaattccaaagcgaggcagcaatggcagctccaaccaaatgccagctccgcggaagattagtcctgctatgctcgctcctggggatgctatgggaggccagggccagtcagattcgctactcagtgcctgaagagacagaaaagggctatattgtgggcaacatctccaaggacctggctctggagccccgggagctggcggagcgccgagtccgcatcgtctctagaggtaggacgcagcttttctctctgaacccgcgcagcggcaccttggtcaccgcgggtaggatagaccgggaggagctctgtgctcagagcccgcggtgtctggtgaactttaaagtcctggttgaagacagagtgaaactgtacggaatagaaatagaagtaactgatattaacgacagcgccccaaagttccaggccgaaagtctggaagtaaaaattaacgaaatcgcggttcctggagcacgttatccacttccagaagctattgatccggatgttggcgtgaactccctccagagctaccagctcagccccaatcaccacttctccctgaacgtgcagactggagacaatggagccataaacccagagctggtgctggagcgcgccctggacagggaggaggcaactgcccaccacctggtcctcacggcctcggatggcggcgagccgcgtcgctccagcacagtgcgcatccatgtgacagtgttggatacaaatgataatgccccggtttttgctcaacggatttaccgagttaaagtccttgagaacgtgcccccaggcacctggctgcttactgcaacagccagcgacctggatgagggaatcaacggaaaagtggcatacaaattctggaaaattaatgaaaaacaatctctgctattccagcttaatgaaaatactggggaaatatcaacagcaaaaagtctagattatgaagaatgttcattttatgaaatggaaatacaagctgaagatggtgggggattgaaagggtggacaaaagtgctcatttcggtggaagatgtaaatgacaatagacctgaagtgaccattacatctctgtttagcccagtgagagaagacgcacctcagggaacagtaattcttcttttcaatgctcatgaccgagactccgggaagaatggtcaagttgtctgttctatccaggagaatctatcttttacattagaaaattcagaagaagattattacagattgttgacggcccaaattcttgaccgagaaaaagcctcagaatataatatcacggtgactgcaacagacagaggaactccgcccctgtccacagaaattcacatcaccctgcaagtgactgacatcaatgataatccacctgctttctctcaagcctcctactcagtctacctcccggaaaacaacgccagaggtacttccatcttctccgtgattgcctatgaccctgatagcaatgagaattctagagttatttactccttggcagaggataccatccaagggtctcctctctccacctatgtctctattaactcagacactggtgtgctgtatgctctgtgctcctttgactatgagcagtttagagatttgcaaatgcaggtgacggcaagtgacagtggaagcccaccacttagcagcaatgtgtcattgagactgtttgttttggaccagaatgacaatgccccagaaatcctgtaccctgccctccccactgatggttctactggtgtggagctggcaccccgctctgcagagcctggctacctggtgaccaaggtggtggcagtggacagagactcaggccagaatgcttggctctcctaccgcctattcaaggccagtgagccagggctcttctcggtggggctgcacacaggtgaagtgcgcacagctcgggccctgctagatagagatgcgctcaaacagagccttgtggtggctgtacaggaccatggccagccccctctctcggccactgtcacgctcacagtagccatagctgacagcatcccagacatcctggctgacctgggcagtcttcagatccctgcagacctggaggcctcagaccttaccctctacctcgttgtggctgtggcagtcgtctcctgtgtcttcctcaccttcgttatcacgctgctggccctcaggctgaggcactggcactcctcgcatctgctgcgggctaccagtgatgggttggctggtgtgcccacctcacactttgtgggtgtagatggggttcgagctttcctacagacctattctcaggagttctccctcaccgctgactcaaggaagagtcacctgatcttcccccagcccaactatgcagacacactcatcagccagcagagctgtgagaaaaatgagcctttgtgcgtctctgttgattccaagtttcctatagaagacacccctttggttccggtgagttcattttttttctttctttcttttctttttttgttttttgttttgttttgtttttgagacagagtcttactctgttacccaggctggaatgcagtggtgtgatctcggctcattgcaacctccgcctcccaaattcaagcgattctcctgcctcagcctcccaagtagagtagctgggactagagtagagtagctgggactacaggcctcccaagtagaataactgggactacaggcacgtgccaccacgcccggctaattttttgtgtgtttttagtagagacggggtgtcaccatgttggccaggctggtcttgaattcctaacctcaagtgatccacccacctcagcctcccaaagcactgggattacaggcgtgagccactgcgcctggcccttaactttctattatagttagctttctctttaactgtctgtacttaaggtagtataagttgatatcagtgtgtttctcatcacttttcactgggcctaattgttgctccaacactgaaaggaggcatttattagttatatttgctgatataactttcatgttctcataataattaacctgctgtcaacgtaaaccatacttcatggggtagctctcagcctgcattgatgtgggctttttgggtagggttgcttcattggttgcagtggactcatatcataaaattcttactcctttttttttttttttaagagatgggggtgtcattctgttgtccagggtggaatgcagtggtgtgggtaaagcttactgcagtctcaatctcctgggcttatgcaatcctcccacctcagccttcacagtagctaggactgaggtgggagggctagcaagctatgttgcccagactggtctcaaacgatcttcctgcttcagtttcccaaagcactgggtgaggtgtgaaccacctcacccagcaaattcttactcctacgatcatttattcaggtcatactatgtttgtaagggtaaactgataaaaaggtaaatgtattcttcttagagaaacagctgaaagcccagatttattgcttctattcttccatttctatgacaggaaaacacctctttgaggttatatttttcagatcacaagtgtgtaaagtctgtttgtgtttacagatattttctgacgaagattcaaacttcagttatccacttccaaaccctagtaaaccaattttttccctttaatggtgaaagttgtcacatcttttattctcatatcttcaaaggtcttaatttcctaatgctttaatgttaaattatggagaatagtaggacattcttcttttctatagtatatgcttgctcaagagaagtttctaagactggacactgtgaaatgacaaaacaaggaattaaaaatatttctctcacttatatattatttctggctcaattctccaacttttgagtctagaaatgaacttgcatatcagatataatttaagaaaatattctcaggaactgctgggaagattctaaaactattttactgtttttagctataaggaagagaataatgtattatttaatgttattttaaacatagtgttgtttcaaatagtaaataacatttcacaagacatttgaaaataagctttgaagttgactcaaaattctatgctaaacatgtgatccatagatacactgatgactgctggcatttctgtggaaatgaagaattgttttatttgtttgtaattatttgggtttcagttgctttatttttaagaaaaaaaagctgaagtgtctgggaatcctttatgacatacagacattttaattatttcaaacacgttttcccccttaagtgggtagcaaaaaaaataaagcatacttcaggctcatatttttaaccatgcaacaagaaaattgttacaatttctgttctgaggagtagccttcatacttagtatttataaatattgaaatgtatgttaatttggggaaaacataacagatatccatgaaggcttgtatgtcatggtaggtagttactattcgataccacaaaaatgtctcttgcccttaaaaccagaacacgaggctcaccagacagatgactgaatggagtatggaaaatctttatttctgtttttcttaggctatgtaggacttaacttattgtgcattggtaacagattgtagaacataagctgaaagataaaattcttgaccttaatgtctcatcttaaaaagaagcattggttgacattctatatctcgtattacttaaaaataatgggggagcgcagtatatattaaacaaagattggctttgtggtgatcattgttgaaggtggggtgatggctatgtgaaggttcactatatatactccctactgttgtataagtttgaaattgtgcataatagatttatttaaaacacaaagcatagaaatatctactataatattatggtgagagcaaaatttgagggggatgtacacctgcattttcgaagaatatatacatttcggagaccgaattcaaaatgaaaaaccgggctgctgtcccgcacggagcctctgggcgccgctgtcggccagtgcagagcaagcgctgacgccggggatccgtcagcctctggcctgggattccctgcgcagccaacaacagaaagaagaaaaccagctcccacacagagcctcccggctgcgcagacctttcccagcacagcggattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtgctatttcctttgctgctgcctttgttctaccccaccctgagtgagccgatccgctactcgattccggaggagctggccaagggctcggtggtggggaacctcgctaaggatctagggctcagtgtcctggatgtgtcggctcgcaagctgcgagtgagcgcggagaagctgcacttcagcgtagacgcggagagcggggacttacttgtgaagaaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaatttgataaaaaggaaatacatttagaaattttcgaatctgcatccgctggtacacgactatcgcttgaccctgccacggatcctgatataaacataaactcaattaaagattataagataaactctaatccttatttttcattaatggttagagttaattccgatggtggcaaatacccagagttatctctggagaaactcctagaccgggaagaacagagatctcatagcttgatattgactgccttggacggaggggacccaccaagaagtgccaccgctcacatagaaatttctgtcaaggataccaatgataaccccccggttttcagcagagacgaatatagaattagtcttagtgaaaatctgccccctgggtcccctgtgttgcaagtgacagccactgaccaggatgagggggtcaatgctgagataaactactacttccgaagcactgcccagagcacaaaacatatgttctcattggatgagaaaacaggtatgattaagaataaccagtcatttgattttgaagatgtagaaaggtacaccatggaagtggaagcgaaggacggaggtggtctctctacccagtgtaaagtaatcatagaaatccttgatgaaaacgacaacagcccagaaataatcatcacttctctctctgatcagattttggagaattcacctccaggaatggttgttgccctcttcaaaacacgggatctggatttcggaggaaatggagaagtcaggtgtaatatagaaacagacattccattcaagatttattcttcttccaataactactacaaactggtgacagatggagccctggaccgagagcagacaccagaatacaatgtcaccatcgtagccactgacaggggcaagccgcctctttcttccagtagaagcatcaccttgtatgtcgctgacatcaacgacaacgccccagttttcgaccagacgtcctacgtggtccacgtggccgagaacaacccgccaggagcctccattgcgcaagtgagcgcctctgacccggatttggggctcaatggccacatctcctactctatagtggcgagtgacctagagcccctggcggtgtcgtcatacgtgtcagtgagcgcgcagagcggggtggtgttcgcgcagcgcgcctttgatcacgagcagctgcgcgccttcgcgctcacgctgcaggcccgcgaccacggctcgcccacgctcagcgccaacgtgagcctgcgcgtgttggtgggagaccgcaatgacaacgcaccgcgggtgctgtacccagctctgggtcctgacggctccgcgttcttcgatatggtacctcgctctgcagagcccggctacctagtgactaaggtggtagcggtggacgccgactcgggacacaacgcctggctgtcctaccacgtgctgcaggccagtgagcccggactcttcagcctggggctgcgcactggggaggtgcgcacggctcgagccttaggcgacagggacgcagcccgccagcgcctgctggtcgctgtgcgtgacggtggacagccgccactctctgccaccgccacgcttcatctggtcttcgcagacaacttgcaagagatactgccagacctcagcgaccgccctgtactctctgacccccaggctgaactgcagttttacctggtggtggccttggccttaatctcagtgctcttcctcctcgccgtgattctggccattgccttgcgcctgcgacgctctctcagccctgctacttgggactgcttccatcctggtctctgtgtcaagtctggacctgtagttccccccaactacagtgaggggactttgccttattcttataatctgtgcattgcacatacgggtacaaaagagtttaatttcctaaaatgcagtgtgcccctacattccaatgaagacatggtttgcagtgtttctcctggagccttaattccacctcatggtggggaggatttgacttcacatcctgagactctgacttcggtgagtttctcttttttgtgtgtgatttatctaatagtctactagtttctcatattttaggcatactactttattttcatatctagaatcatatgtttaaaatccatagctttttacaatattttctcaatgttttttcaattatagttttcactatgtatttggttcataagttgctctatctttttgtaaaataatgtcaccagactgaagatattttgtctttgtcttttttttttttttttttttttgagatggagtctcgcactgttgcctaggctggagtgcagtggcgtgatctctgctcactgcaacctccgccttctgggttcaagcgattctcctgcctcagcctcccaagtagctgggattactggtgcccctcaccacagctaaattttttgtatttttagtagacatggggtttcactatgtcgaccaggctgttcagaaactcctgtcctcgtgatcctcccaccttggcctctcaaagtgctgggattacaggcgtgagccacaatattttgtcaagttctgactatcgaacagaagcagtggtcttggcatctaagaaaacaaacaagtaacctatctattcaaatttgcgaagacttagtgaatttacgatatcttatttatatatttttaaagcctaaaaatattcagaagacaggcccagtggctcacacctataatcacagcactttgataggctgaatcggaaagtatcacttgagcccaagaattgagaccagcctgggcaatatagggagaccccccatctctactaaaacaacaacaacaaaaaaaaacattagcagagtgtggtagcattcccctgtggtcccagctacttgggaggctgagctgggtggattgcttggtcctgggaggtcaaggttgcagtgagccctgatcttgccactgcactccagcctgggcgacagagtgcgaccctgtctctaaaataaataaataaatatgcaggcagggccaagtgtgctgtaatcccagcactttgggaggtggaggtggagaatctcttgagcgcaggaatttgagaccagcctgggcaacacagggagactccatcgctacagaacatttaaaaattagcagggtgtggtggcacatgcctgtggtctcagctactctggtggctgtggtgggagaatcgcttgagcccaggaagtctaggctgcagtgagctgtctaggtgacagagtgagaccctgtctcaaaaaaaaaagacatttctaagaaataaatgaaatactattgcctttgcactcagtctctgtctctgattctctgatagaagatttttgaagaaaaaagataaaatctttgaagagttctatacttggaaggcatagtgacataaacacttctgaacatcctgttctctgtgtgaaagaagtgaacttctataccctttgcatttgagggaacaattgctactgggttgatgggcacacacagttgaagatatgtgaaccactggactttggcctctgatacaaactgcctaagagaagagattatttatactggtattaatgctctgatgaaaacaggtcatttgacataaacacttacttgttaaaaacctatatcactacatctaactttgttttctaaaacttttagtacttcaaattctacgtatttcttttctcattacaatgcaaacagtttaatttgcaactgtaatatatgttcattttagtttgtgattacctgcttaatcatttaaataggtccatttaacttgtatccctgtaagataaagtatgttttacacaaaaaggttaattaaggctcagtaaaactattctagaagagtactttaaaaacctcttacacaatcctaagctaaataagtttaatgaattaagtagttacaattataaagcttcagagtgaattatctcatgagtttatttaatataatctttgtatgaatgtatactaaataaaattggcctattcaaatcacaattttaaattataagacttttctgaatttacctagacactaatatgacctaaaataagtattatttaccttttattaaagtgtgtacatttctgttgggaaaacgtgttgcaaatatatatttaaccaaacattatcttgaaatatttacaatattttcactccactttatcacacctcccctaagaaacctacatatagtaaattatttaaagataggagtggagaaaccaaagaatctatgtaaaatataataatccaacagaatagtttactttccattgcatgtatcacttgggtgcagtaacttcttaggactctgagcgccgctgttcacctactaggagagaaaacgcagccagagctcaatccggattctcagggcttcaactacacaagccccacaaaccggctgctgggctgcagggaagctcactccagaatttaaagtgcccaggctacagagacaccctgaagccacagaaagacaaaggaaccggttgaaacacacaacgtgtccagtgaggactttgcagaattctgtaaccagactacaatggccgctcaaaggaatcgctcaaaggaatcaaaggattgcagcgggctggtcctgctctgccttttcttcgggattccatgggaggctggagcccggcagatctcctactcaattcctgaggaattagagaaaggctctttcgtgggcaacatctccaaggacttgggtctggcgccccgggagctggcggagcgcggagtccgcatagtctccagaggtaggacgcagcttttctctctgaacccgcgcagcggcagcttgatcaccgcgggcaggatagaccgggaggagctctgcgctcagagcgcgcggtgcgtggtgagttttaatatccttgtggaagacagggtgaaactttttgggatagaaatagaagtaactgatatcaatgacaatgctccaaaattccaagcagaaaatctagacgtaaaaattaatgaaaatgtcgctgcgggaatgcgttttcctctcccggaagctattgatccggatgtgggcgtgaactccctgcagagctatcagctcagccccaataagcacttctccctaagagttcagagccgtgccaatggcgtcaagtacccggagctggtactggagcactccctagatcgcgaggaagaggccattcaccacctggtcctcaccgcctccgacgggggtgaccctctccgatctggcactgtccttgtcagtgtgactgtcttcgatgcaaatgacaacgcgccggtcttcaccttgccagaataccgagtgagtgttcctgagaatttgcctgtgggcactcagctgctgacagtcacagccaccgacagggacgaaggtgccaatggagaagtgacatattcattccgaaaattacctgacacgcaattgttgaagttccaactaaacaaatatactggagaaataaaaatatcagaaaatctagattatgaagaaaccggtttctatgaaatagaaatacaagcagaagatggaggagcatatcttgcaactgcaaaagtgttgattacagtagaagatgtaaatgacaacagtccagagctgaccatcacgtctctatttagtccagtgactgaagattcacctctgggaacagtcgtagcccttttaaatgtgcatgatttagactctgagcagaatggacaggtaacctgttccattttggcgtatctaccatttaaattagaaaagtccattgacagttattacagattggtgatacacagagcccttgacagggaacaggtatcctcttacaatatcacagtgacagccacagatgggggaagtcctcctctatcaacggaagctcactttatgctacaagtggcagatatcaatgacaacccacctaccttctctcaagtctcctactttacctatatcccagagaacaacgccaggggtgcctccatcttctcagtgacagcgctggacccggacagcaaagagaatgcccagattatttactccctggctgaagacaccatccagggggtacctctgtcctcatacatatccatcaactcagacactggcgtcctgtatgcactcagatccttcgactatgagcagtttcatgagctacagatgcaggtgacagccagcgacagcggggatcctccactcagcagcaacgtgtcgttgagcctgtttgtgctggaccagaacgacaatgcgcccgagatcctgtaccccgccctccccacagacggttccacaggcgtggagctggcgccccgctccgcagagcccggctacctggtgaccaaggtggtggcggtggacagagactccggccagaacgcctggctgtcctaccgtctgctcaaggccagcgagccgggactcttcgcggtgggggagcacacgggcgaggtgcgcacggcgcgagccctgctggacagagacgcgctcaagcaaagcctcgtagtggccgtccaggaccacggccagccccctctctccgccactgtcacgctcaccgtggccgtggccgacagcatcccccaagtcctggcggacctcggcagcttcgagtctccagctaactctgaaacctcagacctcactctgtacctggtggtagcggtggccgcggtctcctgcgtcttcctggccttcgtcatcgtgctgctggcgcacaggctgcggcgctggcacaagtcacgcctgctgcaggcttcaggaggcggcttgacaggtgtgtccggctcgcactttgtgggcgtggacggggttcgggctttcctgcagacctattcccacgaggtctctctcaccgcggactcgcgaaagagtcacctgatcttcccccagcccaattatgcggacacgctcatcagccaggagagctgtgagaaaaacgatcctttgtctttgttagatgattcgaagtttcctatagaggataccccattggttccagtgagttttattttcatttttacttttgttaaaaaaaaaaagattggtttttactttgaagtttgcggcatgatggtggaaagtgtaaatgctaaaacactgatgagtagaatttgatgtttattaaggttttttttttttttttttttttttttttttttactttctggtaaaattcacctagtctcaatcaaggcctatatatcataaggctttgttatgattagctttgcagaaccttgtagtttatagtgttgttgagtacaatattgacaattcctaagacagacttccatacagaagtgcctgtcaatttatatttcctcctgggtggtcacatattgaaactccagccccttaagcaaccctcttgttctgaaggcaggtctggtaagaataggtaagtatcagaaagaaatcacctctggaaacacaacccaaatccaagaatactcaatgcagttcttcccaaggagaagggcaataggcctttttcaaactacattttatatatttttcaatctatactttgtggtgatagttgcagttgaatatactaagtttttcattaatattgaattaacaatttatttataacaatgtatgcttagatttttccagccctatttataactgataacactgcagtatcctttttgcatacaattctctaatttcacactgctatgtggaagatatagcattttaatttaactttcattgctcaatagggatcctgaggaggctatagagggtgaaattaagaatatttgggattctgcttttgtcttttttgttaaattttctagtgactaaggctgaaagtaaatatgggttgggaagacagataaatttgtacatgttcccgagaacaggagcaagagatatatgacaaagctatttcagtggctctttaatgtataaggaggcaaacacctgaaactctgaaaactctgaaattgagaggcaaaataaacttagagtcaagaaagaaatgccatttctgcagatcagaatataaacaccaaccacagctgtaaaaaagaaaagaatatatgcaacgaagggaaattatataaacaaaggatcattggaggtactgatgagttcatttagttcaatgaaaatagtgacgtattaggtagatctcttaattttattactagtattctactaaatgtggtagtataaagtcaaaaagcattccgaagtttctcaagacccttataattccatgatttttttcaggtcagtcaacatttgttgaatgataggtctgtggaaggaaagcacactctttagggtcatagttattaactattaaaccattgaaactattattttatatttgtgttaatgagagtcaaaattattgtgcattcatctcaaataattctattattttgaaaaatacaggttttttttttaaaaaaaactgctcttgacattgtagctattgtgagaaaatattttgattataattatttaaaagcaatacaggacaccctggatgatggtaatgactagggcaatggttgcattccagtacttaagtatgaaataaggaattattactttctgggtgaatataggctagaattgaagacaaaaaaatttgttgcttatcttcagtacttccagcttcatagataattactcttaaaaggaacaagaatgactgcctctggatggaggaattggatagcaatgggccgtgggataggagacctataaaccttcatgctatattattttgtgcctttttaaattttgaagaaaaaatattcatttattcaagatatatgtaaattcagtaaataaaaagatatgatagttatgaccaagtggaaatatatttcctgatgtaaaaggaatcactgaggaaaaagattaaaatattttggctgtcaactcgtagtttaaaaaaaattccttgaaagaggtagagaaaagtcaagttgcagtcccacacagagcctctgggcgccgccgtcggccagtgcagagcaagcgctgacgccggggatccctcagcctctagcctgggattccctgcgcagccaacaacagaaaagaaaaccagctcccacacagaggctcccggctgcgcagaccttgcccagcacaccagattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtactatttcctttgctgctgcctttgttctaccccacgctgtgtgagccgatccgctactcgattccggaggagctggccaagggctcggtggtggggaacctcgctaaggatctagggcttagtgtcctggatgtgtcggctcgcgagctgcgagtgagcgcggagaagctgcacttcagcgtagacgcgcagagcggggacttacttgtgaaggaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaattccggaaagatgaaataaacttagaaatcagtgaatccgtcagcctggggatgggaacaattcttgagtctgcagaagatcctgatattagtatgaattcgctgagcaaataccaactaagtcctaacgagtatttctcattggtggagaaagacaatcctgatggtggcaaatatccagaattagtattgcagaagactctggaccgagaaacgcagagcgctcaccacttggtactgaccgccttagatggtggggaccctccccgaagcggtactgctcagataagaatcctggtaatagatgccaatgacaaccccccagtgttcagccaggacgtgtacagggttagccttcgggaagacgtgcctccaggcacctccatcctgagagtgaaggccactgaccaggacgagggcatcaactcagagatcacttattccttctttggtgtggctgacaaagctcagcacgtgttctctctggattacactacaggaaacattctaactcagcagcctttggattttgaagaagtagaaagatatacgataaacatagaagcaaaagaccgaggatctctctcaacacggtgtaaagtaattgtagaagttgtagacgaaaacgacaacagcccagaaataatcatcacgtcactctctgatcagattatggaggattcccctccaggagtggttgttgccctcttcaaaacacgggaccaagactcaggggaaaatggggaagtcaggtgtagcttaagtagaggtgttccatttaagattcattcttcttctaataattactacaagctagtaacagatgaggccctggatcgggagcagaccccagagtacaacgtcaccatcgcagccacagacaggggcaagcctccgttatcctccagcaaaaccataaccctgcacattactgacgtcaatgacaacgcgccggttttcggacagtcagcctacctggtccacgtgccagaaaacaaccagccgggtgcctccatagcgcaagtcagtgcctctgacccagacttcgggctcaacggccgtgtctcctactctctcattgccagcgacctggagtcacgaacgctgtcgtcctacgtgtccgtgagcgcgcagagcggggtggtgttcgcgcagcgcgccttcgaccacgagcagctgcgcaccttcgagctcacgctgcaggcccgcgaccagggctcgcccgcgctcagcgccaatgtgagcctgcgcgtgttggtgggcgaccgtaacgacaacgcaccgcgggtgctgtaccctgcgctgggtcccgacggctccgcgctcttcgacacagtgccgcgggccgcgcagccaggctacctggtgaccaaggtggtggccgtggacgcggactcggggcacaatgcctggctgtcctaccacgtggtgcaggccagtgagcccgggctcttcagcctggggctgcgaacaggcgaggtgcgcatggtgcgtgctttgggtgacaaggactcggtccgccagcgcctgctagtcgctgtaagagatggaggacagccacccctttcagccactgccacgctgcacctggtgttcgcagatagcttgcaagaggtactgccggatttcagcgaccatcccacaccctctgactcccaggctgagatgcagttttacctggtggtggccttggccttgatttctgtgctctttctcctcgcggtgattctagctattgctctacgcctgcgacagtctttcagccctactgcaggagactgctttgagtcagttctctgctccaagtccggacctgtgggtccccccaactacagtgagggaacgttgccctatgcctataatttttgtgtgcctggggatcaaatgaatccagaatttaattttttcacatctgttgatcattgtccagccacacaagataacctcaacaaagatagcatgctactggctagcattttaactcccagcgttgaagcagataagaagattcttaaacaggtaagtatttaaaaatgtatttaatcctttttatattacaatatgccaatatattccaatatagtggtattattttaagattctagataacttcttcatagagttcgcaaaatataggtcaaatttatggttatcattattaaaacaaaagtttaaattaaatgcctcagtcttcctactattcaaagacattttaaagcaaactacatgggtaatctccggtgacatttttatgaagtaaaatacctttcggttaaaaatataaaatacaggtatatttttacggcatggtattttaattgaaaccctgatgctactcaatttttctcaagtatttcatcttcatttactcaataaaggaaccttgtaagaattatagttaggcatcctacctgatgattttatcgggaccgtattatttccacttccagaaatgtcgttcctttcagtcggttaaaatcaattggaaccaactacaacctacaagttttcagctccagtaatattttgaaaactttttaaaaattaagcaagcccttttaataattactcctttcgcaggtgttcttggtaaagttttaacgtcacataatgtaagtattgtgtatcatcgtttttaagctctacaaatacgtgtgattcacaaaggtgagcgtaatcatttcttctggaatttcttagtcgttgcaataataagaatgggctctaggcgccgctgctcaccaatcagggaatgggaagctgcgcgccattgagtccctccctcccccgcctctaccacacaaagcggaatgagatggatactcacagatcctgacactggagacttagaagtattttccttcgctttctgatatattttggatgtagtcggcctaggacttcatagatacataagccgattcacaaccaaccagctcgagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccccgggagctggcgaagcgcggagtccgcatcgtctccagagggaagacacagcttttcgctgtgaatccgcgaagcggcagcttgatcacggcaggcaggatagaccgggaggagctctgtgagacggtgtcctcctgttttttaaatatggaacttctcgtggaagacaccttgaagatttacggagtggaggtggaaataatagatattaatgataacgcccccagcttccaggaggacgaagtggagataaaagtcagtgagcacgcaattcctggggcgcgatttgctcttcctaatgctagggatccagatgtgggcgtgaactccctccagagctaccagctcagccctaataattacttttccttgcaactgcggggcagaacggatggggccaagaatccagagctagtactggagggaagcctggaccgagagaaagaggctgctcacctgctcctcctcacagctttagatggaggcgatcccatccgaaagggcgcagttcccattcgtgtggtggtcctcgatgtaaatgatcacatcccaatgtttacacagtccgtatatcgcgtgagtgttccagaaaacatcagctccggaactcgggtgctgatggttaatgcaacggatccagacgagggaatcaacggggaagtaatgtattcatttcggaacatggaaagcaaggcttctgaaatattccaattggattcacaaactggagaagttcaagtacgggggtctctggattttgaaaaatatagattctatgagatggaaattcaaggccaagatggtggaggtctctttaccaccacgacgatgttgatcactgttgtggatgtgaatgataacgctccagaaataactatcacctcttctattaattcaattctggaaaactctcctccaggtacagtgattgctcttctaaatgtgcaagatcaagattctggagaaaatggtcaagtctcctgttttattcctaaccacctgccttttaaattagaaaagacttatggaaattattacaaattgataacaagcagagtgctggacagggagttggtccagagctacaatataacgttgacagccacagaccagggaagcccgcctttgtctgcagaaactcatgtctggctgaatgtggcagatgacaacgataaccctcccgtttttcctcactcctcttactctgcctacattcccgaaaacaaccccaggggtgcctccatcttctcagtgaccgccctcgacccggacagcaaacagaatgccctggtcacttactctctgacggatgacactgtccagggggtgcctctgtcctcctatgtctctattaactccaacactggtgttctctatgccctacaatccttcgactatgagcagtttcgagacttagaactgagagtgatagcacgtgacagcggggacccgcccctcagcagcaacgtgtcgctgagcctgttcgtgctggaccagaacgacaatgcgcccgagatcctgtaccctgccctccccacagacggctccactggcgtggagctggcgccccgctctgcggaacctggctacctggtgaccaaggtggttgcggtggacaaagattcaggccagaacgcctggctgtcctatcgcctgcttaaggccagcgagccgggactcttcgcggtgggggagcacacgggcgaggtgcgtacagcgcgggcactgctggacagagacgcgctcaagcagagcctcgtggtggccgtccaggaccacggccagccccctctctcggccaccgtcacgctcaccgtggctgtggccgacagcatccccgaagtcctggcggacctcggcagcctcgagtctctggctaactctgaaacctcagacctctcgctgtacttggtggtggcggtggccgcagtctcctgcatcttcctggtctttgtcatcgtgctgctggcactcaggctgtggcgctggcataagtcacgcctgctgcaggcttctgaaggcgggttggcaggtatgcccacgtcacattttgtaggcgtggacggggtacaggctttcctgcaaacctattcccacgaggtctctctcattgcggactcgcagaagagtcacctgattttcccccagcccaactatggggacacgctcatcagccaggagagctgtgagaaaagcgagccactcttgatagctgaagactcagctatcattttaggcaaatgtgacccgacaagtaatcaggtgagatttatttctctgcctcctaattgttggtgtcttggcacaagtcttttaaggagatgttttttgagcctgttatgaaaactgtttggggggggggtggggcggcatatatttagttcatatatatttagagcaatacatgtgagttttactttgcctttcatgagattacgataatctttcagaacgtttttgtgaaagtcatttttcaatcttggcatattttcttttgatttcaaaggggccattcaactatgctggtttggtttgaagtaagttgaattttagtattatttttctattatcagtgtatgaggctctcaatttattatatatagatacaaattaatgattcacaaacactttttatttccatttcaattttgctgtgccttcactgatttgtagttatattccaccattatttgctattactgctaatgttcaaattttgatcctgttgatttaatagcatgctccctctagctctccttctcatctatctatctatacacatgcacacacacttatacacgtaagcttttctctgagcaattttattttgattcttggtggctggtaatatgcttagatcctgttgactatttcaactttgtctcatttcttcatcctatcaacacagacatattgactggcttttaactactggatttccttgggagataaaatttagatcacattttttcttaagctctagatgtcttttccattactatggtgaagttacattgactgttctgaggaaataattgaattattgaactggtattatttccttttattcttttactttggtgtctgtgtttgtatgtatggaaggttttttaatgtagtaaatccatatatagaaataacttgattttgattcagtgcttctcaaaaacctattttcaaatgtgctaaagatgtctacagatttattcaaatagagtagtttgtgaatatataaatagattgaaggtatttggactttaattaaactgatttagctagtatccttctggctatttttttgttcattttcagtgtagttgggagtcatagattccttctttctttctttataaggtcattcttatggcaaatagtacattcagttcttttattcagaccaacttgttattgaagcttgatagttgcctgacatacatgttatctgaagcaatgtctaggaaagccaaatgaggaaaggagacttatctagggtttttgatcacaggaatcatttccataatcaattcagtcaacactctcacatcacttctaggtatttgccccaaattacttggatatttatgttccctttcaagtttagttttctcatttaggaatttaccttatgtcattagttgtaaactgactatctagggctcggacaaaaataatttcaactgtaggaaaggcaagtcttccaacagatgcctacatttttcttgaagtcaagaaaaatgttcaggtattttgagcatctagggataggatttatacttgtggaattccaaactgagaaaaatgatgtaaggcattgtactttgactggaattagttaaataaaaaggatatgaggtatttggctgggaaaaggagattgttccatattataaaacctcatctaaactaacttcccaagatcgtggagaacaaaaaggaagggttggctttgaaatgtgatattaagagggttatgttgattcggaggtagtgataaagttctgttaaggtataacatatagtcccattaaatagaggataaaaataaaacaccatcacatttcatgttattaattcctatggcaacctactaggctatacctttatattctctttatgatgaaacatgaaacaataatccttttcagaaacctcttttataagtgataagaagggtttggctaactttattctgaatatgccctatatagctttcagtgctcctccagttttctctgataaaactaggaggaaaattatctgcacatcagattgaaaataatactgcatatcatttcatagtggtcaaaattttcccataccacttgatggggatgttttcccacaaggtttttgttctacaacaggagagaagactttgcctagttcttccaatatgtgcattgcttctgcttagaaaaaaacaaacttttaaattctctttgctgggttaatgactgttctatagattcccatctctaaggaatcttctttggtagtaaacactggaaaacagtcactacgaaaactcataaaatgtctagtttcctatacattagtccaacacatcagtctaattctgaatcccattgaattagcaaaggcttccggctgcagttttctaaatagactcagagccctgctgttggccaatgtgctgcaagaactggagcctgggatctaccaggacgatattctgttcagtcacagaagcaagtcggagagtggccaagacttgggctttctgctcctgcaaatctgattccatacggattggggtgccctcaaactgggagcattgagttttctatgtatggaagtaaatattttaaaagcactttgtgaaacattttctcttaacgtcggagactgcagcaacgcatgggaaggatgggaaacagggtgaagcagagaagcaggacccggcagtggcaagcactcttccctttcctgctgcctttgttctgcggggcaccctcggagcagatccgctactctattccagaagaaacggtccagggctccgtggtggggaaccttgcggaggacatgcggctgcatgttcaggatttattgacctgaaaccttagagttagtgcagagaaacaatactttaccgtgaacacggagaatgggaacatacttgtgagtgacagaatagatcgagagtcactgtcttcaaaatcctctgtgtcatacccttagagattgtagcagagaatcctctaaatgtttttcacataaatgtgatgatagaagatataaatgataacccacctcattttccccaaaatagcattgttttacaaatcaatgaactagcaattccaggcattcggtttggcctggaatctgctatagatgcagatgtagggcctcactctctccagagttaccagctcagttctaatgaacatttctctctgatgatggacaagactaaaggcaagaacgctccagaattagtgctggagaagcccctgggccaggagcaacagagctctcatctcctggtcctggaagcaatggacatgggtgacccagtcccaactggcactgctgcaattcaaattgaggtcactgatgccaacgataatgccccagtttttagccaggatgtatacaaagtcagccttagagagaatgtgcccccaggcacctctgtactaaaggtgacagccactgaccaggatgagggtgtcaatgcggagatcacctactctttcaaatccctacgagatgatattggaaatatgtttgtgctagaccatcaaaatggggaaattaaatccaaagacttaatagacttcgaatttcgtagcagttataccatgagagtagaagctaaggatggtggaggcatgaccagcgaatgtaaaattatactagaaatcctagatgagaatgacaatgccccagacgtggtttttacttcagtgtccagttctgtaactgaggacgcagaaccctggacggtgatcactctgttcaaaacacatgataaagattcgagagaaaatggggaggttacatgcctcataaacgaaagagttccttttagaatcgaatcttccgccaataatgactataagcttgtaacagatgggaccctggattgggagcggatcccggagtacaacgtcaccatcactgccactgacaagggcaagcctccgctctcatccagcacaagcctcaccctacgcattggtgaagtcaacgacaatgctccggttttccaccaagtctcctacgtggtccacgtggccgaaaacaaccttcccggagcctccatcccacaagtcagcgcctctgacctggacctagggctgaatggccaagtctcctactccatcgttaccactgacttggagctgcgggcactgtcgtcctacgtgtccgtgagcgcacagagcggggtggtggtcgcgcagcgtgccttcgaccacgagcagctgtgcgccttcgagctcacgatgcaggcccacgaccagggctcgcccgcgctcagcgccaacatgagccggcgcatgttggtgggcgacctcaatgacaatgtgccgcgggtgctgtaccccgcgctggggcccgatggctccgcactcttcgatatagtgccacgcgccgcagagtccggctacctggtgaccaaggtggtggcggtggacgcagattcgggacacaacgcttggctgtcctaccacgtgctgcaggccatcgagcccgggcttttcagcctggggctgcacacgggaacctgctggttgctgtgcgtgacggaggacagccgccgctctctgcgccgctacgcttcacctagtcttcgcagacagcctgcaggaggcactgccagacttcagtgacagtcctgtgccctctgattcccaagcaaagctgcagatttacctggtcgtggccttggccttgatttctatgctcttcttcctcgcagtgattttggcggtcgccttgcacctgcgatgctcttccagcccctctgcctggggttgctttcaccctggtctctgttctaagactagaccaggggtttttcccaactacaatgagggaactttgctttattcctgcaatctgtatgttccctcggattctagaaaaagaagatttaattttctcaccatgacaccagaaacagtccccccacaagatctttctaatgaagtttctctggtagcaagcttcactgaagagaataacaagataagctctaactctgttgctcctactcacgtgagttccaatgaatgtctttcatttacaaatggatgaggtttaattttcaaaccaatattttggcaagaaaatcttaaacatattatatctactattgcttcaggtttgtttgcccactcttaatatttcctgttcctttctgtgtgggccagtaacttcattattagctttcatgtatttttgaaacattttcaccatttttacgggagactttttttttttttggacggagtctcgctctgtggtccaggctggagtgcagtggcatgatctcggctcactgcaagctctgccttccgggttctggccattctcccgcctcagcctcccgggtagctgggactacaggcgcccgccaccacgcccggctaattttttgcatttttagtacagacggggtttcaccgtgttagccaggatggtctcgatttcctgacctcgtgatctgcccgcctcggcctcccaaagtgctgggattataggcgtgagccactgcacccggcccggagacattgtttatacacacacacacacacacacacacacacacacacacgtgtgaaaagtgggtattatgatactgctgtcattgagatattttaattgaggaataaatttttttcctgtgatgtttcttgggacatcaatatttgagtatataaggctttttctttaatccattaactataaattttgaagaaaatgcatgagaaaatggagaaaatgtgttttttttttaaaaaaaattgagattaaggtctcattatgttgcccaggctggactcaaactcttgggctacagtaatcctcccacctcaatctccagagtagctgagactacagttgcctgaaactgtgcctggcagagaaaaaagcttaaaaaaataagaacatggtaatgatttgataatattcagttacatttacttttgattcttgtaattcaagtaaactcaattttatgtctgatattttctcacagctacctatatatttcttcccaatttaaaatatattattttattttatgcctagcaaatatctttacagtataaatatttacgctcatgaaagtacgtagccagttatttcttagggagaattttttccctatattttgatgggcttccaaaagtattaccagtaattctcagtaattacaattaggtcagttacccaggaaaaggtaagtctgtaacattctttggactaccaattttcttttactaagtttcctgaacaataaatatttttgaaatataatgtattaatagaattctggagtacttccattatttccagtcaatgcaagttggaatgcttctactttatgctaaaaatattaatgtttctttttcacttgggttcttgttaagtgtgattctgataatgtatacaatcacatatcatttttaggtttccataatatcatgaaaatttgatttttaagcgttacatgtcaacaacctggtaaagtaatccttccattcaggatcattcaaggaatctatttaaaaatattttccccaaattatagctgaatcagaaagtttaaattattatattatatgatttgtcaaaaagagaaactcctagggagacatctccataataggtgtgttgggggaacagtaatctcaaagcagatgcactaacattataagattaaaatcattgtttatagaaacttccaattcatttaaaagctcattggggaaaaaaaagctcattgggaaaaaaaaaaaaagctcactaaagtttctattaaagcgaatacggtagatttccatccccttttgaagaacagtaggtggagctatttaagatataaaaacgaaatatcctttctgggagttcaagattgtgcagtaattggttaggactctgagcgccgctgttcaccaatcggggagagaaaagcggagatcctgctcgccttgcacgcgcctgaagcacaaagcagatagctaggaatgaaccatccctgggagtatgtggaaacaacggaggagctctgacttcccaactgtcccattctatgggcgaaggaactgctcctgacttcagtggttaagggcagaattgaaaataattctggaggaagataagaatgattcctgcgcgactgcaccgggactacaaagggcttgtcctgctgggaatcctcctggggactctgtgggagaccggatgcacccagatacgctattcagttccggaagagctggagaaaggctctagggtgggcgacatctccagggacctggggctggagccccgggagctcgcggagcgcggagtccgcatcatccccagaggtaggacgcagcttttcgccctgaatccgcgcagcggcagcttggtcacggcgggcaggatagaccgggaggagctctgtatgggggccatcaagtgtcaattaaatctagacattctgatggaggataaagtgaaaatatatggagtagaagtagaagtaagggacattaacgacaatgcgccttactttcgtgaaagtgaattagaaataaaaattagtgaaaatgcagccactgagatgcggttccctctaccccacgcctgggatccggatatcgggaagaactctctgcagagctacgagctcagcccgaacactcacttctccctcatcgtgcaaaatggagccgacggtagtaagtaccccgaattggtgctgaaacgcgccctggaccgcgaagaaaaggctgctcaccacctggtccttacggcctccgacgggggcgacccggtgcgcacaggcaccgcgcgcatccgcgtgatggttctggatgcgaacgacaacgcaccagcgtttgctcagcccgagtaccgcgcgagcgttccggagaatctggccttgggcacgcagctgcttgtagtcaacgctaccgaccctgacgaaggagtcaatgcggaagtgaggtattccttccggtatgtggacgacaaggcggcccaagttttcaaactagattgtaattcagggacaatatcaacaataggggagttggaccacgaggagtcaggattctaccagatggaagtgcaagcaatggataatgcaggatattctgcgcgagccaaagtcctgatcactgttctggacgtgaacgacaatgccccagaagtggtcctcacctctctcgccagctcggttcccgaaaactctcccagagggacattaattgcccttttaaatgtaaatgaccaagattctgaggaaaacggacaggtgatctgtttcatccaaggaaatctgccctttaaattagaaaaatcttacggaaattactatagtttagtcacagacatagtcttggatagggaacaggttcctagctacaacatcacagtgaccgccactgaccggggaaccccgcccctatccacggaaactcatatctcgctgaacgtggcagacaccaacgacaacccgccggtcttccctcaggcctcctattccgcttatatcccagagaacaatcccagaggagtttccctcgtctctgtgaccgcccacgaccccgactgtgaagagaacgcccagatcacttattccctggctgagaacaccatccaaggggcaagcctatcgtcctacgtgtccatcaactccgacactggggtactgtatgcgctgagctccttcgactacgagcagttccgagacttgcaagtgaaagtgatggcgcgggacaacgggcacccgcccctcagcagcaacgtgtcgttgagcctgttcgtgctggaccagaacgacaatgcgcccgagatcctgtaccccgccctccccacggacggttccactggcgtggagctggctccccgctccgcagagcccggctacctggtgaccaaggtggtggcggtggacagagactccggccagaacgcctggctgtcctaccgtctgctcaaggccagcgagccgggactcttctcggtgggtctgcacacgggcgaggtgcgcacggcgcgagccctgctggacagagacgcgctcaagcagagcctcgtagtggccgtccaggaccacggccagccccctctctccgccactgtcacgctcaccgtggccgtggccgacagcatcccccaagtcctggcggacctcggcagcctcgagtctccagctaactctgaaacctcagacctcactctgtacctggtggtagcggtggccgcggtctcctgcgtcttcctggccttcgtcatcttgctgctggcgctcaggctgcggcgctggcacaagtcacgcctgctgcaggcttcaggaggcggcttgacaggagcgccggcgtcgcactttgtgggcgtggacggggtgcaggctttcctgcagacctattcccacgaggtttccctcaccacggactcgcggaagagtcacctgatcttcccccagcccaactatgcagacatgctcgtcagccaggagagctttgaaaaaagcgagccccttttgctgtcaggtgattcggtattttctaaagacagtcatgggttaattgaggtgagtttatatcaaatcttctttcttttttttttttaattgctctgtctcccaagctggaatgcagcggtacgatcatagctcactgcagcctcaaactcctaggctcaagcaattatcccacctttgcctccggtgtaacagggactacaggtgcaagccacctactgtctgcctatctatctatctatctatctatctatctatctatctatctatctattactttcttgtacagacaggagtctcactatgttgagcaggctgatctgaaacttgggctcaggctagcctcctgcttctccctcccaaactgctgggattacaggcgtgaaccacagtgccccgcccttatcagatattcttttctggctgggcgcggtggctcacgcctgtaatcccagtactttgggaggccgaggcgggtggatcacctgaggttgggagtttgagaccagcctgaccaacatggagaaaccccgtctatactaaaaaaatacaaaattagccgggcgtggtggtgcatgtctgtaatcccagctacttgggaggctgagtcaggagaattgctttaacctgggaggtggaggttgcaatgagctgagattgtgccattgcactccagcctgggcaacaagagtgaaactctatctcaaaaaaaaaaaaaaaaaactttatcctctagtttcatccattgatgacacttgctttaatcacttattacaatcacctccaaatgaagattttataattccattgtttcttctacagttgttaattggctttctaccttgaagaagagttttatattctctatatatgtttgtttctatgattctggaagcatggttttctattttattcaatggcctgtaatctgttaatatcaattatttattttgatgctgaaattgtcccaggattggcctttgggactccctttaggctgatttctatgtcctttctgttacagcaagcttgggattatatccaagatttgtaattccaatgtacttacttctgtcagtgtaaacaaagtacgatttctggactagatgacttgggcattgtgggggaggtggaaattagaggtattctctgtttttcctgtaggatcttgcatttcttcctcttgctgcttgtctctttgtgtcgggaacaggccccccaaaatctggccataaactggccccaaaactggccataaacaaaatctctgcagcactgtgacatgttcatgatggccgtaatgcccatgctggaaggtagtgggtttaccggaatgagggcaaggaacacctggcccgcccagggcagaaaactgcttaaaggtgttcttaaaccacaaacaatagcatgagtgatctgtgccttaaggacatgcccctgctgcagataactacctcaatccatccctttatttccgcccatctcttcgtttcccataagggatacttttagttaatctaatatctatagaaatgatgctaatgactggcttgctgttaataaatatgtgggtaaatctctgttcagggctctcagctctgaaggctatgagacccctgattccccacttcacacttctaaaaaaaaaaaaatttttttttctgagcttggagaaatatatcccttagtacacttggcatttataaagcagacatcaataaatttatatatatgtgacagataccaacaacaatccagtccccttccctcataccttatttatgtacatatattttatataatagatataatttattaacaatttataaaattactttgttaatactctatatcattttctagctgaatttatcaatgataatgctcttttcccacttttatttttttcccattgaccatgcagcagttttgtgtagaccgtctgataacaactgatctgtttatctaggggggagaaatctaattcaatggaaaatataaataaaattgtgataaacttttgtaaatagagtggcttttaactacacttgagatggctagcaaattcataaagtgaatttactttctttcaaagttcagtaattctttctggccattagggatatgtccatttatactttctcagtatcccaagtcatttcatggttttaaatcattcatgaacttccaaatatagtgaatttatttcttctgcatttaaaattttatcacttaaatatacaatataccgtattgccatgacgaaaaatggtaaagactatttttcacttctgttatgcatttcattaatacgatatctgtatgtgtttccaagttagacatttcttttgcccatttcctacactaatgatactaatgatgactttgtggaatattcagaattaacaaaatgtgttttgagtgctttttttagtactggggcaaatttgcagtaatatcgcctgctttttacattaaattccccataacttttacaactatgggaaaatttctgaaacgtgcacagattccaagtgttttctgagaactttatgcttattgtagagtggttacagacactgaatgctaaagtgtattactctttgaaaagcattgcttgatttcttttggtgaattctgtaaaggtgcagggaaacataacgtcccaattattttttctttcttctttgtttgctgcctatctactttgaaagatacaatagttaaaacccagaaaagagattggaaaccccttagagaatgaaagacatccaagggctctaaaatgcggcagttgctgcttctgagaccaaaaaagggggcaaaatatagagtgtgtggttctacttgtgtgattttttgaaagaaagtatttgaatttatctaaaaatactaaatttgtatttacattagttttcaaatagaatttaataagtacagtgttctataggtaatattgagagaaatagaggacaatgaaacctctctcctccatcatcttgtatgaactaccaaaatgtttatcatatggacagttctcatatatagtcaaatagaaagaaagacataataggaaaacaaatgacttgggaaactaagctaacatggtctaattattctgacctctgctcacctaacttgatttaggaacaaatcattgagagttagagcatgaatagtcaagactgttagaccatatctcaaatatcagtgacttcaatcaactatgtttccagtttaagctgaataggctttattaaatagttgttgaatgaatggataaacaaataatgtactctggggattacctgataccaggattctgaattttcagatgtatcatagaaggatagcagctttgcaattaggtaaattgttaactgtgtcacctttagcaagttatttaatctctttgagcttcagcaaagtaggaataatcatatctaatttgaaaggtcgtggtgatggctagggctaacaaaaatctgattcacaacatgcaattaattaacagtagccatttttagtggttgaccaaaaaaaggatttatattttcaatgccagcacactcgatgttctgttgggaaaaataataatgatttttgtgtgcttctccatatggtataatggaatgatttgtggatggaaataaaactgttctaaaatttttgtgacagctggtttaaaaatcttaagtgcctaggcacattcttgattgagaagccacagttttaggccataaaagatgggggaaagatttttatatgagacaattttgtgagtgttactttttctttgtctgaaccatagtgaaatctaaacaaggatcttgtgaaacttattttaaagaagcagtttacttcaatgggatcttagataatttcaccagaaaatggatcaccgaaaccagaaggctggtgatcattatttggtttgggccatataagaattgaaactaacggcttagctttaggatttttaggacacttgttgataatttaggattcataattaacatatgtgttgattgttttctgagactaactgggcaatgggtttggatgtgtttacatttattctgattccagtcataaaattatgtcaaggactttccttgtctttttatgtgtatgacagatgtgtatgtatccatttcatctaacaagttaaagcgttcagctataatttaaaatttgtagcttcactgttttatagtacctaaaattggaatgtaatcagtcagaagacattcatccactgctttcattccagaagtattatgctttttgaagcagcaatagcataggaatgttgaggagactatactatacttttatagcatatttaatctcgtagatcacttttcaatgaattataaggctgatgacaaatgagcaaattgtatcagttttctttatgacatgtaacagagtatagctgtgatcatgaattggatagttctggtgtaaaaatctgctttatccccatataagatgtcaggttcagaaaagcaaacacatagtttcgaagagatgttgatcaaactgatgaggctaaatctcaagaaagagacacagttaccctctaatgttacactttgagttcacctttttttttttttttgagacagagtctcaatctgtcgccaagctggagtgcagtggcactatcttggctcactgcaacctctgcctcctgggttcatgctattctcctgccttagcctcccgagtagctgggactacaggcacacgccaccacacccagctaatttttgtatttttagtagagatggggtttcaccatattggccagaatggtcttgatctcttgatcttgggatgcacccaccccacctcagcctcccaaatagctgagattacaggtgtgagccaccatgcccgaccactttgagttcacttttaagaaaccatacttaatggaaaattaccagtaacagggcatactgtttaggatgcattcctaaaatattaatggcaaaagatagccagcctatggcaaagctaattggaaaaaatattttataaaggatgagacttctggataccatatgggaagggctctggttcaggaaaatgtttttaaaaaactgtcattgaagagaccatagaatcaaacaaaataatttaatctgtatgtaaaagaagttggtaccaccataatttttcttatacatgtcatataaggatctactctgtgtattgtcattgagggcagatataatttcttagttcatcattaactctctgaagtatttcacacagtagtttgtacaccttctaagtactcaatacaatgcttgagttcaattattggaaagtggtctcttggagaaaaaagaatcatagtgcaaaaccaattattttacatggacttttcctctatatctaagccctaataagaggcagctgtctgatatacatacatacatacatacatatatatatatatatatatatatatatatatatatatatatatacacacacacacacacatatatgtatatatatatttggagtaggggatggagtcttgctctgtcacccaggctggagtgcaagtggtgtgatctcagctcactgcaacctctgcctcctgggttcaagcgattctcctgcctcagcctctccagtagctgggattacaggcgcctgtcaccatgcccagctaattttttaaaatatttttagtagagacagagtttcatcaagttggccaggctgctcttgaactcctgacctcaggtgatccacctgccttggcctcccaaagtgctgggattataggcatgagccaccgcaccctgccaactgtctgacttatcttaaaaggctaaggacctggtttgtttgtcaaattttgaaaatagatgcctcagttcataagatttccatattgtgtggcaggcgcctgtaatcccagctactcaggaggctgaggcaagagaatcacttgaacccgggagacagaggttgcagtgagctgagatcacgccactgcactccagcctgggcgacatagtgagactctgacaaaaaaaaaaaaaaatccatatgtgaaaattcttagaagcttcctatacaatttcagctgaagattcagccaacagttcattctgagactgtgttccatggaaaaagtaaagcccaggcatggaagtgggaatggaaagaaagattctaagcctacaaatactcaaacatcaagaagaaataaaaataagtcatcacttcgacttcatgtgctaacatcactgaggttataaattcccaggaatattttattgcgggagcaagactgcactgctgcctttcagcttgcaaattccagtgagaaacgtctttctctctgctctcaactaactctacagaacgctgtcctctcatttcttcaggctgcagttctagagtagggactcagagtgccactgttggccagtctggaaacagagataaatgagccaatccccagacattccggcttggtggcttttctaatttcatggaatgcaaatccaagagcagacccacaacattcctattatggctcctagttctacaaattataagcaggaacggaacggatttacaggcaatgagttcagctccttcttggctggagattctataatccaagaagagtttgaaaaggggcttatttgggctggagcagcagcaactctaactgtggaaaaggtggggaatggtgctggactgacagtctgggtagaaccaaggcgactactgcctcctttcctgctatttctatcctgctgggcattctctatgatgcagatccgttattcagtcctagaggagctggccaagagtttggtggtgggaaaccttgccaaggatctgggactcagtgtcgaggacatgcccacttgaaagcttcgggttaatgctgaggaataatacttcattctaagtggggaaagtggagacttacttgtgaatgactgaatggatcaggagcagatacgccccccaattatagcttgggccataacgctttgaaatagttgaaggccaggcatggtggctcacacctgtaatcccagcactttgggaggccgaggcgagcagattacgaggtcaggagttcgagaccagcctgaccaacatagtgaaaccctgtctctactaaaaatacaaaaattactgggcatggtggtgcaggcctataatcctagctactcggggggccgaggcaggagaatcgcttgaacccgagaggcaatcgcaccactgcactccagcctgggtgacagagcaaggcgccatctcaaaaaaaatgaacaaacggtagttgaaaattctttaaatgtttttcacattaatatggagattcaggatatgaagaatcatgcaccacggttcagcaggaatgttattaagttacgtatctctgagtttacccagctggaacaagatttgcaacagaacctgcagaagatcctgatgttgagagaaattccttacaaaattatcaccttagcagcaactctatatttctctttgaagtaaaagtgaccaacagtggaaagacatatgttgatcctgtgttagagaagctgcttgactaggaaaagcagagctcccatcccttagtgctagcagccttagacggccccccaacaaagcagcatcactcaactcctgatcctattggttgaagccaatgacaaccctgtgttcatctaggatgtgtacagcgtcggccttcaggaagatgtgcatccgggcactcctgtgctgagagtgagggccaccaaccaggactagagtgtcaaggcagagatcacatatggcttcacaacccagagtacccatatctagtttggccttgatcaaatagtggagaaatgaaaactttaagtacattggacttttaaagatttttaatttccatggttttggtagcaagtgacagagagggactcattgtccagtgtacagttgagaccgaatttctagaagataatgacaatatcctagaggcgatttttacttctaattccacaatgattcccaaagattctgcaccttggacagtaatcactgtccaggatttaaatcacaagatctttaaatcacaagatctggattcgggagaaaacgaggtcacatgtctgatataagaaaatgcaccttgagaaaaatcttcctccaataattaactacatgcttgtaacaaatggggccgtggaccaggaacagacccaaggtataacatcagcatcactgccactgacagaggcaaaccaaccctctcgtccagcccaagcatcaccctactcattggcgatgccaacgacaatgctctggttttctaccaggcctcctacgtcgtccacgtggccaagaacaatcttcccaaagcctccatagtgtgcaagtagacacctccaacctagacttgggacccaacagccaagttccctattccatcgtggccagtgacctggagccacaggcgctgtgattctaggtgtccttgagcgcacagtgcgccttcgaccaagagcagccgcgagccttcaagctcacgctgcaggcccgcgaccaggactagctcgcgctcggcgtcaacgtgagcctgcgcgtgttggtggacgacctgaatgacaacgcaccgcgggtgctgtaccccagctctggagcgcaatggcttcgcgctcttggatatggtgctgcacgccgcggagcctggctacctggtcaccaaggtggtggctgtagacgcagatgtgagacacaatgcgtggctgtcctaccacgtgctgcaggccagcaagcccaggctcttcagcctggaatgcgcaccgacgaggtgctgacagctcgcacgatgggccacaggaaagcgactcgccagcgcctactggtcgcggtgcactgcggtggacagccgctcctctcgctaccgccacgtcaccaccactaccgcccctcgtcgccgacagcctgcaggagactctgccagacctcagcgatcactctgcaaagctacagcctgaatccaaaattaatttatatctggtgattgccttagctttaatttcctttttattcttcctgattgcattgtttgtgctggttttaaagtgccgaagaccccaaaatgatcctgtctgagtctttcccacggatgtctatcccgcgctaagccccaggtttctgggtaactgtagctctatgatgccatattcctaccaggtgtgtgcttctcctacgaatccagggctgagtgaacttcttttttgaatccctacccctcaggactcaatagcagtttcactgcagaaagccccttggggaaggggatgattgtgattattctaattgcttgggcagaatccactctccaaggtgaaaaattcttgatgaaactaagttcagtcacaagcaggttttcttctagcattaaatattttcagagatctcagtaaaaagcatttctagcagcaagaccaaaggcctaagatgagaaatatttggcatggtgagcttgagggacagtagtcaggcagacaagagtatcagacatgccagagcatttggggcctgtaggtaaggagcatgttttgattatatatatttgtatgtgtttgattatattttataattttactttgatattcaaattgtactgatccaaaaataagggagggacaaatcttggccattgtagtatgagagatgtaaatttacaactcagaatccctgcttatcacttctccttcagcacacaactgtttcattttctatttaagaaacttcctctcactgcaaaaagacattctggctgataaagttagcctataatttcagtaaatctaagaatatgactaatggaagttgccagacctaaactttgaaaattattgttccactgaagagcgtcttatgactgagtgttccagtctccttctcaagctgaaccttgcttttcaaaccagattaagaacactatcataagttatactgcattttatttccctacccatgtccactgcatcattctctatagtacaaagagcttgtctcgccaggcgcatctataatcttagcactttggggcgccaaggcgggtggatcacttgagcccaggagtttgagaccagcctggacagcatggcaaaaacccatctctacaaaaaaaaaaaacaaaaattaacaaggtttagtggtccatgcctgtggtctcagctacttgggaggctgaggtgtgaggatcacctgagtctggggagattgaagctgcagtgagctgtggttgcgctcctgtactccagtctgggtgacagaattagaccctgtcccaaaacaaacaaacaaataaagagcttctctccttatgacttatttaaagcttgggaaattgttccaattcaaatgctttaaatggacttgagctaaaacagaatgtggtatatgaaatgttcttataatcaggtgattgtaaaaattgatccagataatgttagcatagcattttactgaactagtagtttacaaacacttcaaaaattatagaataacatttgcatataaaattcctcatacatttccctatcagtgaattggaagcttacaatatacaatattaccaaaaagacaaaaaaaatgaaaaggaaacagttacctttggaaaacataattaggtaaaatgggtaatatggaaagtctgaaaactgaaaaaattactgataagtcaagagaaaaggaatattagtaggaaaattcataaaagtgtgtctgactactcacagcaggtttccttattggtatgtattctgtggtccatctaagctatgttaattttattttaaatgctacctgggtattggcttctaaaaggaattcagtaaatcagataatttggcatcttcaatctagattctgatgctcacctgaaaagtctgctaaggattggaaaccaagaaaagtgaagtatctcaacagatatgtgtcacttgtgtgtactggattttttttttttttttttttttttttttttttttttgagatggagtttcactcttgttgcccaggctggagtgcaatggcatgctctcggctcactgcaacctccgcctcccaggttcaagtgattctcctgcctcagcctccctagtagctaggattacaggcatgtgccaccacgcccagctaattttgtatttttagtagagacggggtttctccatgttggtcaggctagtcttgaactcccaacctcaggtgatcttccctccttggcctcccaaagtgctgggattacaggcatgagtcactgcgcccggtcgcgtactggatttatattgtgtaatactttgctctagcagtatagtaggtgagacagtgactgtgtctagtgagcaaaaggcacttatttgacacttttgactcttcctttctacttaccttatttaaaattgatttttgcatgtggcatgatgcaccagttcattgaggtaggggttgaagttatttcccatttttttcaataccatttattaaaaatattttcctctttctgttgaatttgcttggtgcctttgttgaaagtcatttcactgatatatgtagttctatttctatattcttgatcatgtttcatttgtctattcttttactaatagcacactgtctcaattattgtagctttatagtaagtcttgctacaaagtcttactacaggacaaagcttgtaggatttttgaatgggatggcattgcatctatacctttatcagggaaagagggaaggagggaggaggatcatcttaacaatattgacacttcaaatccatgaacatggtatatatttccatttaattaggtctttaatttctctcagctatgttgtatagttttcagtgtagagaggtcatgtatatttctcattaaattgtccctacatatttgatgttttctaatgttattgtaaatagtatttttaaaattgtatcttctaattgttcatttctagtttacagaaaaatgaaaaactatgtttttatgtattctatatgcttttgaaaagtaagaggtgcaaagtgctctattcttacactatattgtgtgagaatataagtcgaaaccactctgcataagttcaggcttccattctcttcagtttgtaggttgagagaacccatccagaaacagtaaacattggtgtctgcccaagtctggtcctgggtggttcattcattcatttacataacaaatatttattaactgtctgctatatgcaaggcactgacctatggactaaggatgcagcaatgaacaaggcatatatgattcctgagttaatgggccctattctaatacatgatattttacaggtctgataaaagccaacaaggagaaatacaaaagcactaagagaaagcttatagtagggaagcttcgcctaatctgaaggtcaaggaaggctttctttttttcggaaagtgatatttagagagatgaatagattaataggatgagtagaagttatctaggtaacaaggaaagtaaaaaagaaattgtcaggcagaggaaatagcatgtgtaaagatctttttaaaaaataaaaggtgtgactcaagcaatttaaaagggctagggaggctagaaacagaaaataaatagatgaaactaataaggcagggagagccttgtaaatcacacttaaaattctggattttgttctaaatacccttgtacttaggagctattaaaatattttaaacaaggcagtgacaagatatttgaattattaagcttactctggctgctatatggagaattgatttatgagggttataaatagaaataggaagataagataggagactatggcaatattcctggtaagaaatggaagaagagctggcttggattaaaggggaggcagtggatgtagaaataaatggatgaattatagatatatttaggaaatgggttcaataagacttaataatggaataggtggaatataaatttcatgagggcagggggtgttttgtttattattatattcctaggtgtctgaaaatattgttgtgttgcctggcaagtggtagatcttcagtgaaatattattaactgaataaatacaatggataaatggggagcagggattaagagtgattcctgggtttccacattaaggaactggatggacaaagctaccatttgatgagaatggaagactaaagaatgatagatttaagagaaatcgagttgagttccagccatgttcatttgaaggatctgagaaacagtgcagatattcagtgtgtgattagacatatggtcatcattcttttttttttttgagatggagtctcgctctgtcacccaggctggagtgcagtggccctatctctgctcactgcaatctctgcctcccaggttcaagtgattcttctgcctcagcctcctgagtagctgggactacaggcgtgcaccaccacgcctggctaatttttgtatttttagtacaagacagcatttcaccatattggccaggctggtctcgaactctgatctgcccgcctcggcctcccaaagtgtggggattacaggcgtgagccaccgcgcccagccggttaccattcttttactctgagttcttccattgtgatcatctagtcagatgggtagatccttataaggctgagcataataagcttcctgatagctctacactggtatgttttggggttcatggctgagctacttttgtgttttatttatcttcctgatctctttttcactgtaagaaacatccagcacccagggaaatttgctgtctaattcatactccactcttcagactagtcctagtgttcagttttgttttgttttttttctgtgtctggaattctattaaaatgtgtcaggctgttttaatttttgttgtttaattttctttcacatgattatatgtgctccatggatttttttgtttgtttgttttttgtttttgtttttgtttaagcggggtcttgctcttgtcgcccaggctggagtgcaatggcttgatctcggctcactgcaacctccgcctcccgggttcaagtgattcttctgtctcagcctcccaagtagctgggactacaggcacatgccaccacacccggctaatttttgtatttttagtagagacgggtttcatcatattggtcaggctggtctcaaactcctgaccctggtgatctgcccacctcggcctcccaaagtgctgggattacaggcgtgagccaccgcacccggaggaaatttttaacctcagtttttcttcaccatctgtaaaactgcatagaaggaatgtttaggataaaagatgcataacaatcataacaaaattgttgggttttaatgttatgagtacacttggaggattctatgtccacacataccttaaacatcctatagagtccttagcattttaaagttgaaaccaacagtatgaatgatggtagaattttcccccccaggaagttagaactgttccatatcttgatagagggatgggttataaggatgtacacattttccaaaactcattgaacttaagagtcttgcatgtgactgtatataaattatactttaattgaaaataaatttaagaaaataaaattggctgggcgtggtggctcacgcctgtaatcccagtgctttgggaggccgaggtgggtgaatcatctgaggtcaggagttcgagaccagcctggccaacatggtgaaactctgtctccactaaaaatacaaaaattagctgggcatggtggcggacacctataatcccagctactcgggaggctgaggcatgagaatcgcttgaacccaggaggtggaggttgcagtgagccaagatcatgccattgctctccagcctgggcaacatgaacgaaatgccatcttaaaaaaaaaaaattaaaagaaaagaaaattagcctcccccaccctcactatacctcagactcacccctgaaagatcactactattcatccctggttatgtacacttacaaacattttctgtgtgtatgcgaatgtatgtgtggggttttctttgcacaacaggatcattttacagtatatatactgttgtgcaacttgctctttccacttaatatctcaaggaatcttttctttgaatctttatagccatgtacctcaatcttagtagttttctttattttatttttgaataggaaatacatttacatggttttaaaaatcaaaacaatatactatgtatatattgagaagtctgacttccatccctatcctactcctattccacccttgcttcctcctgtcccctgtaggtaaacattttataactttattaagcatcctgtcagcatttcttatgcaaatatgtacatatatttttatttccccattttttttacaaaaagataaaatactatacaccactttatatcttcctttcttcacattatatcctttaaaaatatttccatattggccgggcgcggtggctcacgcctgtaatcgcagcactttgggaggccgaggcgggaggatcacgaggtcaggagatcgagaccatcctggctaacacggtgaaaccccgtctgtactaaaaatacaaaaaaaaaaattagccaggcgtgatggcgggcgcctgtagtcccagctactctggaggctgaggcaggagaatggcgtgaacctgggaggcggagcttgcagtgagccgagatcgtgccactgcactccagcctgggcgacagagcaagactgcaactcaaaaaaacaaacaaacaaacaaaaaagaacttccatattaatatatagaaagctgttttttttaacagttgcttagcattcctttggattattaaccagtctcataaatgagcgctattgaatagccctgtacctacatcagtttttacatatgcagtatatctttgggatgaattcccagaaatggaattgaaattgctgggtcaaagaggaaataggtgtaattttcttaggtattttcacaagaagtgttaattctaactttctgttttgaaatgatttcaaattttcaaaggagttgcaagaattgtacaaagaactgtatctccttcacccggatgcaccgggtgaattatatgtattatataattgtatctgtaggccaggtgcagtggctcactcctgtaatcccagcactttgggaggctgaggcaggtggattacttgaggccaggagttcaagaccagcctggccaacatgataaaactccatctctactaaaaatacaaaaattagccaggcctggtaccccatgcctaagggtgaggcatgagaaatgcttgaacctgggaggcggaggttgcagtgagccgagatcgcaccactgcactccagcctgggcgacagagcaagactctgtctcaaaaaaaaaaaaaaaaaaagtaaaaaagttttttaaaaagatgtatctatatatacatatttacatacacacccaagtgtgtatgtatatatgtttgtgtgtatgtacacaaacacattatttttatatgatatgatttttttatgacatgattatttttatgacatttgagagtaagttgtagaaattatgtttctttattcctaaatacctcattgtgtatttcctaacaaggacattcttttatataattaaattttaataataaaaatcagaaaatttaacatcaatgcaatataattatttagcctatagtccatatttaaattctaccataccttatagtatattttactatacctcatagtaattttttttagtccaaaatatcacacattgcatttagttgccatgtctctttttttttttttttttttgagacagggtctcactctttcgcccaggctggaatgcagtggtatgatcttggctcactgcaacctccgcctcccaggttcaaatgattctcctgccttagcctcctgagtagctgggactacaggcatgtgccaccacactcccaccacacccagctaatttttgtatttttagtagagacaaggtttcactatgttggccaggctagtcttgaactcctgacctcaagtgatctgcccacctcagctaagtgctgggattacaggcgtgagccaccatgtgtggcctagttgccatgtctctttaatctactttaatctgaaacagttcctcagccttgtttgtttatatgaaactgacatttgtaaagactagaagccatttgtcttgtataatgcctttaatttatatttgttttatgtttcctcgtgattttatatatagagtttgtttgtttgtttgtctgtttgtttgttttgagatggagtctcattcttgtcacccaggctggaatgcagtggcgcagtctcggctcactgcaacttctgcctcccaggttcaagcaattctcctgcctcagcctcctgagtagctgggattacagatgcctgccaccatgcctggctaatttttgtacttttagtagaaacggggttttgccatgttgcccaggatggtctccaactcctgacctcaggtgatccgcccgccttggcctcccaaagtgccgggattacaggcatgagccaccgtgcccggacctcatgattgtatttatttatttatttaatattattattattatttttttttttttgagatggggtcttgctctgtcacccaggctggtgtgcagtggtgcgatatcggctcactgcaaccgctgcctcccagattcaagcaattctcctacctcagcctcccaagtagctgggattacaggcatgtgccaccacacccggctaatttttttgtattttttttagtagagacgaggtttcaccatattggccaggctggtctcgaactcctgaccttgtgatccacccaccttgacctcccaaagtgttgggattacaggcgtgagccaccacacccagccttatgattgtatttagactagacatttttttggtagtatattatttagccattgctgtgtaacaaattatcccaaaacttagtggcttaaaagaagcatttattatctcataaattttgtggatcaggactgggtatagctttgctgagtgcctctgcctcaaagtcttacaaggcagcaattaaagtgtcacctaaggctattgtcttatctgaagggtcaacagaggatggatccgcttctaatctctctcacatagttaatggcaaaattaagttccttgtggattgttagactaagggttccagttccttgctggttgttagcttgaggtctacctcagttccttgccatgtggacctccatagggcaaccagcttctgttagagcaagtaaaggagagtgccagagagggcaaatgtgatgaaagccacaatctttttataaacctaattttgaaagtgacatacaaggctaggcatggtggctcaaacctgtaattccagcactctgagaggccaaggagggtggactgcttgagcccaggagttcaagaccagcctgggtaacatgacaaaaccctgcctctactaaaaatacaaaaattagctggtctggtggtgcatgcctatagtcccagctactcaggaggctgaggccagagaattgcttgaacccaggaggcggaggttacagtgagccgagatcacaccactccactccagcctaggccacagaatgaaaccctgtcaagaaagaaaggaaggaacaagggagggagggaggaaggaagggaggtagggaggcagggaaagaccgagaaagtgacataccatcatttttgctgtagtttgttcattagaagcaaaatcacttggtccagcccacactctggggagatgattttctaactccatttgtaataacttattctacttttattagttggcattatacagtaagaaagagctttcttttctcttcttatttattcatatatggctcatgtgttttttccaatgagttatattctattactaacattttttattttgacctcaaattgttttagatgttaccaataagaacctcttcaagctggttcttgtgtccttttgccataactctctcattttcttgaaccctttcttactttctgatataagaaaatattagagactcatactttccttgttccagttctgagatgaaccatttatccaaaagccttgcttcattttagtagggaatagtatttagaaactaagatctgggtgtgaggtatgctcactgctaatgggctgtcactgtttctaggccttgtcagcagacggagctaggaaaaacacacataaacacacccatatttatatttgtacacacactccctcaaaatcgtgagttcatattgatacctccagttctggttcttcctagccttccccctttccatctttgtatttttattttccaacagtaagaaccctggctcccagtgctatgaatatatttactcatttgctccatccactgcactccagcctaggccacagaatgaaaccctgtcaagaaagaaaggaaggaatgagggagggagggagagaggaagagagagaaggaagaaggaagggagggagggaaaactgagaaagtaacataccatcatttttgctgtagtttgttcataagaagcaaaatcacttggtccagcccacactctggggagatgattttctaactccatttgtaataatttattccacttttattagttggcattatacagtaagaaagagctgctgaagatttgcttgcaattggttgtctttaaactgagggtatattgtcaaagtactgtgctgaaaagttacctgtagtatagttatgtgattcattaaaataaagtttgtttctattatgtgcagttttagagttttgccacactctggttgattagtatattttctgttgcttttttgttttgttttgttttgttttgtttttgagatagggtctcgctatgtcacccaggctggagtccagtggtacaatcacagctcactgcagcctcaacctcgtgcacttaagcgatcctcccacctcagcctcccaaatagctggggctgcaagtgcacaccaccatgactggctaattttttaattatttatttatttatttatttattttagagatggggtctcactatgtttccccaggctgaccctgaactcctggggtcaagtgatcctcctgccttagcctccaagtgctggtattacaggcataagccaccacacctagcctagtattcttttttgaatatgtaaaacattaacataaagtcaaaactattaaaaaaaggtgtactcagaaaattgtcattcctcccctataccttctgcctcattcacaccacactctgtagataatcgatttcattagtttgtggtttatcctcactgtgtttctttttgcaaaacgcaaaaacaaaacctatacatatttatattttcttatgtcctcttctttcttacacaaaaggtaacacactatgtaggtagtcctggctttgaacagtttcactataaaaatatttgttactacagcttaaataacataagtctcctaaaaataattcaaattttagttaccatggtatattaactttgagtagttccataaaggacaaacttggctgctagcccttcagtccacagagcactttgaaaataacagatgagcaaaataatgtggccaatcacatgacttctttcaaagtatgtcagtgatcagtcactgtgtgcctataatttagttcatgcacagacagcaaagcatgtagttgtgttgccttccagtgataaacccacataacattttagaaaaatgtattaagaattggccagcaaagataaaagtgcagcaaagaaacaaaagtgataatgttttcagtgaaatttgaattgaacataaatggagttatagaagaaatagctgaccatgggaatgttcacactgctactttcaagaatctctagaagggcagctaaaggagcttagtgaaggtgaatttattgacatgaatgagaaaagtaattgtgatgaaaaggatgaagatgtcccagagaaagtaatgccagcaaaaacttcacattaaaggaactctcagatatttcaaagcattgaaacctccaagaataaataaaatgttggaagttgatccaaacttagaaaggagtatggcaacttgtcaagatgaagaaaaggtgcttattcctttttatttatttatttagagacagagtttcactcttgttgcccaggctggagtgcaatggcatgatctcagctcaccgcaacctccacctcctggattcaggcagttctcctgcctcagcctcccaagtagctgagattacaggcatgtgccaccacgcccggctaattttgtatttttagtagagacagggtttctccatgttggtcaggctggtctcgaacccccaacctcaggtgatctgcccacctcggcctcccaaaacactgggattacaggcatgagccaccatgctccacctgcttattccatattatatgttataggatgaaaagaggccaaactaatcttgacatgttttttacaaggaaataatcctccatggttctaatttttttttttttttttttttttttttttgagacagagtcgcgctctgtcacccaggctggagtgcagtggcacgatcttggctcactgctagcaccgcctcccgggttcacgccattctcctgcctcagcctcccgagtagctgggactacaggcgccggccaccacgcctggctaattttttaaaaaatatttttagtagagacggggtttcaccgtgttagccaggatggtctcgatctcctgacctcgtgatccgcccgcctcggcctcccaaagtgctgggattacaggcttgagccactgcgcccggtgggtctaatgttttaaattacactgtgttaaataaatattagtttgttggttttttttttagtttttttatttctctacaaatttacaaccaataagagtttttaatgctttgacaaaaaatgttaaaggtcatagtacaatcgcatttcttcccattgattattaacatcactttacatagtttcatcttgcattagcaattttgtgtgtgtgtttgtggttttaaggagcggagagtttaataggcaagaaggaagggagaagacagaaggaaggagctcccccttacagagacagagggagcggggctccaaaagaggaggtccccatctaccgcggataccagccaggtatatatgcagaggctggtggaggtgatgtctgatttgcatagggctcaggggattggtttgaccaggcatatcattcacgtagcccgagaaaaagctggccctcccaccccagccttttaatatgcaaacgtagggcgccatggatgttctaaacacgtggagatatgtggggggcagccatgtggccaggaacttgtggggcaagggcaagaaggctgtgggaatcgccaagttgaatggacctagtttctaatggcctgcatttgcatatcaaaggttgctggcctggctcctagagccggggctttaaaagaaacttttccggagatgctttaaaaaatgaaaacttcccaaggaccccttttcctgtctatctgcataaaataatttcttttattatttatttatttatttatttatttatttatttatttatttatttatttattttgagacggagtctcgctctgtcgcccaggctggagtgcagtggcgcgatctcagctcactgcaagctccgcctctcgggttcatgccattctcctgcctcagcctcccgagtagctgggactacaggcgcccaccaccacgtccggctaattttttgtattttcagtagagacgggatttcaccgtgttagccaggatggtctccatctcctgacctcctgatccgcccgcctcggcctcctaaagtgctgggattacagaataatttcttaataactcctaccacattcctccctgtggcgatatcaaactaactgctgttaggaggctttgggcgaccattgcttctggctacttcctgctgaaaaggggcgtctaatggagaacagcagctagggctcctcctggggttgatctaagggtcctcggaagaatggcgtccatgtgtggttcagtttacagcaccgtttggagtttgattgcttctaggcgagaagaaacaattcaagttatagtattgagtatacagagtccaaatatcaatacaagacatataagcaagagagtgcttaataaaggggttaaccaattccataaagaagactggaagtaattaaagagggattgtagccactcggggctgaagcccacattttccctgagcctgtcaataattttgatttgatttttaagtccctgtagatttgcctcttctttactacaggtgttaatcccaaagaagcatgtttcatttaaaaatgcattactggccaggcgtggtggctcgcgcctgtaatcccagcactttgggaggctgaggcgggagcatcatgaggtcaggagtttgagaccagcctggcctacatggcaaaaccccatctctactaaaaatacaaaaaattagccatcgtggtagtgggcgcctgtaatcccagctaattgggaggctgaggcaggagaatcgcttgaacccgggaggcagaggttgcagtgagccgagatcgcaccactgcactccagcctgggcaacagagcaaaactccatctcaaaacaaaacaaacaaacaaacaaacaaaaactgcattactaaatccaataaaaagtcctagtagactcagtgatagtaaaactttcatgcttcctttttgccagtaactattatccctgctataaggatactaattaagcaaaatacgacagcaatggaaactctgtccaatatttcagttagaaggtgctaccatggataaccctattgcaaatagtagagtgaggaaagcagttcccacaaatgtggtgtggtaggtaatttccatctaaaattttacttgccaacatatagaattcccctctgtgggcctacgaagttccttggttttattttcccaaacaaagaaacctccgggttacaggtaccttacttactttcattacctggcacaatttgcaaaataattgcccagaactagcatattgattcacattttcacattacccatccctttttcccccccaccaagctgcagaagatcaccacttgattcacaggaataagcagggccagggttagtctaaaatgtaggcaaaaagcttaaaaacaattaatgagactagggtttaatgacaaatgtatgataagctttggagcaaaatttttctctccagtcctcatttttggtaaaaactaattatgaatgaactttaatcttatacttggcctgattatttgcatgaagtgcagcaagaatggttatttctacataggacttttggattggctttgatgaaacactgttccacaaggaatttcagattagacttttaaagctgagcccagacatgggtttgtatcctctaatacctgtgagttgggttatcctctcctcttgaggtcccaagataaactcagagcttccagacctgttagaaagtgacattcttcactgaccacaggttaggaaccctgtgtggggactgtgtagacaaggtgtgaggccagttctccccaaggggcttttattggctctgcatgtcaagcttgattccttaaagggaaacacaccctttcagttaaagccttggcaaaataaccggtttttccaattgtgttctgttgacaaagaaaaatggattcttgctgcactgatgcgaacaactatattgccgtaagttaagagtacttacagatagtctccaaattttagaggaaccaggcagagaaaaatgaacatgctccaaattttgttcacagtagtataccttacttgattattaaaggccataaatagtttaaaataagtttcctttcccagtccatgcaccaaaatgatacggctctgatgagtggaggaacaacagggttcctggtcctcatgctggtttagataaaatgacacagacacatgtggagtggttttaaggagtggagagtttaataagcaagaaggaagggagaagagagaaggaagacgctcccccttgcagagacggagcgggggttccaaagctgaaagaggaggtcccccacattaacaatttttaaaataccgtacaactgcagaaaatgaggactgcctgtacatactgtttgacactttgtttttttttttaacttatcaactttattttgtttgtttgttttggttttgggtttttgtttgtttgtttgttttggagacgagtctcactctgtcagccaggctggagtgcagtggcacaatcccagctcactgcaacctccacctctcgggttcaagcaattctactgcctcagcctcccgagtagctgggattacaggtattcgccaccacatccagctattggttttggtttttgagacagggtcttgctgtgtcacacaggctggagtgcagtggtgtgatctcagctcactgcaacctctgcctcccaggctcaagtgatcctcccacctcagccttccaagtagctgggactacaggcatgcacaccatgcgcagctaattttttctattttttgtggagacggggtctcactatgttgcttaggttggtcacaaattcacagcctcaagcagtcctcctgcctcaccctcccaaagtgctgggattacaggcatgagccaccacatccagccttaccagctatattgaagtataatttatataacataaaatttgccttttaaaattatacagtgcaatgcattttgacaattgtttacatctgtgtaaccaccatgcaatcaaaatatagaacatttctataaccttcaaaagttccctcatgcccctttgcaatcaattcactacttctccagctccaggcaacaactggtctgcttcctgtcactataaattagtgttgcctctttcagaatttcatctaaatggaatcctataacatatactattttgtatccatcttcttttactccaaagttcttgaaattcattcatgttcctgtgtgtatcagcagcgtgttccatttgattgttgagcagtattgcattgtgtggatatatcacaatgtgttcattcattcaactgttggtggacatttgagttgtgtccagtttagtgctattctgaattaaagtgatgtgaacaatcatgtacaagtatttttgtaggcatattttttttatttctcttggataaataccccaaaacagaattgttttgggggtcatatgaaatgggaagtatatgcttaactttataagaagctgccaaactatttttcaaaatggtaatatcactttacattttcatgagcaatgcataaagcgttccgcttgctacattttctcaccaatgcttcctattgtcaattttttaaattttagcaattctagtgggtgtgtgatactatctcattgaagtttcaactgtttttccctgttgactagagacactgagcaacttttcatgtgttgtctatttgtatatcttcttgaagcattcgttcatctttaactgagctgaacgccttcttaaaattgagctatgggagttttaaaatatatccttgtagctgggcgtgatggcaggtgcctgtaatcccagctactcaggaggctgagacaggagaatcgcttgaacccaggaggcggaggttgcagtgagccgagactgcaccactgcactccagcctgggcaacagagtgagacttcatctaaaaaataataattatacatgtaattatatatgatttttatatatgtaatatatatattcttgatgtgagctctttgtcacatacatattttgtggatattttatcccagactatgacttgtcttttcattttcttagttgtgtcttttgaagagcagaagatgtaattttgataaagcccaatttattttttcttttatagtttgtatttcttatgtcctattcaaaaactccttgcctactgaaaacttatgatgattttctcctatattttcttttagaagttttatagttttaccatttataatttggtctatgaatccttttgagttgatgtttatgtatggtgtatggtgtgaggtaacaatgaagattcatatttttttccaaaggaatatccaattgtctctttggaaaaatatgctgagaaggctatcttttccccaccaaataatcttagcaccttaatcaaaaatcatttggccatggacatatgtaggtgtgggttttttctgggctctctgtgttagatggatagatagacagatacagatatataactgtgtttacacatatgtaactgtaaacacagttatatatctatatatccaccaacagttgaatgagaataaactattgttataagcatatatacacattgtatatatatgtgtacatatacatattgcatatgtatgtatacatatatacacacaaagtatatatatgtatgtatacatatatacacacttaaagtaatggcctccagttcgatccaagttgctgcaaaggacattatttcatgccttttcgtggctgagtaatattccatggtgtatatatatatatgtgtgtgtgtatatatatgtattatgtatatatatatgtgtgtgtgtgtgtgtgtgtatatatatatatgtgtatatatatataccacattttctttatccactcattagtcgatggggacttaggttggtttcacatttttgcaattgtgaattgtgctgctataaacatatgtgtccaagtgtctttttcatataattacttattttcctttgggtagatacccaatagtgggattgctggattgaatggtagatctgttttttgctctttagagaatctccatactgttttccatagaggttgtactaatttatattcccagcagcaatgtgtaagtgttctcttttccccacatccacaccaacatctattgttttttgactttttaataatggccattcttgcaggaccaaggtggtagctcgttgtggttttaatttgcattttcctgatgattagcgatgttgagcattttttcatatgtttgtgggccatttgtataccttcttttgagaaatggctatttgtgtcctttgcctactttttaatgggattgtgttttatttttcttggtgatttgttagttccttgtagattctggatactagtcctttgtcagatgtgtactttgcaaagataatattttggatgttatatttccattataatttagttcaaagtattttctaatacaccttgcaatttcttctttgacccatggattattttaaagtttgttattttgtttgtttattttgagacagagtttcactttttttgcccaggctggagtgcagtggcacaatcccggctcccagattcaagcgattctcctgcctcagcctcccaagtagctgggattacaggtgcccaccaccacacccagctaatttttttttcttttttttttgagacagagttttgctcttgttgcccaggctggagtgcaatggcacgatctcggctcactgcaacctctgcctcctgggttccagcaattctcctgcctcaacctcctgagtagctgggattccaggcatatgccaccacgccaggctaattttgtatttttaatagagacggggtttcttcatgttggtcaggcgggtcttgaactcccgacctcaggtgatctgcccgccttggcctcccaaaatgctgggattacaggcatgagccactgcacccagtccaattttttgtatttttagtagagatggggtttcatcatgttggccaggctggtcttgaactcctgacctcaggtgatccgcctgcctcggcctcccaaagtgcagggattacaggtatgagccaccatgaccagcctaaagtgtattgtttagtcaccaaatatgtaagtattacccaaatatatttgtcactgatttctaatttaattgtattgtgatccaaaaatatacattgtatagtttctattcttttaaattcgttaacatttcttttatggcacagaatatggtctatcttggtgagtgttgcttacacacaactgtgtaactgaaaactgtgtattctgcttctcgtggttgttgtatcctataattgtcaactagatcaagttagtaagagtgttgttcagtgatcttttcttcttcagtgtttactgtatttgctaatcccatccagtgaagtttccatttcatatattgtatttttcacttttagaagttccatttgactctttcatttccatcctcaattatcttcatatttttctttaaatttttgagcacatttataatggaggttttaaagtccttgtctgctaattttgtcacctctgtaattcctatgatgattttcttcctggcttggggtcataatttgttgcttatttgcatgtctaataatgtttttattggacagcagacattgtaaatgttatatttttgagtgtttggattttgtctttctttaagaactattgcagtttgttttggaaggctattatgttttttgcagatcaggttgatcttttcaaggcttgtttttaagctttgttaggacaggtctgtagtaacttttgccttgggctaatttagacctaccacttaattctgacttttttgattaatctgagtgttcagcagggtctctttattatggctaaatgaaattcaaacattttccagccctatgtgaccatcaagaattcagctaatagctccctggcagttcttcgcccagctgcagaaaagtgtcagtgcactctatgtatgctcagattattatttagccaaagacttggggatccatattaatattcctggagttctttgtgtagctccattctctttagtactctatcccataaattctggctgcctcaatctcctaatctccccaaactctaatatctattcctcaactcagcaaaaccatggtgttattcttggatttcccctttcctgccccacagtctgaaagttgtctccaggcaaaaaaaatggagatcctagtttgcggatcctcatttccttctccttttttttttttttttttttttttttttgagatggagtctcgctctgtcacccaggctggagtgacgtggcgtgatctcggcttactagaaactccggctcccgggttcatgccattctcctgcctcagcctcccgagtagctgggactacaggtgcctgccaccatgcccggctaattttttgtattttgtttagtagagacggggtttcaccgtgttagccaggatggtctggatgacctcgtgatctgctcacctcggcctccaaaagtgctgggattacaggcatgagccaccgcgcccggcctgcttctcttctcttatgggttagaatcctgcactgtcttttgaacaaatgtctaaaagcttttatcacacattttgatccacttcccagttgttatagtggtatatctggtttcacatgactgaaaggaaaagttttcaccttgctttttgtactaataatatatcctggaaatcattctatataaatttatagaaatcttcatttttaaaatagcttcataaaactccattgtaaaaaccaggtgcagtggctcatgcttgtaatcccacactttgggaggccaaggcgggtggatcacctgaggtcaggagttcaaggccagcctggccaacatggtgaaactccgtctctactaaaaatacaaaaattagctgggtgtggtggtgggcgcctgtagtcccagctacttggaaggctgaggcaggagaattgcttgatttcaggaggcggagattgcagtgagctgagattgcgccactgcactccagcctgggctacagagcgagactccgtctaaaaaaaaaaaaaagcaaaaaaaaaaactccattgtatgtgcacatatcattatctgttcaacccatctatgacttgtcatttaggtagtttccatccaatatttttgcaatataaaaaatgctaatgaagaacctgagatatatatatatctatatatatagatatatatgtttgttgttgttgttgttatttttgaagtatgtacgtataataaattcctaatagtgtgattgctgcatcataaggtaaaggcatatgtagttttgttaaatatagctattccccatcttgcattcctacaaatagatgagaatgtccattgtcccatagtctcctttgcagagtatattgtcaagctttttaattgttgccaacctgatgggtaaaaagatatctccaaataattttaattaaaatttctcttattatgaatgaggttaaatagtttttcatatgtttaaaagccagtttatatctttttgtttttttagagacaggaatcttgttctgttgcccaggccaaattgcagtgatgcagtcatagctcactgtagcctcgcactcctgggctcaagcaatcctcctaccttagcctcccaagtagctaggactacagatggatgccaccatgtccagctaatttttttatttttttgtagagatgtgaggtctcactatgttgcccaggcttgtcttgaactactggcttcaagtgatcctcccacctcagcctcccaaagtgctaagattacagccatgaaccaccacaaatgaccctatatatttttttgaattgtctgttcatgtcttattttcatttttctagtagttttttttttaagtgttttagcctaaatttgtaaaaagtttaggggatatatgaagggactctaaatgtttatgaagaaatttaattaaaagataaaaataaaaatataagctttatttttcaacatgagctccatcaagttcaaggcacttttgtaagcaatgatactagccatttagttcacccctaaagaactgagagtcctgggaatttagccatgtcaatgcagtattttttatattggttactgaagaaaaaatgggtgccctttaaagttgtaagattaggaacaaaaacaagtcagaagaagccaaatcagcactgaaaggtgggcacttaatgattacccaagaaaactctcaccaaattgcccttgcttcatgagaggaatgagcgggagcattgtcgtggtcaggaaggattctggggaagttttcccaggcattttttctgctgaagctttggtaactttctcaaaacactctcataataatcagatcttatcactctttggccctccaggaagtcaaccagcaaaatgctttgaacatcccaaaaaagcgcttgccatgacatttgctcttgaccagtctgcttttgcattggtcaaatgccaccacttccacctcttgtgctttgttttcaggatcagactggtaaagtcatgtttcatctcttgttacagtttttttttttttaagaaacccttcaggatcttgatcacatttgtttaaaatttcaactgaggctgggcccagtggctcatgcctgtaatcccagcactttgggaggccgaggcgggcaaatcacgaggtcaggatttcgagtccatcctggctaacatggtgaaaccccatctctactaaaaatacaaaaaattagccgggcatggtggcaggcacctgtagtcccagctactcgggagggtgaggcaggagaacggcatgaacccaggagacggagcttgcagtgagctgatatcatgccactgcactccagcctgggcaacagagtgagactccagctcaaaaaaaaaatcaagtgaaaactctggtcttaaactgcagctgatctattttatttttattttttttcagacacagccttgctctgttacccaggctggagtgcagtggcaccatcatggctcaatgcagccttggcctcgtgagctcaagcaatcttcccacctcaggctcccaagtagctgggactacaggcacatgctaccatgcctggataatttttttgcagctaatctagatgtaatggttttggcacccatctaatggaaagtttgctcaactttaatttttcagtcagaattgtgtaagctgaaccgagatgtctatggtgttggctattgtttctgctgttaattgtaggtcttctttaattagagcacagacaagatcattttttttcctcccaaattgatgtagatggtcttttgctgtgggcttcatcttcaacattgtctcatcccttcttaaaacaagctagctacttgtaaactgccgttttctttggagcattgtctccataaacttttcacaaaacatcagtgatttcaccgttcttccactcaagcttcatcataaatttgatgtctgttcttgtttccattttagcagaattcatgttactctgataggggctcttttcaaactgttatcttattcttcttagtgcctcaaactagatcctattcagacatggtataacaagttagtatgggtttattttggtgcaagaaatattttgaaatccacacatttttttcataatatgcattttccatgaagtttttgaaaactccttgtattaggaatattagtcctttgtccagtaaacagactgcaaatattttctcacagctcatcatttaccttttggcatttttttgcaatgcaatttttttccctttgtttttgttttttgtgtaatgaatcaatgttttcttttttttttttttttagaccaagtctcactctgtcacacaggctggagtacaatggtgcaatctcagctcactgcaacctctgcctcccaggttcaagtgattctcatctctcagcctcccaagtagctgggattacaggcacatgccaccatgcctggctaatttttgtatttttagtagagatggggtttcaccatgttggccaggctggtctcgaactcttgacctcaagtgatccactcacctcggcctcccacagtgctgggattagagacgtaagccactgcccccggccaaatcaacgttttcttatattgcatttaggttttaagtcatagttagaaagcctttccccacacctaggttatagaaacattcattacttttttcttccagtgctagtacttgcatggtttttggtttccacatttagatccctgatctaattggagtttattcttttgtgtgctgagatatggatctgattatatcttttttcccaaatggctatccagttgtcccaatgccatttattaagcacttcatctttgtcccagtgatttgagatagcatctttatcatgtaccaaacttctatagtgccagaagatttttattttttttagacagggtctggctctgttgcccaggctggagtgtagtggcacaatcccagctcgctgcaacctccgcctcacatgctcaagtgcccgcacctcagcctctcaagtagctgggactacaggcacatgccaccacaccaggctgatttttatatttttttgtagaatgagatttcaccatgttgcccaggctggtctcaaactcctgagctcaagaaatccgcccacctcagcctcccaaaatgctaggattacaagcatgagccaccacacccggctgccagaaaattttaatgatcagaaaaccacaattctttcttcctctgttatatgttgaagtaaaatacttcatttagaaaactaagccgggcacagtggctcacacctgtaatcccagcactttgggaggttgaggcaggcagatcacctgaggttaggagtttgagaccagcctggccaacatggtgaaaccctgtctctgctaaaaatagaaaaatttgctgggcatggtggcgggtgcctgtaattccagctacttgggaggatgaggtaggagaattgcctgaacctgggaggcagaggttgtggtgagccgagaccacgccattgcaccccagcctgggcaacaagagcaacggtaaactccatctcaaaaaaaaaaaaaaaaaaagaaagaaaaaagaaataactcagccatacaaggctacccatttggtgagaactaataataagttagatagcaaggtaatagcaaaatgtgggtgcaaaattaaagcaagttatttctgaggagaatgtaggtctcatggaagattttcatgtggacaaatttagtaaattttttgcaggtagtttcctgacatatttaacatttgtgatatagtaaacaataagaaggtactaaaggctgggcgcggtggctcacgcctgtaatcccagcactttgggaggccgaggtgggcggatcacaaggtcaggagatcaagaccatcctggctaacacggtgaaaccccgtctctactaaaaatataaaaagttagctgggcgtggtggcgggtgcctgtagtcccagctactcgggaggctgaggcaggagaatggcgtgaacccgggaggcggaacttgcagtgagccaagatcaagccactgcactccagcctgggcaacagagcgagactccatctcaaaaataataataataataataaggtactaatatgatccagactagaagagaatagcactaaaatgggagatggggtaaacctgtggttttttttaccttaggcttttgacttccaaaattattgtttttgctgggtgcggtgggtcactcctgtaatcccagcactttgggaggccaaggtgggaggattgcttgagcctaggagtttgagaccattctaggcaacaaagcaagaacctgtctctaaaaaaatttaaaaattagccagaaatggtggcacatgtctgtagtcccagctacttgggaggctgaggcaagaggattgcttgagccttttgaagttgaggcttcagtgagccatgatcaccccactgcactccagcttgggcaacagagcaagaccccatctcaaaaaataaaacaaaatagactgggcacgatggctcacgcctgtaatcccaccactttgggaggctgaggtggatggatcatgaggtaaagagatcgagaccatcctggccaacatggtgaaaccccgtttctactaaaaatataaaacttagctgggcgtggtggtgcacacctgtagtctcagctactcgggaggctgaggcaggagaatcgcttgaacccgggaggtggaggttgcagtgagccaagattgtgccactgcactccagcctggcgacagagtgagactctgtctctaaataaataaataaataaaacaaaataagtaaaataaaataaatgtttgtagttccaaaatattttgatgacataatttcttcttgttctaataaaactacatatgcattggtcctatgacctagtaatcacactattaggaatttatcataaatacacacctcaaaaattacaaaaatacatatataccagcttatttattacagcgttatttgtaattgcaaaaacattgtagatagaatggaggtcacataaaacttattcttaagattcagaccgggtgcaatggctcacgcctgtaatctcggcactttgggaagccgaggcaggcagaccacccgaggtcaggagtttgagaccagcctggccagcatggtgaaaccccatctgtaccaaaaatacaaaaattagctggtcgtcgtggcacgcctgtaatcccagctactcgggatgctgaggcgcgagaactgtttgaaccccggaggcagagactgtagtgatctgagatcatgccactacattccagtctgagcaacagagcaagacttcgtctcaaaaaaaaagatcatagatcatcttatcaaatcaaagtatgcaaaatattcaagtaaacttcagataaatatgaaggctaaaccattcagcttcttcaccaaacccttgaatgtcccacctgtctaaatggagatacatgtttgtttgatttattggttaactgtttttattccatttttcctcaaatgatcccataatttgaccttaggaagctgttcaaatagacacattaggttgaatggaaagactactcgatgatatttaggattttaagaggattttatgtattttttccttgtgtgcaataatttaatagcatcttgaataggattttctgatattactaaccctctgggaataatattaggtaattagacagttagctaatattaaaatatgtatcaggtaatatttattgagagtttcctctgtgccaagcaggatcaacttcataggcaggcgacctgtgcggggacacagggcttcatgcttagataggcccccttgctttgaaggcccctaccctttggttagggctctgctgttaccatcttgaaattcttaataatttttattttatttttttgagtcagggtcttgctctgtcgccctggctggagtgcagtggactcactacagtcttgaattcctgggctcaagcaatcctcccacttcagccttctgagtagttaggacgacaaacacacgccaccatgctcagataagttttttgtttgtttgtttttttgtttttgtttttgttttttgtagagatgggactgtccctatgttgctcaggctggtctcaaattcctggcctcaagtgatcctcccacctcagcctcccaaagtgctgggactacaggcatgagccactgtgcctggtcaatcatttttattaacaagcccaagccctcttttttttttttttttttttgagacagggtctccctctgttgtccaggctagagtgcagtggtgcgatcttaccttcactgcaacctctgcctcctgggttcaagtgattctcctggctcagcctccctagtagctggaattacaggcacccacccccatgcctggcaatttttttgtatttttagtagagatggggtttcaccatgttggcaaggctggtctcaaactcctgacctcaagtgatccacccaactcggcctcccaaagtgctgggattacaggtatgatccactgcgcccggcctccaagccccctatttttattttgcactgaccctacaagttacgtagctaggcttagttatgtttttagcaaggaaagtgtataatctcatgtaccttttgaaagattactcaggtctctgcatgtgaaatggaatttagggaatgcaagagagggagtaaaaataacagcgaggaagctatgatagcatttaaggttgctttgactcaggggtagcagtagatagggtaagtaattgatagtttcaaaatatattttgggagtagtaagcattggtatggattagtaatatactggatgtggggatgcagaaaaaaatattaaaaattacttctgaaattctggctggaatagaagtgccacttaccaggtaaggaaggttggagacataacatatttgagggtgtggtcaaaagatgagtttgacattatgctatgtcatataaaagacatataaaagactacctattttataattcctttttaataaaatattcagaaaaagcaaaactgtggttgcctgaggctgaagctaggaagattgactacagacaagcatgagggaaattttgggggtgatgagagttttctaaaactggattgtggggttggttgcattactgtataaatttattaaaaatccctgcatcgtataggggcactatattgtatgtagaaagctgtgaaaagattttaaaaatgattgacatgtctgtggttatatcaatgagtactattattattcccattttatacataaagaaaataaaagagaagttaaaaataaaagtttcatggttacatagctactaggtgtaatatccagtattggaatttgaatctttttgacactaagaccttactctcgatcatataatacattcactttctattttaaagttatattatagccgggcgcagtggctcacacctgtaatcccagcactttgggaagccgaggcaggcagatcacgaggttgggagatcgagaccatcctggctaacacggtgaaaccccgtctccactaaaaatagaaaaaattagccaggcgtggtggcacgcacctgtatcccagctactagggaggctgaggcaggagaatcgcttgaacccagaaggcagagcttgcagtgagacgagatcgtgccactgcactccagcctgggtgacagagtgagacaccatctcaagaaaaaaaaaattatattataaatgctgcatctcattggtcagaagctctcttgaaattataaaacaaagaagaaaaaagataaagactgggaaattgtgttgaatcagtatataaatcctgtatactggtccttccatttcccctagaaataagtgatacaggccaggcgctgtggctcacacctgtaatcccagcactttgggaggcggaggctggcagatcacctgaggttgggagttcaagatcagcctgaccaacatggagaaacccccgtctctactaaaaatagaaaattagctgggcatggtggcacatgcctgtattcccagctactcgggaggctgaggcaggagaattgcttgaacccaagaggaggaggttgtggtgagccaagattatgccattgcactccagcctggggaacaagagtgaaactcaaaaaaaaaaaaaaaaagaaagaaaaagaaaaagaaagaaggaaggaaggaaggaaagaaagaaagaagtgatacaacaagttacagcatctttgtttattatccactgtgagttgtattaccacactttacttggctctttggcaaactatattatctcttcagatcactagggctaggaaggcccactggtaacttgaaggagtaaatgtatcttctaaaaaatgcttacttccagggagattggatccacacaagtgaatacatatatagtccttagtgtatgctatgattattttactatgtcagtagcataaagattgctatattaataagcattaagtgcctgctgtgctagacagtgaggatgcaagtggccaccaaaatagcatggtccctgccctcctggagcttctttttttcttcttcagtgggggaagcagatactttgcttatgcaaaaataattataaaatttaaagttgtgccaagttcaatggaaaaaatataaggtgttctgagagagcataacaaaggatcctggttttaactggggcctaatggaagacctctattaggaaataacatttaaactaagaccagacagacctgtagaaattagcaaagcaaagggagggaggaaaaagcagctttcctggcaaaggaacaatttgtgtgaaggccctgagacagggaagggctggggttctgaccaccctccaagtggtgcaatggaatatagtgagagagggagaagacatgagaacttggatactatgcaaaggatttggtattttaattcaagagcagtatgatgctactgaggagcagctggacaattgtgtgatccaattaaaattttaggaagatgaacctcgctattgtggagaatgcatacacaagggttctgttggttcatgaagaggtcttaagaaaactatgagctgggtgcagtagctcaggcctgtagtcccatctacttagaagtctgaggcgggaggatcccttgagcccaaggagctggaagttacagtgagctatgattattccactgtactccagcctggatgacagagcgagatcctgcctcagaaacaaaaaccaaaaaacaaacaacaacaaaaacaacaacaacgaaaatctcagaaaactacaggccttattatcaagaaaatgacaggccttattattgagaaaactacttacatttttaaaagctgattttcaaaaaccagattgtgaattaagtgatgctgaataggggaaaaaaagactgataaaccagtgtatctctgaataacccactagatcagtgcttgtcaaactttaatgtgttttcaaatcaccctgatgttttgttaaaatgtaagtcatgtctcagtaggtctagaggagggcatttctgcatttctaacaagctccccggtgatgcctagaccattggtcctcacactttgagtagcaagtgattgggctatactctttattctaaattctaaatgtattctatcttctaatgcctatcagccctcttgctggtctggctaattatcaaacttgagcatttaaaactgggggttttcagagattaattgaagtgttaaagacatggaaatataggtcacatatggcttttcatctcttccggaaatatcctatatatccttacttcttttctacctacctaacctatgtgcctaccccttcacttatgttcaaggttctattatacttcaaaaggactctatgcaatcaaagtgatgtccaagacaaatatacagaaatagtatgaggctctaacactttacatctaatggagtggtttgcatcattaattgaggcttactctgtgccaggcactttacctgccttcttcatttaataggataggagcaggaactcttagaggttcatttcttgttcaaggatatacatctcatctctggcttatatcacagtggactcttttattcactatcctaatcattataattttgtttggtgacaacaattctaaatgcagaaaagttaaggctctttattctgtgactaaaggctttgtattttctaaagatttgtggagctttgctgccattatttcaataattttataaagatcctaggtggtaaataggcctggctttttttctttttgaaatcttctccgtcttcttcttcattagcagtgcaacttcttgtggcatatggtacccaagatcttgggaaaaggattgatcaagtaaagggaaacgatagagagagtgtgctctacaactgagatcatgctccttgtgaaagacagggtagggaaatttcttattgctccctggttcttaagaaatgagagctaacaatgacatccagttttaaaagaaataaaatctgaattgtacttttaaattttataagccagagttaaaccaatagattgtaactcctgctaatttgatagtagctccagataatgaggaagtgacagggaatgctaatttcatttggtaagagataaaactgaaattattaatgtctccacggaaatgctaaatgcctccttacaagtagggtccggctaattgtctgtcttccaacaagccagatttgttggtgtttttccagacaatgttgtgtagttttcggtttggttcgatcccctttcttgtgatcaaagaaagtgattcaaatgtttaatgagtcttgatttggattggagacttgcagaacggctagcctcacagccccaaggctggctttccctaaggtaggtttcctatgcaccgatactggcaaggcgctttggctggaaactctggaaggaagccaaaggaaagtgaagttcctggcgctagcgcgtgtcctgctcagagagcccggcgctagctcattcttcgtgcagttattggctgggactctgtgtgccgctgtcggccaatgaagacgctggagatcgggcccctgcccgtcccctttctgcgccccgggatgaggcagagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattgcaaagtgttggtggaggttgtggatgtgaatgacaacgccccggagatcacagtcacctccgtgtacagcccagtacccgaggatgcccctctggggactgtcatcgctttgctcagtgtgactgacctggatgctggcgagaacgggctggtgacctgcgaagttccaccgggtctccctttcagccttacttcttccctcaagaattacttcactttgaaaaccagtgcagacctggatcgggagactgtgccagaatacaacctcagcatcaccgcccgagacgccggaaccccttccctctcagcccttacaatagtgcgtgttcaagtgtccgacatcaatgacaaccctccacaatcttctcaatcttcctacgacgtttacattgaagaaaacaacctccccggggctccaatactaaacctaagtgtctgggaccccgacgccccgcagaatgctcggctttctttctttctcttggagcaaggagctgaaaccgggctagtgggtcgctatttcacaataaatcgtgacaatggcatagtgtcatccttagtgcccctagactatgaggatcggcgggaatttgaattaacagctcatatcagcgatgggggcaccccggtcctagccaccaacatcagcgtgaacatatttgtcactgatcgcaatgacaatgccccccaggtcctatatcctcggccaggtgggagctcggtggagatgctgcctcgaggtacctcagctggccacctagtgtcacgggtggtaggctgggacgcggatgcagggcacaatgcctggctctcctacagtctcttgggatcccctaaccagagcctttttgccatagggctgcacactggtcaaatcagtactgcccgtccagtccaagacacagattcacccaggcagactctcacggtcttgatcaaagacaatggggagccttcgctctccaccactgctaccctcactgtgtcagtaaccgaggactctcctgaagcccgagccgagttcccctctggctctgccccccgggagcagaaaaaaaatctcaccttttatctacttctttctctaatcctggtttctgtggggtttgtggtcacagtgttcggagtaatcatattcaaagtttacaagtggaagcagtctagagacctataccgagccccggtgagctcactgtaccgaacaccagggccctccttgcacgcggacgccgtgcggggaggcctgatgtcgccgcacctttaccatcaggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacaggtaaggtttagcaagtcatgcttgaccctgttagtgcttttttattcctacatcatattgaggaaggaatggagctgtttttttagtgatgaagatgttttcctggtgatgcattcacactttcaactggcccttcctagatcaaagttagtgcctttgtgagatggtggcctgccagagtgtggtttgtggtcccatttcagggggaagatacttgactcatctgtggacctaattcacatcctcagcactcttttgctatcacaactaaccaatcttgctaagggatggttaagctaaaacacaagatctcagcgatcagagtttagcttggtatcatttacattaggaataagctgctggatacctctaaccagtggcagcttctaggaatacaaaaactacctcattcctccacctttcaagtgattgtgacatttgtattaaaactaatagctttttgataattttcctttgtttatacagatcgtgtacctcattctcagataattttttatgaatgaaatgaaattccaggcatcctttaaattttatttcaagcattctactggaaatgatgtgcaccctgcttacaaaatatttttaccttataacagtaatgcatgtttgctagaaaattcagaaaatacagaaaagtatttaaaaaattaaaactataatctccaaacccaaagataaccatttttaattataaaagtaataatttatttcaaaaataaatctaggcaacccaagaaaacataaagtagccagactcagtggtgtgcacctgtagttcttgctgctcagtgcctgaggtgggaggattgcttgagcccaggagttctgggctgtggtgcactatgctgatcaattgatcaatccactgtctgcactaagttcagcatgaatacagtgacctcttgggagggcaggaccatcaggttgcctaaagaggggtgaactggcccaggttggaagtggagaaggtcaaaactgctgtgctatccagtagtgggatgacatctgtgaatagccactgcactccagcctaggcaatatagggaaaccatgtctctttaacaataacaacaacaacaacaacaatcccagaaactacaaaaggagagtctttttggtgcctccagtgttagtccctgtccttccagccttatttttcttaagtatatgcacaatgtgaaaggtagataaattcatatccttagacaggtaaagcattcattaattcagggtggtatgcaaggatactatccaaggcatggtatccatgcaaggtgactgcaaggcctttgccctggagagaaccctatacatactctcaactgtaggagaaacactgttattttgttactcagtgcatcattgctatcaactcttggatttggcagttagtcaaatgaggttctaccatttaccaactaggagtctgtggccaagttactcaatctcctttctaagcctcttcctcatatgcaaaaagggaataataagtgttttataagattcatgcatgatataatgtatgcaaagtgtttagcatggtgcctggcatatcataactgttaaacaattattagccagctcctagcattttgggaggctgaggcaggcggattgcttgaggccagcagttcaagaccagcctgagcgacatagtgagatcctgtctctacaaaaaaaaaaaaaaatgtgttttcattagctgggtgtgttggcatgcacctgtggtaccagctacttgggaggctgaagtgggagaattgcttgagcctgggaggttgaagctacagtcagctgtgattgcaccactacacttcaaccatggcaatagagtgagaccctgtctcaaaaaaaaaaattatcagctattactataattatttttattagttcctcactcacctaaaatctcaaacacaccttagaaatacacatatgagaacaaccaaaaatgacaaagtagaagcacatatgaaaaggctaagaaagcatgaaagccagcaagaaataactgccgctcttctggtcagcctggaaagcaactggcattttccctagaacaatgttttcaaacttggttgcacattaaaatcacctagagaccttttaaaaattctgaaacccaggccacaccccgacaaatgaaagcacagtctctgggggtgggacataggcatcattttttgaaggtccccacttgatcctaatgtgcagacaaatttgaaaaccacagctttgggaggctgaggtgggtggatcataagatcaggagtttgagaccagcctggccaatatggtgaaaccccgtctctactaaaaatgcaaacattagctgggcatggtggcgcatacctgtagtcccagctactctagaggctgaggcggaagcatcagtgagggagaatcagtgaacccaggatgtggaagtttcagtgagcccagatcacaccactgcactccagcctgggcgacagagcgagactccacctcaaaaacaaaaagaaagaaagaaaaaagaaaagcagtactctggaacctaccaatccatcatttagcatatttgtgaagtaaagtgttattctggtatttgcagaaccagaatccagctttattgggccaggcccaatttttttaaaaaacatggtaaggtctcccagccttaaagtattacatagcatagctctaaaagatcactgtaggaagacataaaatggtatttcagtcatctaagggaaaaaccttcctaaagcactagcccctggacaactattatttaaacatctacagctgttcaatagatattgggttctttttggagggatgtgacaaaattcttgtataattagattgtgatgatgattgtatcagtttagtacatgtaaatacactgaaaaccattggattatacactttaaatatgtgatttgcatggtatgtgaattatgtctcagtaaaaatctagagatggggctgggctcagtggctcacgcctgtaatcccagtacttagggaggctgaggccagcggatcacctgaggccaggagttcaagaccggcctggccaacatggtgaaacttcatctctactaataatacaaaaatcaggccgggcctggtggctcacgcctgtaatcccagcactttgggaggcggaggcgggcggatcacgaggtcaggagtccaagaccagcctggccaacatggtgaaaccccgtctctactaaaaatacaaaaattcaccaggcgtggtggctgaggcaggagaatcgcttgatggtggaggttgcagtgagccgagatcgcgccactgcactccagcctgggtgaaagagcgaaactccatctcaaaaaaaaaaaaaaaaaaaaaatcagccagatgtggtggcaggtgcctgtagtcacagctacttgggaggttgaagcaggagaatcgctttatctcaggaagcagaggttgcagtgagccaagatcatgctgttgcattccagcctgggcaacaagaacaaaactcactccatctcaaaaaaaaaaaaaaaatatctagagatgggagaatcatatggctggcataaaaaggtcaagtcaaagatatgtaagattaaggctttacgatgctccagttctagtaaaacagaccaggtacttgttttggtgtgaaattgccaatataagtatagtactgtacatattagttgtttagcttaggtaagtcttttaatctctttaaactccagtttcctcatctataaaataaagagaatatctactttgcaaacttgttgtgagagtgaaaagtaatgcatataaagtccctgtatggagcaagtactcaataactatttgttgaactaaaaatgataatactgatattcaccatttattagcatccctatgtgccagacactgtaaacaattaaaagttatcattctggtacccagagtacagtatgagacagacatgcaaaaaaaaaaaaaaaaaaagataatggagatctgcatagcataagatgcagtgggaccaaacgggaaaaaacacctaaatgagcctggagaaaggaagaaatgatagaggtggtgatgcttgagctatgatctaaaggttgagtagtagcttgtcagacagtaaaggggaaaggacagggcagggaggggccattgcaagaaattccatgcagagggattatggtatttcattatcactgaaccttaaactgtgtgtgtggccgggtacggtggctcatgcctgtaatcctagcactttgggaggccaaggtgggcagatcacttgaggtcaggagtttgaaaccagcctggccaacatggtgaaacctcatctctattaaaaatacaaaaaattagccaggtgtggttgtgggtgcctgtaattccagctacttgagcagctacttgagaggtcgaggcaggagaattgcttgaacccgggaggcagaggttgcaatgagctggtgtcaggccactgcactccagcatgggcaacagagagagactccatctcaaaaaaaaagtgtgcgtgtaaaacagacagtctttgtaggagatgaggtgaagcaagtaggcaggagttagatcctgagttacctttgggccaagccaaggagtttttattttattccatatagatgacagtcactgcagaaatttgaactgatatgcatatatcatgaggtttttttgttttagaaatattattctgtcagtcataagtgaagggactggggacattgggactggaggcaaagagatcttatctctttgcaatagtttgaaagctattgcaatatttgaagagaagattgataaatgcttgaaccagcacagtggcagtacagatggagggagctgactacaataaaatcatcaggacttgttgattgacatgatataggaagtgagggacagggatgagtcaaggctgatccccctagatcctgactaaggaagctgggtggttgacagtgccattcacagagacagtgaattctggcataaacacctaataggtcaggctggtttacacctccatcattcccatgggagaaggtatagaggggtgtgtgtttgtgtgtgtgtgtgtgtgtgtaaaagaacacagaaagccagattcctctttttgacaccagaatattggttcccaccatagtcaaaaggatattcctgaggatcgaggcttggaaaaatattggggaaggataagaactccagttgttgctgctttttttggcagccagtgtaacctaggtaaggacttggttgaattaagaaatttcatgtccagatcaggatggatttttctatttctctgagctctggtgtgtttcccactcagattgcaggtcgtaggtacctacggtgtgaattgtgttgtgtttctgtgcttgtgcaagggagtagctaggttgctgggaggtctggatgagggtgggggtggggtgagatcaagtctccagctccaagaggtcccctggggctaagtgaaaagcttgctcttttgaaatggtcttcgttggtaattaacaaaagatcaagaataccttggtgtcagataaagggaatttgtaggcacaatgctgttggtagctgatctcaatcattcaaggaagctattaaatctatgaacattagcattctgccaggtaaagagatctggtccttagcacctcccagacacactgattctttactgttttgaaacatctccctctcctggcttcctccaccccgcttccatactgtccttgaaatcaatgaatggtaatttagtgtatctagtgtatcactagcaaatgtctgaataagaaaggtttggtttccgctgtgtctcctgttacaatgagaacatgtactgcataaatttaattggctacgttaatgtgtaagccttttctgcaaagagatggatccgtttctgaatattctgcagaagggcagagttttgagtatatggcagtggttctaattagcagttgctccaatacaatcagactgagacggaagctactcatttagaatactggttgatgacaacactggcttgaacaaagtgaccactctccaatggctactctccctctcagtgggccgcaggttgctagggctcaggctgtggctgttttccccgccgaaaaggggcggggtcagtcggtgtgttaggaaaaaaaatgtatatatatatatatgttgtctgcctccccacagagataacaacccgtggaaaaacatgccgttgagcgggaggaaggcgaaaagataggctgggttttttggggggtgggggagcgtggaggatagggtgggctttttcccctccaatgctgcgacgcattaaccctgctgctgttgggacgttctctgctcagcctattggctgagcccgggagccgctgtctgccaatcgggtggtgaaaggcagacaaatctaccccgccaccagcaaaaacggcgcgtaacccttgcggcgccggccgaaccgcgccagagctggcgcggggaaagggagataggtgtctccagctgctgtggctgtttggggcgggtcggcttcatccgcgtctcaggagcaagtagagaattagcgggcggcagcaatgctccgcaaggtgagaagctggacagaaatctggcggtgggctacccttttgttcctcttttaccacctgggttacgtttgtgggcagatccgctacccggtcccagaggagtcacaggaagggacttttgtagggaatgtcgctcaagatttcctgctggatacggacagtctgtcagctcgcaggctgcaggtcgctggagaggtgaaccaaagacacttccgtgtggatttggacagcggagccctgctcatcaagaacccaatcgaccgagaggcactgtgtgggctcagtgccagctgcatcgtgcccctggagtttgtcaccgaaggtcctttggaaatgtaccgagcagaggtagagatcgtagatgtgaatgatcacgccccccgttttccgcggcagcagctggacttggaaattggggaggcagctcctccaggacagcgtttcccgttggaaaaggctcaggatgcagatgtggggagcaattcgattagcagctataggctgagctccaatgaacactttgcactggatgtgaagaagcgcagcgacggcagcctggtcccagagctgctcctggagaagcctttggatcgagagaagcaatcggactaccgcctggtgctgactgctgtcgatggagggaacccgccgagatctggcaccgcagagctccgggtatccgtgctggacgtaaacgacaacgccccagccttccagcaatccagctacaggattagtgtgttggagagcgcaccagcgggcatggtgctcatccagctcaatgcctcagacccggacctgggtcccagtggtaacgtcaccttttatttcagtggtcatacccctgatcgtgtaagaaacctctttagcctgcaccccactactggaaagcttactcttttggggcccctagactttgagagtgagaattactatgaatttgatgtgcgggctcgcgatgggggttctccagccatggagcaacattgcagccttcgagtggatctgctggacgtaaatgacaatgccccttacatcacagtgacctcagagcttggaaccctccccgagagtgcagaacctggcactgtggtggcacttatcagtgtgcaggatccagactcagggtcaaacggagatgtgagcctccgcattcctgaccacttgccatttgccctcaagtctgccttcaggaaccagttctccctggtgactgctggacccttggatcgagaggccaaatctagctatgacatcatggtcactgcttctgatgctgggaaccctcctctcagtacccacagaactattttcctcaatatttcagatgtgaatgataatccaccctctttctttcagaggtcacatgaggtgtttgttcctgagaacaatcgcccaggggacctgctttgctcccttgcagcctctgacccagactctggcttgaatgcgcttatctcctactcactcctggagcccaggaatcgagatgtatcagcttcctctttcatctctctgaacccccagacaggagctgttcatgctactcgatcctttgactatgagcaaacccagacactgcagtttgaggtgcaggcccgggatcggggcaacccaccccttagcagcactgtaacagttcgtctatttgtgctggacctcaatgacaatgctccagctgtgctccgtcctcgggcccggcctggttccttatgtccccaagcactgcctccatcagttggtgctggccacctaatcacaaaggtgactgctgtggacttggattcaggttacaatgcttgggtttcctatcagctcctggaggccccagatcccagcctgtttgcagtctctcgatatgctggggaggtgcggacggctgttcctatcccagctgacctcccaccacagaagctggtcattgtggtaaaggatagtggtagtccaccactctctacctctgttactctcttagtgtccttagaggaagacactcatccagttgtcccagatcttcgagaatcttcagctccaagggaaggagaatctcgtctaaccctctacttggctgtgtccctagtggcaatttgctttgtctcctttggctcattcgtggcactactctctaagtgtcttcgtggggcagcctgtggagtcacatgctttcctgctggcacctgtgcctgtctcaccagatctcgaaggagggaggggcttcccccttccaatgggatcctccgaatccagctagggtcagatgaccctatcaagtttgttgatgtgggaggccactctcatggctgtacacccttggcttctgcacccactcggagtgatagcttcatgatggtgaagtcacccagtgcacctatggcaggggagcctgttcgcccaagctgcccaccctctgatcttctctatgggctagaggtgagacctttgcaggctcaacaaatgcttgagggttattctgatccaggcatatggctaggccatgtcctagagagtactggcctctcagtaagtgcccatagtgatgtcaccatttttgtaagaggtaactatgtggtagacgctgtgctttgtaactgtttcgtgaattaaccagagttgtcacagtttagcattgggggcgggtcatgcctatatctgagtaagaaatgaaagtaattggtgatcaagagccaggctgttgtggaagcatgatgatggaatgtgggagcacaggaggctacagtgcacagggtacagtgcaccaggcagtcacttggacaaaggtggctgttttctctactcttcctgaaagaggggatcagattctgaagtaccttaactctaggttaccatttcccaagggattgaggggaaataaaatctttgtctcccagtatctagtacactgtgaagggacctctctatttgaaacatagagacagcagaaagaggagagaactaaaggaatagagaggcacgcatcagagtggtggcatagatcttttggtctgggtcttaggactcatatcaagtccctactggggatttgaactagatgcggtaaattggaaggttggggcgggttggtcatcacctttggaaaaaacagtaagtgaaatcacttatgtcagaaaactggtttacagttggctgattcatagaaacagccaccctgtgcatctttaagttgagttctcctgaatttggtgaaaccatgaaacctagaagccaagccatccatgcttggcctctgaccaccctcctgggtgacctgattcagccccagaaatgttcccctacccaaaaactgtaacactcattccacatttggggtctggggtgtcagaaaagctaagtcccatgtcagctgacattgagatttccgcaaagcattgctggagagtcagggcaagactttacaaggttcttactaatcttttctctcaccttagcagcattcagcaggatgggggagggtgggggaatacatgggctttgcctctcccagaaggacaagattttgctggttcaagcaaagtggtggaagcttctgaagtcatgcaggaagttgctgggacagaacgctgaggagttttgtatcactttgtcttccctgttgagtaccatctgagctgtcaaactttgctgccaagggggctgaatcaacctgcagcacgaagtgagtggggaggtaggaagcttctgtgacacagatttgcagcctgtgttcccaaggtttccaggattgaggaaactccataattggttgagagcacacagactttttggccaatcagactcagagctgaggtgggagatctgctcttccagcccgcctctcctcctccagctccccagctccactcaaattcagctcccctcccccctgcccacccccgccactcggtgactaagaactgctgcaagcaggcaaacctccgagcagtttttaagaggctggaaggagacataagagacttcagctgctgcattccaagccctgggtctaccttggagacaggacagcacagacttactctccacaaagggacttctgggtcatggggcccaagacactcccacagctcgctgggaaatggcaagtgctgtgcatgttgtccttgtgctgctggggctgggtgtctgggcagcttcgttactcagtggtggaggagtctgagccggggacgctggtggggaatgttgctcaggatctgggcttaaagatgacagatctgttgagccggcggctgcaattgggctctgaggagaatgggcgctatttttccctgagcttgatgagtggtgccctggcagtgaatcaaaagattgaccgagaaagcctatgtggagccagcaccagctgcctgctgccagtgcaggtggtgactgaacaccccctggagctaatccgtgtagaggtagagatcctggatctcaatgacaactctcctagctttgccacccctgagcgagagatgcgcatctcagaatcagcagcatctggggcacgattcccactggacagtgcccaggatccggatgtgggcaccaatactgtgagcttttacactctaagccccaacagccacttctctctgaatgtgaagaccctaaaagatgggaagccattcccagagctggtgctagagcagcagctggatcgtgaagcccaggcaagacatcagctggtgcttactgctgtggatggggggaccccagcccgctcagggaccacccttatctctgtcatcgtgctggacatcaatgataatgctccaaccttccaatcctcagttctacgtgtgggaatcccagagaatgcacccattggtactctgctgctccgcctcaatgccactgatccagacgagggcaccaacggccaactagactattcttttggagaccacacatctgaggcagtgcggaacctctttggcctagaccctagcagtggggcaatccatgtgttgggtcccatagactttgaggagtcacgtttctatgaaattcatgcaagagcccgtgaccagggacagcctgccatggagggccactgtgtgattcaagtggatgtgggggatgtcaatgacaatgccccagaggtgctattggcctctttggccaaccctgtcctagagagcacaccagtgggcacagtagtggggttgtttaatgtgcgagaccgggactcaggtagaaatggtgaagtgagccttgatatctctccggacctgccatttcagattaagccttctgagaaccactactcgctgctaaccagccagcctttggaccgggaggccacatcccactatatcatcgagctgctggccagcgatgctggttcaccttccctacacaaacatctcaccatcaggctcaacatttcagatgtcaatgacaatgcaccccgcttcaaccagcagctttacactgcttacatcctagaaaaccggcctccgggctcccttctttgcactgtggctgcctcagatccagacactggggataatgcccgcctcacctactccattgtaggaaatcaggttcagggagccccagcctcctcctttgtgtatgtcaacccagaggatggacggatctttgcccagcgtacctttgactatgaattgctgcagatgctgcagattgtggtgggggttcgagactccggctctcccccattgcatgccaacacatctctgcatgtgtttgtcctagacgagaatgataatgccccagctgtgctgcacccacggccagactgggaacactcagccccccagcgtctccctcgctctgctcctcctggctccttggtcaccaaggtgacagccgtggatgctgatgcaggccacaatgcgtggctctcctactcactgttgccacagtccacagccccaggactgttcctcgtgtctacacacactggtgaggtgcgcacagcccgggccttactggaggatgactctgacacccagcaggtggtggtcctggtgagggacaatggtgacccttcactctcctccacagccacagtgctgctggttctggaggatgaggaccctgaggaaatgcccaaatccagtgacttcctcatacaccctcctgagcgttcagaccttaccctttacctcattgtggctctagcgaccgtcagtctcttatccctagtcaccttcacctttctgtcagctaagtgccttcagggaaacgcagacggggacgggggtggagggcagtgctgcaggcgccaggactcaccctccccggacttctataagcagtccagccccaacctgcaggtgagctcggacggcacgctcaagtacatggaggtgacgctgcggcccacagactcgcagagccactgctacaggacgtgcttttcaccggcctcggacggcagtgacttcacttttctaagacccctcagcgttcagcagcccacagctctggcgctggagcctgacgccatccggtcccgctctaatacgctgcgggagcggagccaggtgaggggctcggcgccgccccgggcgacccctgggggcggcactggagaagccgcccgtcctcataagggattgaacttgcatccactcctctccggccggcttggtcgctggctgcgctccacccgattctcgggatcattggaccgtttgcgcgaaaccagagtggccgattaagggatggggctccgagcaccgggggtggtggcgactgtgggcgaggggaggtgggaccgacccccacccctacactcaaaaaaggccggggcctccttcgagcttccggtgaatttcgggcgatttccgcgggtgtcgggggtcccgggaggaggcagtcacagatccacccctgcagccagcctcctaggcgccggctccggcacgcttcgccggtctgtagatttcctcttcgatttctccccagctcccagcatctgtgacttcactgttaccctccctatccccgcatcacccaaccgcacctgtctgcgggacttaggtgtgcgcgcggggctcatgcgtgtcctccctgctggccacccccacggcccacacaagttgcacgggctcgccacgccccgccaacacgtgcgcggacgcacgcacgcactcctcgcacgtgggcttacgcgaataccagctttcactgccactcgctcgcggccagattcacaggcctgttccggtccactcgcagctcccctctgccgctccctccgccgggctcaggagtactcgtagctgattgtgcgcgcctgagggtcccagatcgcggccgcccaggaccaggcgaggactccggagcctcctctcacctctcccacctgcgccccgggctgggccgggtcgcctggggggcggcctgagcgaggcgcggggccaggagcgctggagcgactgccgctctaagtgccgggcgggcaggactctacgatccttgggccagaggtccggatggtcccgggactccgtctcaagggtcggcgacccctcaacccagaagcctcgagcaggcggacaggcagagctgcccagtggccgaggcgcggcagggctccgcgttgggcgagtgagtgagcctctataggacagcaggactgggactccagtggcaccagcggccccttcctcccgcaggaagtgaaagcctcgagcgccctggctctcaacccccagagatacaggcttttggcgccgtcgtgatcacaatgtgcccagcgatctagggtcagagatttggaggtgaccaaactatctgacactctaacaagtcctgtctcctctggcagatggaaagctataggctctgccagatgccagggtgcccttatgtgtgaggaaactacaatagtaaaaaacacaagtttctccaactccaggagcttttattcaaaatatatcaatgcctaactctgctcctaggactgtattttgaaacacccccaggtgattttgatagctgattgagagaaacttactatataactcctttgagaacctcatctcatttgctcttcccaccattgctgttggctaggtactaacatgcctctcttataacagcttcacagaggtcaagtgacttgctcaagttcacagagcaagtaagagagattctaacccctgtctaactccagaatgtgtgcttttaatttcttggcacttggaactttaaaagcttgaggacaggagaggggagttgcctctgctgggattttgcttctgctgggatggggcaagggtggggttccttcccttttaggaccttacatgtggggaaagtcttctgtggctcctcatttctgagcagtccccgcagcgcaaacttggccagttatccttttggagattgagttcccccagctccgtttcctcctatcacaatcactgcatttccatgtagattctgctgtgtctaagaatacagtggctgagggctggccatccctgtgcccttctccatggcagccccagaatggtgctggtgactcccgatacacctggaatgctaggtttctgggttctgctcatatcactgccacctgtgagccttgagtgagccactggcagttccggagcttccttctccctggagtaatctgagatactcacactctctgcttctgggagcaagtatgagtattaattaccagcccaccccagaaccagtgaggaggtggctctaggagtgctccatgagagtgtgtgatgggataacacaccccctggaaagaccagaagggactcaggaatgaagtggctggccagagccccacaccttcagctaggtgggagatggctacacatcagccccttgggagccctggagacttagttggccctgcttggaggctgtgggagctggatccctccccgctgcatcccttccatttttctccgtctcagacagagcagccttgttctcttctccttagtcacagaccattgtctggcacggagttctaggggtgagaagtgtcccgggacttggatgccccgcaaaggcccaatctggcatgactcctaaattaataatgtatttagctgtgggaagagattcttgcaagccaagggcccagagaagatgtccctgtgaatgtgtcactgcacaacctggcaccaaaagggttaccaagaacagcagccatcttgctgcagaggatgctttgttcccagctgaggagttgaataaattcattctagggctggtagaattctcattgaaaagcctcctttgccactttagggggctttgtctgcacctcttcccccagttccacagaagatgccttcagtccttgaattttggctcaggagttctgactctgggggcagggaggaaggggccatttctttaggaaaggagtctcagcttgctcactgtggtcagatgaaatgtgatttatctcttggtttctggtacctcagacctctgagacctgaggtgtattttgtctttggagatgagtccacccctgccccctcttagtccgttttcttctctgtgcccactcccctccttctctcccggcccatccctaggggctcgggtgacattctaacttctcacgggtactcagcccctttccctctgttttctccacagcaagccccgcccaacacggactggcgtttctctcaggcccagagacccggcaccagcgggtaggtgactgattctccagcccaccctcttctctgcggcattttctcagggatgacgtgggaggagatgggggagggcccagcatttgctacagatggcttctccctcagtttgagatcccagggaggtcttggtgtgcggggggctggcacacagaccccggaaggaagaggcgactgccctgactgttcaggaagctcaattcacatgcttgccccttccctcctcgccacgaccggcaccttttcctatcccctgagggcactgtggaaccaaaggatggtcttaagctggtctctgggtgaaagcgaggctttctatgcccatgtactgcctaaccccctcccctgagttgagctgggctccattatgacctggggctcaggcagaaaagcatttgaccggaggaggcggtccgcactcagcgcctcctccagagcctccagagccgaggctgactgcagcctggggagagtggaggcagcacagctggaggtggaactgaggaaggactgggcggggcatggagcaggcccccttctccggcccctcctcccactgtcctctgcccctacttgtcctgctctctgtctgtggggtctccgtgtctctgcccctttttcttgagtttccgtctttgccactttctcttacctctcagtccttccctcagtctctatctcgctttgcaatctctgcctctccctctcttctccatctctgtcttagcttccgtcttgattgctgcacctcagcctcagtccctttcatttgtctacttgcattgatctgtgccgcccactgtgcctgccatggcataagtgctcaataaatgtggagtgagtaactacacgggacccttagtctctttctccttctctatctctgcctccctgtccttgtcctggacctcttttctgtttctcctttcaccgtttcctagcgccttgtgttcttctatccccagcctctatgtttctctgtctctcactatttctgctttcctctctgttctttgtctctctttgtctctgtctctgtatatctttctttgtctctgtctctggtctctgtgcctgttgtctttttctgcctctttctctgttactctttctttatctctctttttcttttatcttgtcttttttctctgagcctctgtctctgtctctcatttttttgtgcttgtgggcaagccagcacacacaaccccccacccaccacccaccaacaccccgctctcttccttccctgcccctcacacactgagcctttgatcgcagctctccaccagacaccctcccatccaagcagccccagctgctcatttcaatctggtatgaattcctgctgagacaggaaccccctgcgggctgaaggggagggaaacttcagcagaaagaccttcagttggtctgagcagagtgggataggctctgcgccaggcctcccagttagaagtcaggagcctggaggagtctcagagcccagggagagaagcaggagcttgggccaccttaccctacctcctcaatggttgagtacttgctgtccacatttgccaagttgctacagatgctgagcttccaagagttatctttcccccatcctgcaaccaaccaaacccttgttgccacaaggacccaggagcccttggtgtatggcagagattccagcttctgggcatgcacagtcctgtcacccattttaggaacgcaaagcgcttcttagaaggcccctaaaaagcagcagatcaaaaggcttgggctgcccttgcccttcctttgaccccagctgttgtccttctccctgctggccttgccaaccttctcataagttatccattaagtcattaatgtattcattcgttcatttattcaacaaatatttatcgagcatctactatgagcagggccctgtgctaaacattgggctataggagtgaacaagtagatgtgatcccagaactcataggcttccagaccagcagaggagactgaaaatttgcaacaagtaacacttaaaaaaaaaaaaaaaggctgggcactgtggttcacgcctgtaatcccagcactttgggaggccaaggtgggtagatcacttgaggtcaggggtttgagaccagcctggcagccaacatggtgaaaccccatctcgattaaaaatacaaaaattagccaggcgtggtggcaggcacctgtaatcccagcgacttaggaggctgaggcagaactgcttgaacccggaaggcagaggttgcagtgagctgagatcacgaaaaaaaaataatctagccacaaatcacagtaagttctgagaggcagagaacaatgtgagtgtaatgggggggggaagatcagagaaggcttctaggaggaggtgacattgagaagttctaggccatttatgttccctctacctaccaccaccccaggccatacactggctttgaagcagaattcaccattgaacctggaagccccaccaactgcctctcatgtgtcctctggggtgagcaccttacccctgcctcaactcccattccatcaaatgagaggcttagtggcctggaatacatgtgggagctcttggagatatggaggagaaggtgcggaacctctctctctctcctctctctgcttccttagttaacttgtggaggatgcaacaaaccttttttttttttttttttagacagagtcttgctctgttgcccaagctggagtgcagtggtgcgatcttggctcactgcaacctctgcctgccaggttcaagcgattctcctgcctcagcctcccgagtagctgggacagcaggtgtgcaccaccacacccagctcatttttgtatttttagtagagatgggtttcgccacgttggccaggctggtttcaaactccccgacctcaactgatccacctgcttcagcttcccaaagtgctagaattacaggtgtgatcgcccccggccacaacaaacatttttgattcagcggctccaaagtgaaataagcgttaggatctagtccagtaacttcaacttctctccttcattcattcaacaaatggtcagtgagcactttctgttggccaggcagtgttctcgatgtgggaggcccctgccctcaaggagtttacagtgcactgaaggagacaaatattgaccaaataattacaaaaataaatgtgagactgaaactgtcataagtgctaggtagaattgtatctggtggtgtgggcgtataatagggatttgatttagggagcaggaggacatcctggaaatgaagttgtgctgagatctgaaagacaaatacaaattaaccagctaaagaaaagaaggaagagcattccagatggtcaggcataccagcttcaaagcagggctggtgttgagttcttcagtaaacttggttcaagatcaagccagctctgggtcacactgcctacacagaaggaagagcattccaaatgggaaaagcctatgcaaaagccttgtggtgaggcctcctgggatcaagggaatggcagggagttttctctttgctggcactggagtgaggggatgaagaggagaggttccttttatccagtctaaccctggttccagccttctgttgatgccctgcctcactccctccccaccatcttgcccactgccctccagcctggtctggtcagacacaccagcttcaaagcagggctagtattgagttcttcagtaaacttggttcaagttcaagtcagcactgggtcacactgcctagacagaaggaagaagacctggccaggtgtggtggctcacgcctgtaatcccagcactttgggaggctgaggtgggtggatcacctgaggtcaggagtttgagaccagcctggccaacatgatgaaaccccatctctagtaaaaatacaaaatattagccaggtgtggtggtgcacacctgtagtcccagctactcaggaggctgaggcaggggaatcgcttgaacccaggaggcggaggttgcagtgagctgagatcacaccactgcactccagtctgggtgacagagcgagactccatcaggaaagaaagaaagaaaaagagagagagggagggagggagggaaggaaggaaggaaggaaggaaggaaggaaggaaggaaggaaggaaggaagaaaagaaagaaaaagggagaaaaaatgaagaagacttacattctgaagttcctgcttggcacatgcttctcctccccaccactatcccttctcaggtcatcctttgggtgtctgatcccaatagctgttgtctcaagctctgagcccagcaaaccatttcccccttcttaggctgtaacccaggccctgccctgcagctgtccccagcctctgcacaaagagtctccatttggtccctagactgttctctgatggctccacactaccatccctcctctgagagacagtatccctgctctctctcagtttgggcagtcattcaacaaacaaatagcaacttaatttttttccacttataaaatagtacatgctcattatagaaacatgaaaaatagaaaaaaaattaaaaggaaaaccacccatcattttacaatctagggagaaccaccaccaactacagtttaatatgaaacatttcaaatatgtacaaaagtagagagaatggtgtcatgaacctgtatgataccactatccagcttcaactaatgccttatcttgtttcacctatatccctacccttatcctgtccttggattcttttgaagcaaatctcagacatcatataatttcatcttggtctccaccatctttaacagatgacttttttttttttttttttttttggagacagagtctcactctcttgcccaggctgtggcacaatctcagctcactgcagccttcgcctcccgggttcaagcaattctcatgcttcagcctcctaagtagctaggattacaggtgtgcaccaccacacacagctaatattttgtattttcagtacaaacagggtttcgccatgttggccaggctggtcttgaactcctggcctcaagtgatccaccctcctcggcctcccaaaatgttgggattacaggtgtgagccaccttgcccggccagatgattctttcataaggtccacattttatatttgagtgagtgtctcttaagtatcttaatgctcttttaatgtaaaagacttcccctccatcttccatttttgcaatttatttgttgaatccctgccttttcatatatatctttctaaacttttctttgtgtaatcaaagaacatgcatgagcttcatttttatttttatttatttatttatttatttatttatttatttatttattgatacgtagccttgctctgtcacccaggctggactgcagtggcgcaatctcggctcactgcaagctccgcctcccaggttcacgccatgctcctgcctcagcctccagaatagctgggactacaggcgcccactaccacgcccggctaattattttgtatttttagtagagacggggtttcaccgtgttagccaggatggtctcgatctcctgacctcgtgatccgcccgcctcggcctcccaaagtgctgggattacaggcgtgagccaccgcgcctggccgagcttcattttaaaaaaatctcattcacctaaataagttgttcacaaacttgtcacactttcatgtgacactttattcacatattaagaactgttattcccagtcatacggtacatttcctactagttttttaaaaatagcaactgaggccatactgtccaacagaattatagcttttttcttctttgcagtgtatcatgagaatttccccatgtctttcaaaattcttcccaagtcatttgcagagtaactcctcttatgaatatacatattattttacagaataagtcctcatatgaatatacatattatttttctaatgctaatgggcttttgctacattagaaaacatacacattcatttacaattttttttttttgagacagtctcgctctgtctccaggctggggtgcagtggcgccatctcggctcactgcaagctccacctcctgggttcaagcaattctcctgcctcagcctcctgagtagctgggactacaggcacgcgccaccacgcccagctaatttttgtatttttagtagagacggggtttcaccatgttgaccaggatggtctcaatctcttgacctcgtgatccgcctgcctcagcctccctaagtgctgggattacaggtgggagccaccatccccagcctcatttacattttaacacaattaaattcagggtgttgtcagggtgacttcctagatttctcagttttttgagcatgatgtagggagtattttattatagtccagtctatgggatattcccttatacacacacacacacacacacacacacacacacacacacacaccccaaactcaatagggcaagaaccatattcatcatctcttaaatcctaggtcctgtcacaggccactgcttggaaaatagttgactaaatgtagtccatttcttccatttttacttttcactattccccaaatcctggaagagtccctcatatctgctgctggggctccaaggcctccaagctgaagcccagtacgttgttgtgcataagatcataggccctggaatcatattaggctggctttcaggttgcaactctaccagttccagctgtgtgactctggtatagtctctcaacctctctgagccctgttttcatctgttggaaaatatagataatcacaacacttatctgcagggtgattccgaggataaaaaagacaaatatattacccagtcagcttagaataggaagctctcagtaaatggttaaaaaagaggtctctctccctctgctcatctcttacccagcttcacataattggcagcccacccacctgtttggccctcaaccttcaaccatttcccaggacgcctccttacactcctgatcatcatggttccaaccccactgttccactcagctttgttccctcaacaccactgctccctgtgacaggtcatcctcctaacctctggcatctggtcccgttgtctccctgacaacccgcatgctctcctccctgcaacccccgccgcttgcctgctctccctactttattcccattagcccccttcacctggggctgagaacacctggccttgaccctgcaccctcagccaggcccacagagctcagtcgggccggaagtaaggaccccagatattcagttgaggaatttaacattaatacaataatatagaatccaccagcagattttcataaatgttctgtgtgttcttttatccttttttttaatccaggattttatcaaggagcatagattgcatttggttgtcacgtctttcctctcctttaatctggagccagctcccagtctttttatttttttaatgacatggatatttttaaagagtccaggccagttgtactttaaaatgtccccgaacctggatttgctggctattctctgatggttagattcagattacacaccttggtaggaatacttcccgcagcatcacactgggactcatctaacgtcggcctgtcccactatcagtgatgccgagtttgttcgtgtggtaaaaacagtgtcccagatctctccattataaaaatatatttttataaagatattttaaaatatttgtgaaaatataagtaatctgtggatgatactttgagataggcagcaacccttcatgcaattttagtattccctgatgatccttgcctgtatctgtttttacatcagtgattacaaagcggtgatgttctgtcattccttctacatgtatttgctggtattcttctgaaaattacctggatgatttcttcagatttaaattcactgtcttttccttggggaagcctggactggctgagctgcctaaccctgactctctgtcttttttttttttttgacagggagtctagctctgttgccaggctggagtgcagtggcaaccttcacctcctgggttcaagcgattctcctgcctcagcctcccaagtagctgggattacaggcgtgtgccaccatgcccggttaattttttttttttaatatctattttagttgagacagggtttcaccatgttggtcagaatggtctcgatctcctgacctcgtggtctgcccgcccctgcctctcttcataccctctggtagcccctgacacagcccatggcaagtatcacaattgcaattactctattgtgtaattatttaaaatcagcctctcagtgcccaccatgagcaccgtaaagatggacagtttctatcatactcacagccacaaccccagcacctggctctgtgtctggtacatagaaattgctcaagaaagaattgttggaggggcgcggtggctcacgcctgtaattccagcactttgggaagcggaggcaggtggatcatgaggtcaggagttcgaaaccaacctggccaatatggtgaaaccccatctctactaaaaatacaaaaattcgctgggcatggtggcatgtgtgcacttgtcgtcccagctgctcaagaggctgaggcaggagaatcacttgaacctgggaggcagaggttgcagtgagccgagatcgcgccactgtactccagcctgggtgacagagcgagactccagctcaaaaaaaaaaaaaaaagaaaaaagaaaagaaataattattgaatcaatggaaacagaattacaactcttcccacttttgggaaggagaattgagattcctgctttccccttcaaccctagctttatgtttgttgtgatggtatagaggtcacacatggcagccttgtgtctgttcttaggctgagttcatctacttagggacggggaatcccagattgggcaaaaccaaaagcagggacagaccttggaaaaattgtaaagcagttcttggttgtgctcacccaccatgacaaaatatgcacacacacaacgcaacacacacacagacattttcatgccttcaaggcctaccctacagcctttcccatggtgccaaacccttcttcttaccttacagtcacttaactgtctctgctggtctcttcccactcatttaggcaacaaatatttattgaaaaacttctctgagccagatggtgccaaacagttacctaaagggcagactgtgtgtgtgccagggctgtttcccgccaacactcccctgcaaattgaaataatttcatccttggaaattcaaaaaaatcatgaaaattgtcactgtgggaaaattccaagtagagctgaaccttctaagaagcagagagttcttcttatggtttagtatttttttaaattatgaatcatttcatgttttttcaacactcggagtttctaaaagtctcacttaggtccaagtgctaggctttgtgctaggtgcttcagtaggaagcaggtggagtcgctgcctcacagaagccagtgtggtggaggaacagacaggcactacaacagctgcagtgtgactagtgccatgtggggcagccgctgggatgggagtacagtggaggcacctgcccagtctgagtggatctcctctgatatattttattcgtgtcatcatggcaaatgttgggggactggcattctagggaacaccatctgcccaggattcacagcaagagggaacttgagggataggaaagtgcaccttggaaaaggtttgatgatagagtgtttgagggcggggggtgggggttcttgtaaaataggaggggcaggttcttctatggccgtggattttactctgagggcttaggaagccattgaattttagaaatttcttctccctgctccagggtctcttggggcctcctacatctccccctaggtacctcctaggtccccactttttctctagctctggaacattctcttccatttcccaccttcacagtcctctggagaaggtctgatctccctcactatgacaggaagccaggctctctcatggtgggtgggggaatgcactatgttcaatgcattggaccagcctggccaacatggtgaaaccccgtctgtactaaaaatacaaaaattagcctggcacagtggcaggtgcctgtcatcccagctacttgggagactgaggcaggagaatcgcttgaacccaggaggtggatgttgcaatgagccaagatcgcgccactgcactccagcctggatgacagagtaagaccctgtctaaaacaaaaagaaaaaagcatcggaggcagcaaagagctggtttgagggactgacttgtgggattctggcttctgaaggattgtagaagtgcctcctaccttgctgagagaaacaggtcttgggcatggggtagggttagggtactaggtttgggagccctgggagaggacaggaggggcatgagctgtgccggcctgggagtctgtgctcaccatcctactctctccccagctcccaaaatggcgatgacaccggcacctggcccaacaaccagtttgacacagagatgctgcaagccatgatcttggcgtccgccagtggtaagtggtgtcagtgtgtgtatggaagagtgggagacctggggttctggggtgcatctcacagccaccatgcccacggactggatgtcaaacctgtgtagtttctccagatctttcggcaggtctgaaaggacccacaattccaaacataaagcctggaattgtggctaaggaacagcagaggggttgggggtcctgggatgcctggaggagagcgaacaaggaaaagactcatggagggaatagtggttacaagtctagctctggaatgggacagtgtagctcaggtcctagctctgctactatccttgggacttggatcgacttgctcaatctctctaaacctcagtttcctcagcctagaaagtggggacagggaccccaaagggttgttgtagagattaaatgagatgataccacaaagcatagagttctgggcctggcgcttggaagccctcaagcaatgaaagtgggtgtagaaatccccagccgagagaacacctcctctttatgcgaggctcctcttttgctgcccctaactccagagtaggattctggttttcccataaggttgactaagggcttcctttgtaatagagattcggctagtggtggttgtccctgaagagtcactagggcccagagcaggagaagaagaatatcatttgtccttaagagcacagcctaagctgggcgtggtggctcacgcctgtaatcccagcactttgggaagctgaggcaggaggatcatgaggtcaggagttcgaaaccggcctggccaacatagtgaaaccctgtctctactaaaaatacaaaaattagctgggcatggtggtgcgtgcctgtagtcccagctacttgggaggctgaggcaggagaatcgcttgaacctgggaggtggctgtggtgagcagaaaatcgcaccactgcactccagcctgggcaacagtctcgctctgtctcaaaaaaaaaaaaaaaaaaaaagagcacaggctttagaggcaggccaatctggattcaaatcctggcacctggcaccaccacttagcaatgagtccttaggtaagttattaaaccccctcggtttcacttactattaatgggcacagtattaacggatctcattgtggtgttaccagggccaaatgcaagtccctcagcacaggattggcagagagtaagggcacaatatattattatctttgctgacccaaacccgttttttactgggtagaaagcagaattagaataatgcctattaataaagactagcttctggagcagcaaatcctgggcttataaggaggctggcagaggatcaaggcattgccctatatcatgaactgatagccctgccctccagcatgtctggaggactggtgggtagagaaccaggtgaaatcacaagaagcactgtcatcacacctgggcacatactaaacaaactttaggggcctcctgtcaatgaatcctctcaatagctctgcaaggcaggtctgatttctcacactcgacagatgagagaaccgagaaggcacttgccccagggtcctcagttttgagctgccaagctgaggttctaacctggctcaactcctaagtttatgctctttctactatagggaccatggctgcctttggatccagcctcggcttctctattacctgagcaggatgagaggctgtcctcttcctcgagctctgctttattcttccagatcagggttgccagataaaatacaggatgcccagttacagttgaatgtcagataaacagcaagtactatttcagcataagtcagtctcaaatgttgcatgagacataatgtactaaaaaaaaaaatgctcattgtttacctgaaattcaaatttaactgggagccctgtacttttatttactaaatctggcaactctaccccagatgtctgtgaggttaagtggggccaggcctacagctgacggaaggacagagagagaggtggcagggactgctggcctcctgaggcagagctgtcccaggtctggtggggctatgattccagagaggccagagactgagtatgaaagtggcaggcggctgggtctgaggagatgccaagttggcctcttgagggaaataaacaggtatatttagctgttgtggccttgcgccctgaggccaggaagcagctttttagcctaaatccagatgttaaaaacagaaatgaaatcagtatttatggccccaaaccctccaagcaagtcatgcagctcgttcccctgtcaaggcctcccacctttggcccacacagggcctgaccctcgtctaagcctgcgccctggggaacggaccctgggggtggaggtggtgggtcaggccctgctctcactttcacacccgcttcctagccctgaaaccagagaggttcctgaagtccagcccagccaggcctgtggggctgctgagaggggttaagtaagagggagagtaaaaaccgacacttgggaggaggcttttaaaataaacatctgcggggagggatgctctcaaggaggctgcggtttgcagctcagccagctgtgttccagctaatcagcctccttgggctactctggagttgctgccttggccctgggatggggtaggttaagaggacagagggaggtcagggagctgggggctgagtttccctgagtagaggctggcacaggagagaaggcatcacccccacctcgtccaggccagaagatgtccagcttcttgaggctctcctaagtctgcctctcctgggaccaagagaaaatcccggtccttgaccaaggtgggccttggggggagtggggtgtagagggaggggcactggagaactgactctacagaaagtcaaagctggcaatccaacttcttcccctcagatttatagatgggaaaacaggcttgagccacgcagagacttgaccaagctcacacagttccttagtggcagagcagagcaaatattctctttcttttacattctggatttccatatcttctctccctcctggtccagcccaacctcagggcaccccccacgaggtgggcgggggatggctttgtcacttgcacccactcggggtgctactcagagatcttgggtgcacataggacgtgggtgggccgagcttctagctactccgtcaggcccttcctgtcattctgtctctgcctcccttctccctgcttctccgtgttcctcctcattcttttctgtgtgcagggagactacaccccccaccccgctctttctctggcgcctctgaggtcccccctctagcccctaaatcactctggaatcctggctctttgaagccagatctgggcccccctcccctaccccttccattcccaggctgggaaaggctgaagaggctgacggctggaggggagggggcggggcggtggcggatctggcttccttttggagttaattagggaaaacagagaaatgtcagcggaatgaaagggctgggggtgggggccagctggggtaggagaggaggaagtgggcagctgctccctcccactcaacccctctcccccgcccccagaaagctctcagctccggggatttgcgacatgaaatgggggctgtagaaacctgagcgctggtgcgtgaagagaaaaaccgaggcgcatcccggctctcccctcccgtgtgccctcctcctcttatgccggcttgaaaatatttcctgtctctctatttctcaatccctggttgatgtcccaggattactcagcctctccggctttagtcactctcgctacccgctcccagggtccagggtggaggcagagggaggctgggagagaagctctactgccagctgggcctgggctggcctgggcatccctgaggttttaactgtctcctaaccacagaggatctcagggcctccagcagcgagccccaatgagtcaaactcttgtttcctcctctcccacccccgacccagtcagggcaggtgaggggtagaggtgatggcatgctggatgtgacggtgttgatgatgtattgcacaggatgaagcaccatctcatttagtcctcacagcagccttcacagtgcgtacaaatcagctggcaattccgagaggctgcattctaaacaagttcctgggtgatgctgagccagggccagagtgtggacttctctgggccccagtttcttcttctgtacagtgggacgttggactggaggtgctgtctgatgtcacctagctgtggcactctgagcctgtgcctaaagtgtccctgagatgtctagtccccgagatcatcatctcctcagcttcatagagccgagctcttctccatcttctctctacctcccattcactcagaacagggataaggtccaagctgctggtggtgatggtgactgactgtcccttccagcatgcgcttaggtacacttgggcctgaatgcccctctaacaaatgctaccgggtatggccttggtccttctaacacttggttccctcatctgtaaaatgagggtcataccacatagctggctgggctgttatgtagaggttaaaagtgattgtgcatgtgaagcatccagcagagtgcctggcacacagtaggtgctcaaatgctgttttgaaatacaaaaattagctgggctagtggtgtgcacctgtaatctcagctactcaggaggttgaggcaggagaatcacttgagcccaggaggcagaggttgcagtgagccgggatcgcgccactgcactccaggctgggcgacagagcaggactccatcttaaaaaaaaaaaaaaaaaaatgctgttttgaaatggaggcttggaagagcactcttcacccccaccccacacacttactaacggaactaccgaatctctactcgtgccaggccttgcttggcaaaggctaggggcatgtaaagccatggtttcatggctgctgccctccaggagcccatggtctagtgtgggagtcagaggctcccttgagaaagccagggcaaggaactgagagcccgtgtcacagccctgagagaaataccagcgaatgtgttttgagcacttacatctaccaggcactattttacgtacctgacatacattttcttatttagcattcactaaaaccagaagaggtggttaccattatcatccccattttgcagatgagaaaactgaagtggcataaggaggttaggtagacttgcccaggatcacagtgagtaaggaaaggagctaggaatcaaacctagactttctcactccagagcctcttaacctctaccctcaactcttgtgaagagagactaccttggtgacccctatattcccagtgctcagcgtggtcaaggcccagggtgctgtataggcattcattaactgctggggatataagacagtgactgttgaggaccctaagtttagctcccacctgatcttcctctgtctctgcagaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctgaacgtttctgtataagcgatggaagctcctggcatgtgtgcatgaagtgatgagctgaggtgggtgctggaagaagggcggaatcgggaggccactctgtgtcattgcgcgtctagatgtttccgaattgcgtgtgtgtgtgtgactgtgcaatatggttgtgtatgcttgcaatgccgttgtgcctatgagac

SEQ ID NO: 14858 - DNA, 159963 bp, Human
agacctgtttcctagatgttaacacttagtaatagcagtgccttttcttagttgatatgcaatactatattttcaagtcattttattcttagctctttataaatgtatttagagttcttcccacccaagttaaagttcatcaattacattaattatgtaattgatgtaattatgtattaatgtaattatgtaattaatgtaatcttcatcaattacattctagtttgtctttttgcagcaacatgtatgtttaatacagccttccaattattaagactcttaacactttgtctcatcacaagtagcaaatattgtccaattttatatttgcatcactaactttgagtcaatattattcccactctataatttcagtcaatgatatttcataattttcttaaccattcctaaattatttgtttttatgctctttctattttgtctctattaaaacaaagaatgtaatgaacatttgggtttataaagcgttttccatacttcttgtttctttagtgtagatttctgaggaattagttaaatctataaacatgttgagatttttttaatgcatactgtcaaatttatttccaaacatcttatttcacctctcaatcatccgcagtttgtgcggtctttgaggattgtgaaaaacacgtttaatctactctctcaaagtctgagggtttttaaattctgtatagctaatgcccttttgtatgagtcatttctactgctaattgttaagtgaggaataagcttaagaactgatgtactgctttatctcaaattttcacagattagtaaattactgtaagtattcataagaaagaaagcgatggcacatgcaatgataatccatgttcggctaccaaaacatttccttttactggctatttctaaaatgagagctaaagtaaagttagaaattgtaaaataatactgaatgtgtcatgtgaaaaaatcactaaactattatctgcactttatagttattcagtctaacttttctttttatttcttttttatttttaagatcagagttatttacccattgttttaggctttgcatttgaactggtcattcatgaaacattgaaaggtttcataaaaattactactctatgaaaggtattgttctaaagattgagaacacattgtgaacaagatagtcatatgcatagcttgtggccaagaatctactgtacacaaaattaaggagcaaattctcttcccaaacctattatcctatttgtcaatctcatttgtacagggtaaggctaactcttgaacagtaggtgagttttttgcaagggaattgaagcattgccccaggttctagagggtcaactcctgtgaggaaacttgttactgcataaattgggactaaagccagacctccaagttcctgtcccactgtcttttcacttatctgtctcatccatttttcaagtccacctttgtctttaggagagataattatgtccctcacacaatacgctatactgagaatgggctgtggggatgaacaatgtgaaaactgaaaagaggaagaacacatcttaggaaaaaaatcgtcatattttctctaagaaaataaataacttcataaagtttattgtacaggaagacttggatcattcttgaattttcattgcaaatcaaaaacaggaatttgactttattatcttgggagaaataggaatagaaaagtgtataaaaaataaactttttttaaccaagaataaattgcagtaacaggttaagactctgggtgtcgctgttcaccaatcagggggaaaagacaaaccagaaatttaatcagaatcacaagatttctgcagcacaaagcactggctctggagctttatgaaagcttcaagcggaagccctgagagctctggctgtgaatgcactttattttggacccagaagatcctggggctcctcaggcctcgacagagggaaaaccgaagcacaggcgactccgcggcggggttgtaatggcggcgcctcctgctcgcccagaccacacccggctgctccagatctgccttctcctgggggttctggtggaaatcagggccgaacagattctctactcggtgtttgaggagcaggaagaaggctcagtggtgggcaacatcgccaaggacctggggttggcgccccgggagctggcggagcgcggagtccgcatcgtctccagaggtaggacgcagcttttcgccctgaacccgcgcagcggcaccttggtcaccgcgggtaggatagacagggaggagctctgcgacagatctccaaactgtgtgacaaacctggagattcttctagaagatacagtgaagattttgcgggtagaggtggaaataatcgatgttaatgataacccacccagttttgggacagaacagagggaaataaaagttgctgaaaatgaaaatcctggggcaagatttcctcttcctgaagcttttgatccggatgtaggtgtaaactccctgcagggttaccagctcaactcaaacggttacttttccctggacgtgcaaagtggggccgatgggattaagtacccagagctggtgctggaacgcgctctagatcgcgaggaagaggcggttcaccacctcgttctcacggccttcgatggaggtgacccggttcgctctggcactgccaggattctcataatacttgtggataccaacgataatgctcccgtgttcactcagcccgagtaccacgtaagtgttcgtgagaacgttcctgtaggcactcggctactcaccgtaaaagccactgatccagatgaaggagccaatggagacgtgacgtattctttccggaaagtaagagacaaaatatcacagctatttcagttgaattctctgagtggggatataacaatattggggggtctagattatgaggactctggattctatgacatagatgtagaagcccatgatgggcctggtctccgagctagaagcaaggtactggtgacagttctggatgaaaatgacaacgcaccagaagtcacagttacatctctcaccagctcagtccaggaatcttcttccccgggtacagtaattgcacttttcaacgtgcatgacagtgactcaggaggaaatggcctagtcacatgttctattccagataatctgccattcacacttgaaaagacctatggaaattattatcggttgttgacacacagaacactggacagggaagaagtctcagaatataacatcactgtaactgccactgaccagggaactcctccactgtctacagaaactcatatttcactgcaagtgatggacatcaatgacaacccacccactttccctcatgcttcctactctgcttacattcctgaaaacaaccccagaggagcctccatcttatctatgactgctcaagaccctgacagtggtgacaatgcccgaatcacttactccctggccgaagacaccttccagggtgcacctctgtcctcctatgtctccatcaactccaatacagggatcctatatgctctttgctccttcgactatgagcagtttagagacctgcagctgctgatgacagccagtgacagtggagaccctccactcagcagcaatgtgtcactgagcctctttgtgctggaccagaacgacaatgtccctgagatcctgtaccccaccttccctactgatggctccactggtgtggagctggcaccccgctccgcagattccggctacctggtgaccaaagtggtggcagtggacagagactcaggtcagaatgcctggctgtcctacagcctactcaagtccagcgagccgggactatttgcagtggggctgcacacaggcgaggtgcgcaccgcacgggccctgctggacagagacgcgctcaagcagaggcttgtagtggtcgtccaggaccatggccagccccctctctcggccaccgtcacactcactgtggctgtggccgacagcatcccagatgtcctggctgacttgggcagcctcaagccttcagcagacccagacgactcgggcctcacactctatctcgtggtggcagtggccgctgtctcctgcgtcttcctggcttttgtcacggtgctgctagcactcaagctgagacgctggcacaagtcacgcctgcttcacgctgaaggcagcaggttggcaggtgtgcctgcctcgcactttgtgggcgtggacggggttcgggctttcctgcagacctattcccacgaggtctccctcaccgcggactcgcggaagagtcacctgatcttctcccaacccagctatgcagacacgctcatcagccgggagagttgtgagaaaagcgagcctcttctgataactcaggatttacttgaaacaaaaggagaccctaatcttcaggtgagtcaatcttataatagatcataccacactgaaatatagacaaagagttgtgtaaatgtctctcattttatatgtaatatatcaaataaagttgcctcttttaatattttattgctttaaagaaaactggtggatgaccttccaataatgatcaacagtatttaccacacaaaaatgttgtttattacttatcctttttggtcttcattcagttgtagtttcagccagaattttctaattttacaactctgagccacctcatttccttaaatttccttttctgtgctgggtgtggtggctcacacctgtaatcctaacactttgggagtgtgaggaggacggattgcctgagctcaggagttcgagaccagtctgggcaacatggtgaaacccagtctctactaaaatacaaaaagttagctaggcgtggtggtgtgtgcccgtagtcccagctaccctggaggctgaggcatgagaattgcttgaacctgggaggcagaggttgcaatgagctgagatcatgacactgtactccagcctgggcaacagagcaagcctctgtctccaaaaagtaaaataaaataaagtaaaataaagaataaatttccttttctcttaggtgttcctgaaaagatacaagagacctgtaaaatagaaggcaattgtgtaaattcacatttacaatattctttctcatgaagctattgttggatctggactgagggttttttaatttcctattttcacactctaccatgctttgcttgaagtttacttttccttccttgaaagggtattttccattataacaggcaacgtcaatttaagaatactggcaatttgtgagtttaacttttagatataactttaacaggatattttctcaatgaactggtatatttcaaatattttcttgttgctgttctgagatgcaccagaagtgactatgtgtgattcctctggtgcactcctgtgattatgagaaatatttccaagctaatttcagtcatatataagtagattctaggagtaactttaataatttttaaattgcttatcatgacatcactattgagactttcttgatttccaaggaaaatataagtttttggagtcttttctcttgtcatcatgtgagcctctttcaaaggttgagttacttgggttctggactgatatgatttacgctgcttagtaaggtggcctcatccctattgctacaaattgctttcagatatttctgtcatcatgtggctctgggattattttatatgagggaaaatattttgtgtgtaggggatatacaacacttttgttctttgtgctttcatttaggttctgtgagaattcaaaattcatgaatgcatatgcttacacaaattagtgtaatttgataactggaagttgtagtgatagactgtggaatatgcctcaatttgacttacaaaggagagttttagtttctacatggttttgtattcatagaaagttgtggtgcaatacatagagtaagctggaatatgatatgatgcagttacctggcttggggagcagaaagcagaaataacaagtgaatgttgagagacaacttacatctgaggagagattgtttaaagtaattaagccataaaatataatttggaaatgctcaattggtctgaaactgtgtcaagcatattcaggtgttggcattaggaatatattccagaatgagagtgccacatgttttaaaggcctaggaaagcagtagataatttataacctaaaatcaaattttttaaaaaatgtgtttttgttagaatgggcagtgggtttcttttagcaaataacaattttgattaaacaaattgttgtatattcatattacggactactagataactatattatgggccactagataactataagaaataaataggaaagctctctatgtactgatatgatctttaagatataacaactaaaaaagcaatgtgcagaatatggtatgttgtatgcttacatttgtgtaaagaaggagacagaatatttataaaaatccgttgccctatacaagacatatctccggaaggatacctaagaaactttaacactcatttcccctgtgaaagcatttctcctcatctaaagcagagatgaaaggaagaacctatgctgaatgcatcttttgaatttggaactatatgaatatttcacatattttaaaacaaatgaagactttataaattaaaaaagaaaagaaaagaaaaaagttcttagcaaatattgacaagccattagtgcagtttcctgagaaaacctctgagcgtcgctgttggtcaaaagaacgaagagaagcgtttgggagcctcttagaggggaacttcctgcacaaaccaaccacacagagaaggccagtatagattcggaaacagaaaacaaaagcaggaaaagtgaccttagcccggattctgccatccccggaaggcttattcctcctatgggcaaaggagcaaagggagccagaagatgaaagcgagctcagggaggtgcgggctggtgcggtggctgcaggtactgttgcccttcctgttgtctttgttccccggggctctcccagtccagatccgctattcaattccagaggagctggccaaaaactcggtcgtaggaaacctcgccaaggatctggggctcagcgtccgggacttgccagcccggaagctgcgggttagcgcggagaaggaatatttcacagtaaacccagaaagcggagacttacttgtgagtgacagaatagaccgagaacagatatgcgggaagcagcctctgtgtgttctggatttcgatactgtcgctgaaaatccactaaatattttctacatagcagtaattgtgcaggatataaatgataataccccgctattcaaacagactaagattaatttaaaaattggcgaatccactaagccaggtacaacatttccacttgacccagccctggattcagatgttggtcctaactcactacaaagataccaccttaatgacaacgagtactttgatctcgctgagaaacagactccagatggtcgtaaatatcctgagttgattctaaaacactctctggacagagaagagcacagtttacatcaattggtcctcacagctgtggatggcggagacccacctcaaagtggcacgacccaaatccgaatcaaagtcacggatgccaacgataaccctccagtgttcagccaggacgtgtacagggtcaccctgagggaggacgtgccgccgggcttctttgtgcttcaagtgacagccaccgaccgggatgaaggcataaacgcagagatcacctactcctttcataatgtggacgaacaagtgaaacactttttcaacttaaatgaaaaaacaggagaaatcacgacaaaggatgatttggattttgagattgcaagtagttacactctgagtatcgaagcaaaagatcctggagatctagcagcccactgcagtatccaagttgaaattcttgatgacaacgattgtgcacctgaagttattgtgacttcagtatctactcccctaccggaggattcgccaccaggaacagtgatcgccttgataaaaacgagagacagagactctggagaaaatggagaagtttactgccaagtgttgggaaatgccaagtttattttgaaatcttcctcaaagaactattacaaactagtgacagacggcgctctggaccgggaggagatcccagaatacaatctcaccatcacagccaccgacgggggcaagccgcccctctcctccagcataattgtcaccctgcacatctccgacgtcaacgataatgccccagttttccaacagacttcctacatggttcacgtggcagagaacaatcctcctggcgcctctatcgctcaaatcagtgcctctgaccctgacttgggccccagtggccaagtttcctactccatcgtagcgagcgacctgaagccgcgggagattttatcctacgtgtccgtgagcgcgcagagcggggtggtgttcgcgcagcgcgccttcgatcatgagcagctgcgcgccttcgagctcacactgcaggcccgcgaccagggctcgcccgcgctcagcgccaacgtgagcctgcgcgtgttagtgggcgacctcaatgacaatgcgccacgggtgctgtaccccgcgctggggcctgatggctccgccctcttcgatatggtgccacgcgccgcagagcccggctacctggtgaccaaggtggtggcggtggacgcagactcaggacacaacgcttggctgtcctaccacgtgctgcaggccagcgagcccgggctcttcagcctggggttgcgcacgggtgaggtgcgcacagcgcgtgccttgggcgacagggacgcggcccgccagcgcctgctggtcgctgtgcgtgatggaggacagccgccactctccgctacggccacgctgcacctaatcttcgcggatagcctgcaagaggtattgccagacctcagcgaccgccgggagccctctgacccccaggcaaaactgcagttttacctggttgtggccttggccttgatctcagtgctcttcttcctcgcggtgattctggcaatctccctgcgcctgcgactctcttccaggtcagatgcttgggactgttttcagcctggtctcagctccaagcctggacctggggttctccccaattacagtgagggtacattgccctattcctacaacctgtgtgttgcctcacaatcagccaagacagagttcaattttctgaacataaccccggaattggttcccgcgcaagatctcgtctgtgacaatgcctcttgggaacaaaatacaaatcatggagccgctggggtcccttttgcctcagatactattttgaaggtgagctttaattaatttattttcacttctggttttattgtttcacctaatttgggtaggaagttccactgcgtatttctttgtctgtgagttagatttggccaatgttgtgccttaattgtcttaatcttatctaactgaattttaagtgttttctctctgaagtgtgagatttatttacccatgattgcaaacctttatcacatgagatattgcactgtatttctttttcttcctcatctttacattacttctctctgcagatttgttgctattgagactttaggcaattagtttcaccttcaggctctttgttattcaaattttagttttacttcctcttagaatcataatacttcagagtaaagagagtcttcattttagtaggctttggaaattgggaaacaaagaagaaagacttttgcataatggcatggcttgttaatcacagggcatgggtaggacattgtcccattgacttgaagaccaacactcagtaagctaaatgtcttggaatcacaaatgtatttctaaaggacaggcaatgtttgaggtctgaggtgtctgctagaaagagtgcatttaacaaatgtgagaaatcattctctaacatgcattttaacaaattgctcttaagaaaaactacacattgagaaaaatcttacaacctatgttcacatcattttctacaaaatattacttaaaactttgcttttgaatttcctaattatatagaatttttattttcttagttttctatgaaagtgttattaaataaaatgactttctgaaatgtccatttttttcaatcaagaggtttttctatttctgttgtcatataaagatgatagcagtaaatatctgtctcaacatagaaaggtcactcagtacttctcgacaagtatctgctcatgctttcctgcatggatgatgaaataaaaccccatcctccacagttactatactggttgtcactggaactacaaatatttgaacatggtaatagaaaaacataaaaatgcatagttaacccaactcaaacgctgtctgagatagtggagagactttctcaaagtcctcacaagtaacaaagatctttatttcttctgcatatgacagctaatataacttacataaatcagtaggcctgtttggaaaggtgcatggagaactgggtttgtttccttggtattcttatatgcaaataagcacgttttcctaaatttatcctaataaggagatgaaatcttgaatcctacaaaggtaagaatttgaatgtcctaatttaatggactaaatatagataagaggtaaataaaggacataggctcccccgatgacgcattaaataaaatttttgtaaggtattgagatctaataatcatattgatctcagggattgtggaagtcttgctattcagaattaaagctgaattaacggtcataaacaacgctacacagttaaacattaaggatatggcaacattattagaaataaaattataactaaacttaggagaaataaaaatggaatttgatgcagtcactggttaggactctgagtgtcgctgttgaccaaagtgggaaagaagctgccgcagaggcgacccgactctgctccctccatactaaacacacagaccagacaagctcctacgaaaagccaacgctccacgcccattttcgtcagggaatatgtacccatcggctttagataaataaggaaacagcaggctgaaccagaactaagagaaaattgggcagagagaaggcaatggcgagtccacctaggggctggggctgcggagagctgctgctgcccttcatgctcctggggacgctgtgcgagccaggatccgggcagatccgctactcgatgccggaggagctggacaaaggctccttcgtcggcaacatagccaaggaccttgggctggagccccaggagctggcggagcgcggagtccgcatcgtctccagaggtaggacgcagctttttgccctgaacccgcgaagcggcagcttggtcaccgcgggcaggatagaccgggaggagctctgcgctcagagcccactgtgtgtggtgaactttaacatcttggttgagaacaaaatgaaaatttatggagtagaagtagaaataatcgatattaatgataacttcccgcgtttccgggatgaagagttaaaagtaaaagttaatgaaaatgcggctgcagggacacggttagtgcttcccttcgcgcgggatgcggatgtgggtgtgaactctctccggagttaccagctcagctccaatctgcacttctctctggatgtggtaagcggaactgatggacaaaagtatccggagctggtgttggaacagcccctagaccgcgagaaagagactgttcacgacctcctcctcacagctttagatggcggagacccggtactctccggcaccacgcacatccgtgttacggtcctcgacgcaaacgacaatgcgcccctgttcaccccatccgagtacagcgtgagtgttccagagaacatacctgtgggcactcggctgctcatgctaaccgccacggatccagatgagggaataaacgggaaattgacctactcttttcgcaatgaagaagaaaaaatttcggagactttccaacttgattccaacctgggggaaatctcaactctacaatcactggactatgaagaatccagattctacctcatggaagtggtagctcaggatggaggcgctcttgttgccagcgctaaggtggtggtcacagtacaggacgtgaatgacaatgcccccgaagtgatcctcacctctctgaccagttcgatctctgaagactgtcttcccggaactgtaatcgcgctgtttagcgtacatgatggtgattctggagaaaatggtgagattgcatgctctattcctaggaatttgccttttaaattggagaagtcagttgataattactatcacctattaacaactagggacctggacagagaagagacttcagattataatatcactttaaccgtcatggaccatggaaccccgcccctctctacagaaagccacatccccttgaaagtagcagacgttaatgacaacccacccaatttccctcaagcctcctactccacctctgtcacagaaaacaatcccagaggtgtctctatcttctctgtgacagcccatgaccccgacagcggcgacaacgctcgagtcacctactccctggctgaagacacatttcagggggcgcccttgtcctcctatgtatccattaactctgacaccggtgtcctgtatgctctgagatccttcgactatgagcagttgagagacctacagttgtgggtgacagccagcgacagtgggaaccctccacttagcagcaacgtgtcgctgagcctgtttgtgctggaccagaacgacaatacgcctgagatcctgtaccccgccctccccacagacggttccacgggcgtggagctggcgcctcgctccgcagaacctggctacctggtgaccaaggtggtagcggtggacaaagattcaggccagaacgcctggctgtcctaccgcctgcttaaggccagcgagccaggactctttgcggttgggctgcacacgggcgaggtgcgcacagcgcgagccctgctggacagagacgcgctcaagcagagcctcgtggtggccgtcgaagaccatggccagccccctctgtcagccaccttcacggtcaccgttgccgtggccgacaggatccctgacatcctggctgacctaggcagtatcaagacccccattgaccctgaggatctggacctcacactctatcttgtggtggcagtggctgcagtctcctgcgtcttcctggccttcgtcatcgtgctgctggtgctcagactgaggcgctggcacaagtcacgcctgcttcaggctgaaggcagcaggttggcgggtgtgcccgcctcgcactttgtgggcgtggatggggttcgggctttcctgcagacctattcccacgaggtctccctcaccgcggactcgaggaagagtcacctgatctttccccagcccaactacgcagacacgctccttagtgaagagagctgtgagaaaagcgagcctcttctgatgtctgataaggtagatgcaaacaaagaagaacggcgagttcaggttagttttctctttcggtaaggatgaccagaacattttcatttgtttcctttttcatgtttctgtcatattcagaatcagctagttatgtaaatagtggaacattatttgctgtattggagattaattttttttatataattcatgctttctccatttgttttcaaattctgttttgggaagtctagctgatatctgtagacttaagtgaaacaaataccttaaaggaaagtggttaaatataatcattttacccaaatattttgttatattggaactgcagttctattaatagaaaagatgttttatttattcaaattgttagatatattgttctcttttgagtgtctgcctagacaccattagtgaatgtgttttggaaaggataatgtataggactgatattttagtctacctgaaatttgtttaaggaaataatttacagtatttacataaatcagtggaaaggtacagagaacttctgggtcataaatatcagaaaagaggccgggtgcggtggctgacgcctgtaatcccagcactttgggaggctgaggtgggcggatcacgaggtcaggagatcgagaccatcctggctaacacggtgaaaccctgttctactaaaaatacaaaaaattagccgggcgtggtggcaggcgcctgtagtcccagctactcggaaggctgaggcaggagaatggggtgaacccgggaggaggagcttgcagtaagccgagatcgcgccactgcactccagcctgggagacagaacgagactccgtctcaaaataaataaataaataaataaataaataaataaatatcagaaaagtagataaaatttatattaatgataacatgtagcattctaaagtctggaaagtttgtgttaagccatgtagttattggatatgtgggcttgttgagagaagaaatcagtgtaaaggaaccttaaggttgggcttcgttctgtgatgtaaagcctccagagagttacatactgctgcactcaataaatgtaaatatgtcacacacctggcatcttctgttatagataaaccctttacttattagaatcaatacctactgcaatgttagcgtttctttaagtgtaggtgcaattcttctttattacttgagtttaaggttgtatttgaaaaaaaaagaactcaacttaaagatggttcaaaattttaaatttcatatctaacgtatgtgctcatcttaaattaatagatttgtcttaatgaaatactggcctatgtgcctcaaattccaggaggatgtgttatgtaatgaaagaactactatatttcccttctgcatctgatttgctgaagatgattttcagatgtttcttattaaaatattcttaatccttcaaattttgtacttttaaaaccttgagcatcagcttcaaataatgactaaataaggggaaaaggtaataaaatattacaaatgggatagtaagctacattactcaaccacatgaaaggttaattgacacattaaagaacctaagaccacttgatttttattttttaaacactgttaaagagcattcaagtatatctatatctatatacatatacacacacatatatatacacacatatatatacacacatacacacacacaaacacacatacatacacacatggacattctgaccaaaatgtaaaatgtacaaactcaccgaatagtgaatgcatccaaagagtaacaagagaatctatacagtaggtgtcgacattattcactcctatgtgaaaacttgcttttccattttttttaaaagaaaatgttatatgcttcttagggtaaggtgtttgggaaaaaagtaaaggttatagatttgggtacatttcttctgagttaaatgttttgtgcaatggaaaaatatctttaaaccctctataaactactaacagactataaaatgcttgatccatacattttgaatgtatgtactgtatataccatatacttttaaatatctgaatctttagttttatatgtgttctgaagaataatttttcatactaattgaagtgttcatacaatgaacacttggcattgtgttggaaggcacttgctttggaatgttttggagcaaagtcttgagtcagttatatttttgatgtttgtataaaggtgacaatgagtgtctgtctagaattctggttactgtgagtagtttaagatgctataatgcttttccactataaggtgaattcggtgtggaactcattgcttattgctgcacacttgcctagttttagagtaacaatacattatgtaggctaaagataatttctttaggaagattttctggtttgaaaatggaattaaaactgtaagacacctgtcagaaacatggaaaatggcatgttattgaccagggaaaagtgtaaataacaaaaagttaggattatcagatggtaaactggggaccaaggaaaagtggacaggaagattacttatataattaaataatataattataaggacttacaattcactccccaatcctaataacgcatcattgttaggctacttgagaagaaacagtacatttcaggacaattgtgatgtagtatgaaaaaacatcctttgtaaaagtttttcatttgggccagggtggttcatgactataatcccagcaatttgggacgctgaggtgggaggattgcttaaagccaggtgttctagcccagcctgggcaacatagtgaaaccccacctctatagaaaaaaaaagttttcaatcatacttatttaattaaaagtagacacttggaaacaaaggaaaagagaccctcttgctttttactatacttctattttataaggtcaatcatttcctcattacctttaacttcttttggggggagataataaagataaaagagaagaaagtgaaacatagaataaaactaaaagctatgacattataacttttagaagttagaagtaaaggaaatagaatgcaataagaatacacgtgaagctgatatttcaagcctctttatactacgtcttctgccatcaccaaaaatagcttccatttgtatgattttctatgtattattttatttggccctcatttctactagagtaagcagagaagatattattatgaccattttatgaaaatggaaactaaaaacgtgacgggattgagcaagattatctctgccctttgacaagtaaaaggtacttgatttggatggataaagctcaaattaaaagaaataacagactaaagatatagtaagtatatttaatgttttttaaaagtccttttaaaatgggaagaaagtatcactatcagtacactgccgatttttctcctaactagctccttatttggagctgatttagtcaccattactgcagttctgcagcagaggcgccgggtgccgctcttggctagtgctgtgcaaaatattggctcctcccgctgcagccagctcggaagaaaagtgcactctctatcaggcttcctgcagcggagacacccattagagaacccaagcacaaagacaaagcaaatagttggtcctgctcggagaactcttgggattatttaaagatctcctctcctcggatttagaaaggcaaaggcgcagagagcgggatgggaaatagctccggatggaggggcccagcagggcagaggcgaatgctatttctcttcctgctctctttgttagaccaggctctctccgaaccgatccgctacgctattcccgaggagctggacaggggctcgctggtagggaacctcgccaaggacctggggtttggcgtgggggatttacctactaggaacctgcgggttattgcagagaagaaattctttaccgtgagccccgaaaatgggaacttacttgtgagcgaccgtatagaccgagaggagatttgtggcaagaagtcgacgtgtgttctggaatttgaaatggttgctgaaaagcctttaaacttttttcatgtaactgtgctgatccaggatattaacgacaacccaccgacctttagccaaaatatcactgagctggaaatcagcgaactggctctcactggagccacatttgccctggaatctgcgcaagatcctgatgtaggtgtcaattcgctgcagcagtactacctcagccctgatccgcacttctctttgattcagaaggagaacctggatggcagtaggtacccagagctagtactgaaagcacccctggacagggaagagcagccacatcaccacctggtcctcacagctgtggatgggggcgagccctccagaagctgtaccacccagatcagggtaattgtcgcagatgcaaatgataaccccccagtatttactcaggacatgtacagggtcaatgttgcagagaacctgcccgctggctcctccgtattaaaagtgatggccattgacatggatgagggcatcaatgccgaaatcatctatgccttcatcaatattggcaaggaagtgagacaactgttcaagctggacagtaaaacgggggaactcaccactattggagaactggactttgaagagagagatagctacacaattggggtggaagcaaaggatggtggacatcacactgcatattgtaaagtacagatagatatttcagatgaaaatgacaatgccccggagataaccctggcttctgaatcccaacatatacaagaagatgctgagctggggactgccgttgccctgatcaaaacacatgatctagattctggatttaatggagaaatcctatgccaactaaaaggaaacttcccctttaaaatcgttcaagataccaaaaacacatacaggttggtgacagatggagccctggaccgggagcagatcccagaatacaatgtgacgatcacagctaccgacaaaggcaatccaccgctctcctccagcaagaccatcactctgcacatccttgatgtcaacgacaacgttcccgttttccaccaggcctcctacaccgtgcatgtagctgagaacaatccgcctggagcctccattgcgcatgtcagagcctcggatcccgacttgggacctaatggccttgtctcctactacatcgtggccagtgacctggagccgcgggagctgtcgtcctacgtgtccgtgagcgcgcggagcggggtggtgttcgcgcagcgagccttcgaccacgagcagctgcgtgccttcgagctcactctgcaggcccgcgaccagggctcgcctacgctcagcgccaacgtgagcctgcgcgtgttggtggacgaccgcaacgacaatgcaccgctggtgctgtacccagctctggggcccgaaggctctgcgctcttcgatatggtgccgcgctctgcagagcctggctacctggtgaccaaggtggtggcggtggacgcagactcgggatacaacgcctggctgtcctaccacattgtgcaggccagcgagcccgggctgttcagcctgggcctgcgcacgggtgaggtgcgcacggcgcgtaccttgggcgacagggaggccgcccgccagcgcctgctggtcactgtgcgtgatggaggacagcagcctctttcagccaccgtcatgctgcacctaatcttcgcagatagcttgcaagagatacaacctgaccttagcgaccgccccactccctctgaccctcaggcggagctacagtttcacctagtagtggcgttggccttgatctcagtgctcttcctcctcgcggtgattctggcaatctccctgcgcctgcgatgctcctccagacccgccactgagggctactttcagcctggtgtctgcttcaagactgtacctggagttctccccacctacagcgaaaggactttgccttattcctacaatccgtgtgctgcctcacattcctcaaacaccgagtttaaatttctcaatataaaggctgaaaatgctgcaccacaagatcttctatgtgatgaagcctcttggtttgaaagtaatgacaatccagaaatgccttctaattcaggcaatttgcaaaaggtgagtttcttcaaacctttccttccataaatataattgggtttcaattcattgatttagagataaaaagaatacagattaaatattccctgattacattattttattgattttctggtgtagagtagggtgtctaggaaattctttgtagaatttcctgtagaatatctgtgttgcagttgttctttcatagaaagcctccttttgatagtcttgaaacttttcttaatcctaatacactataatctgaaacatttttaatacagtattatctcacactgtcattttcagacatatctatccagaattagacccaaatcctcacaattaagtggtttacttagttttaatgcagtcaatcctaaaatatatgaaacattatgtatatcttaacacatttttaatgtaacctgtatataatatttttacttccctttgcatgtttttaaaagtatacacagatgttgcctatgtcagggcagtttttaacttctatgctaatcaaaagaaataatggcatctaaaatggcaactcttgtaatgggcactgtaatgaattggttcaaaatgtgtttgtgtagcatatgcctgtagtcccagctactcgggaggctgaggtgggaggatcccttgatcccaggaggtagcagctgcaatgagctataattgtgcccctgcactctagcctgggagacagagcgagactttgtctccaaaaaagtgtttgtggttgttggtacccttactgaaaatgggactagcataaatggtggtgaaatgtgatgataattcaaaatttacagaagattgtaatattatttctgttccccaaggtcctaagagatattttcataaaaatgaatggtaaacttcagagaacatttaaaattattcaaaataatctcttacactcttctaaatgcttcattatcttggggagggaaatattatgagtgtcatctctgcagatttagcagaaataaaatcctctgtgtgatagtttcacaaaacgatgcagtattaagttaggactctaagcgtcgctgttgaccaacctgggcaagaaaatcaacggaaactcaagttacatcctccaacaacaaagcaaattagacgggaaagcaggaaagctgtgcagaaattctgacctgaaacgcttcgcatccggtctctgcttgttgaaggaccttcaccgctatttctgagaagagcaaaagtgatgcagatctgttcttcctcttcttaatcccagagaagttcctaataagccagtaatggcgcctccgcagaggcatccgcagcgcagcgagcaggtcctgctcctcacgctcctggggacgctgtggggggccgcggcagcgcagatccgctactctattcccgaggagctggagaaaggctccttcgtaggcaacatcgtcaaggatctgggactggagccccaggagttggcggagcacggagtccgcatcgtctccagaggtaggatgcagcttttctctctgaatccgcgaaacggcagcttggtcaccgcgggtaggatagaccgcgaggagctctgtgctcagagcccgcggtgtctggtgagttttaacatccttgtcgaggataaactgaatctttatcccgtggaagtggaaatagtggacattaatgacaatacaccccgattcttaaaggaagaattggaagtgaaaattctcgaaaacgcagctccatcctctcgttttccactaatggaggtctatgaccctgatgtgggaatgaactcccttcagggatttaagctcagtggtaatagtcacttctcagtggacgtgcaaagcgaagcccatgggcccaagtacccggagctggtgctggagggcacactggaccgggaaggagaagccgtttaccgcctggtccttactgccatggatggcggcgaccctgtccgctcaagcgtcgcccaaattctggtaacagttctagatgtgaatgacaacactccaatgtttactcagcctgtctaccgtgtaagtgttcctgaaaacctgccagtaggcacaccagtgttggcagtgactgccaccgaccaggatgaaggagtccacggggaagtaacttattcctttgtgaagattacagaaaagatctcacaaattttctgtttgaatgttttgactggagaaatttcaacttctgcaaatctagactatgaggactcgagtttttatgagctgggtgttgaagcccgggatgggccaggtcttcgagacagagcgaaagtcttaataactatcttggatgtcaatgataatgtaccagaagtggttgttacatctggaagcagaacaattgctgaaagtgcacctccaggaacagtaatcgccctttttcaagtgttcgatcgagactctggcctgaatggcctggtaacctgttccatcccgagaagtctcccatttgaattggaaaaatcagttggcaattattatcgattagtgacaaatgcagctctagaccgggaagaggtattcttgtacaacatcactgtgacagccacggacaaaggaacaccacctctgtctacagaaacaatcatctctctaaatgtggcagacaccaacgacaacccgcccaccttcccccattcatcctactcagtctatgtccttgaaaacaaccccaggggtgcctccatcttctctgtgaatgcactggaccctgacgtggaccagaacgcccaagtctcctactcactggcagaagacaccctccagggggcgcccctgtcctcctacgtgtccatcaactccgacactgggattctgtacgccctgcgctccttcgactatgagcagttgagagacctacagctgtgggtgacagccagcgacagcggggacccgcctcttagcagcaacgtgtcactgagcctgtttgtgctggaccagaatgacaatgcgcccgagatcctgtaccccgccctccccacagacggttccactggcgtggagctggcgccccgctccgcagagcccggctacctggtgaccaaggtggtggcggtggacagagactcgggccagaacgcctggctgtcctaccgcctgctcaaggccagcgagccaggacttttctcagtgggcctgcacacgggcgaggtgcgcacggcgcgcgccctgctggacagagacgcgctcaagcagagcctagtggtggccgtccaggaccacggccagccccctctctccgccactgtcacgctcaccgtggccgtggccgacaggatccccgacatcctggccgacctgggcagcctcgagccctccgccaaacccaacgattcggacctcactctgtacctggtggtggcggtggccgcggtctcctgcgtcttcctggccttcgtcatcgtgctgctggcgctcagactgcagcgctggcacaagtcacgcctgctgcaggcttcgggaggtggcttagcgagcatgcccggctcgcactttgtgggcgtggaaggggttcgggctttcctgcagacctattcccacgaggtctcactcactgcagactcgcgtaagagtcatctgattttcccccagcccaactatgccgacacgcttatcaaccaggagagctatgagaaaagcgagcctcttctgataactcaggatttacttgaaacgaaaggagaacccaggcaacttcaggtgagtttctttccgcctaagcgggaagagtaatctgatcttcccgcaacccaactaatcagacaggctcatcagctagatcggctgttatagaagcgaacctcttttggtacaggaagattcgtgattttgtaaagtggaagactcccttgttcaggtgagggtatcgtttttttttttttttttttttgagacggagtctcgctctgtcgcccaggccggactgcggactgcagtggcgcaatctcggctcactgcaagctccgcttcccgggttcacgccattctcctgcctcagcctccctagtagctgggactacaggcgcccgccaccgcgcccggctaatttttttgtatttttagtagagacggggtttcaccttgttagccaggatggtctcgatctcctgacctcatgatccacccgcctcggcctcccaaagtgctgggattacaggcgtgagccaccgcgcccggccgagggtatcgtttttattggttgacaggaaaattcaagattgtctttgattagtgcttagttttcttagccctttgcagagagtcacataattctaatgtttttcttttatatcaaaagaatgttctgaagtcttaattttgtgggggaaaataatgcatgtcctagtttttctttacctttctcttcttggcaaactatttgtgtcttggattgagtacatctcgtttcttaggttttttcctactatgtgacatttgtaaggttctttctttttctaatgtgggaaaaaaaataaccttaatttaggtcagtgttaaagatcaagatcttggttttagctagcatggtggttcacgcctgtaatcccacctcttcaggaggctgaggcaggaggatcccttgagaccaggagtttgagaccagcctgggtgactctgtctctaccaaaaagaaaaaaaagtagccagatgtgtggcgtacacctgtagtcccagctactcgagaagctctgataggaggattgcttaagtccaggggtatgaggctgcagtgagatataattgtgtcactgcaccctagcctgggagacagaatgagactttttctctctctctctcaaaaaaaaaaaaagattttgttttttctcagtgttacttgataactataaacgacagacgttcatacaagagatctttcacctttactacttaggaatcaaaaattatttttgaaaagataagaatcattggtaactgcagcaggggacaccagatctttggtgttaaaagacctgaataacattcctgtaactatctgttatttacttgggccagttacaatcgccattatcttccaattaaaattaagatttaaaagacttctcttatcagagataggatccccctctgttgcccagtctggagtaaaaatccacctgtaactgctgcttatagagtgtgtatccagggcaacttgaatctatgttcctgggttgcaatcctaaagcttggctcaaataagctctacttatattattttttaaaacaagactttccttatctatctgactcaaattctaagaaaataattttataactttttttcaaactctaaagcagcatagtgaacacgtatttgttgacatcaccattattataattattgggttgttaacaataactaagcaccgatgctgtgtgcctactacagtgtcttttgcatactgtgtgcctgatagtatttaagagtgaaaatggccgggtgcggtggctcatgcctgtaatcccaacactttgggaggccaaggcaggcatctcacgaagtcaggagttcgagaccagcctgaccaacatggtgaaaccccgtctctactaaaaatacaaaaattagccaggtggggtggcatgggcctgtaatcgcagctactcgggaggctgaggcaggagaatcgcttgaacccatgaggcagaggttgcagtgagccaagatcgtgccactgcactccagtctgggtgacagagcgagactctgtctcaaaaaataataatgataattaataaataaagagtgaacatgaattttaaaacatgctcggtagtgtctgcttacaggacatatctctaaaaatagatgactgactggtgaatgggagaacaaatgttaatgaggttcaaataaaaatttaaatattttagcattttaacccagacaataaggctttcatcatataggaactctttattgaaatatttcaagaaaaaagggattatcatttagaagactgattagtcttatttattatgactgaaatgtgcaaacagaatcattgtttcatgaacagaaaacagcagagtttttgactgtcaatgatgttcgaatagaaaatggatcactaaggagataggagattctgttatcgacagtcttcaaaagtaagttgatggccctggaatgaatggagtacaggggattctctaatttgatgacttgttgaactacattatagtcaagatttttctccagtcatgagttggaagattctacaatctggtggtattatagaatggattggccacttgtgcatctgaatttgttatgaatgtgtaagaaaaaagcaattgagaagataccttgaaaataaatgagaacctcctttgtaacctgactttgtcagtcttcttaaagataacattgagttgatgtgtttttaaataagctgctaagagtaatatgtgtttttctgaaccaatattgtggtatttacatttaaggaattgttatagatttatttatttcaagtttccaaaggtatatacctaaacaagagatctaatcatacacatcttcaagctcattttcttgtatctttgtgatataatttgataaaataacattttaaacaacttgaatcttggatattagtctcatgagttagatgggctgttatacatatgattatttcataaactctgaaagtgtgaatgttattttactatactaccaatttgggatgttaaactacatcttgagcatttgttgttatagggaaagctcactaactacttttcatggagatcaggctggtttattttattctcttattacctgtgaccatttcatttaaacaaataaaatatttctctgatggaaaaactaccaacttctactctcacaaaagtcattcactcatgtggactgaccaactgttaaacatcctggcagtcatggaatttgctaagttatggctaaatgaggttctttaatccacctgcaatacagatcattaataataagataggctatctgaggttttgagagttcagtatagaattttgaagcatcaggaaaaaaaactaccaaattattgtcttattcttattttatggtctgtgaaagcctcttttttttttttttttttttttttttttttgtcagagtcttgctctgtctcccaggctggaatgcagtggtgtgatctctgctcactgcaacttcctcctcctgggttcaagcgattctcctgcctcagcctcccaagtagctgggattacaggtgcatgccaccatgcctagctaattttcatacttttagtagagatggggttttaccatgatggccaggctggtctcaaactcctgaccttaagtgatccacccgcctcagcctctcaaagggctgggattacaggcatgagccactgagcccggcctgaaaggcattcatttctgatcaggcttctgttgaggtggcaattgtcaaaggggaaggagtaaaatctcagaggagaaacattggaagatacctatatctttgcttgagaatgaaaatctaaatggaacttcaaagaactgttttgttgtttgttttttagaaaaaaaagtcccaaaaaagaaaagagagaagataatcaattcgatgcccaggaagccaaatagactttacatagaattctttttaatgcaaccaaacaaatggtcaggattcttcccaatatctcagtcaacaataatatacactctttaaactatgaaatgatttcaatttgatacaatgagcttatgttagattttattaaacatatcttggcggtctagtaaagatctttaatatttaattttatgatgttcgataacttagaaaatgtgaatgctagagacaatgaagccatttactccatagggtatgtatgctttgtgttcggagtagtctataatttaatttaactagctcttatttccttttctccaaagaaggtaccaagacactataaattaattgagacttttttaaaacagtagaataagaaacaaatgtgagatgaaactatgaattttgaggcatcaggtaaaaatggatcaagacattgagagctataacctccaaacatgaaagtttgtttgaaaatatctacaagtgcttacattgtttaataatcatacactttgcttgcctcaacaagaagttcaaaagtactattaaacaaatagaatttaactccagtttacagaattcatctataatacctctattagttcctttaaacaaaatttatctactttgtgaatgcaaagataactatggattattttgatagatcaaaacagaatgtccttcaaagtgttccctgtattctggagcaatgccaccagaaagcagaaataggttacttaggagcctcccacaaaacgaagttaagctttcttagtgttagttctggattctcctcctggttccaccaactactctccaggacctagaagaatttacaaaccaagactgtttcttgccaggtctttattccagagcaggtcattctcttttattctgcaactatgtgaaaggagctttcttttctttctgctagcagagggtagcctcggatccatcaataatttagttttactctatcaacatcagtggagagacgagtacctctaaggatcctgtcaggacagtcctgcattttgctcaaatgctgtctagagatccctgttttctcaattacactagaatagagtaggatgaagatttgaattgcatactaggatgaagacttgaattgaattgcataatgaaaagaatcagccaatccattatccagtttcttatgaattcacagcccagtaggatctctgcagatttctgccttctgtagaaaatgggttgcttctatagctgattgctgcagccaagacaaacaacgatttctttctttttttctcacaagactgggagtgagaatatttggattccgacattgttctactactatataatcaataatcaggaacaaggcaaggcaattccctctttctttctttctttctttcttcttcttttttttttttttttttttttggcagagttttgctcttgttgtccaggctggagtgcaatggtgtgatctcggctcaccacaacctccacctcccgggttcaagcgattttcctgcctcagcctcctgagtagctgggattacaggcgcgcgccaccacgcccggataattttgtatttttagtagagacggggtttctccatgttggtcaggctggtctcaagctcccgacctcaggtgatccgcccgcctcggcctcacaaagtgtgggattacaggcgtgagcaacagcacctggccccccctctcattttttaaacggttaaaatgaaggtgttagaccgtctctaaggttctatacaatcaaaaatttattaaaataggtctatatattttacaacaattttgactttctgaatcttgcatcatggtgtctagaacatatgtgttcaattaatactgaattaattaaaatttatatacactgatgtaaatattttctaagtaaaatctttcatatgtatttaaataaaatttacctttttgccttcaataactgattttcccatgtgcaataacgtgtgagtcagtgcccaaaagagtcacttgaaagttgcaaggcaaagcagttttttaaaaattatctaagattatcaaacaccggtccatgaacactgttgcattaattcagtgtcttaaaatggatttttaattatcagggatatctagagcaaagaaatctaacagggaaattttgaaagatgaaacaattttctatgaaatcagtgtattgtgtgcatcaatgtggtgcagtaacttagtaaggactcacagcgccgctgttcaccaaccagggaaaaatggtgcgagagatcccacagaaaccaccgagttttacagcacagagaaacgacagattgcgataagccctcttccaggctgcactaaactcaagcctctatcctgctggattctgagctccccttcctaagacagaggggtccacccggatacacccgcattctgaagcacttcccgagatcggcgcctaagcaagagaagcaggacgactatggcggctcagccgaggggcggggactacagaggattcttcctgctctccatcctcctggggaccccctgggaagcctgggcaggacgtattctctactccgtgtcggaggagacggacaaagggtcctttgtgggagacatcgccaaggacctggggctggagccccgggagctggcggagcgcggagtccgcatcatctccagaggtaggacgcagcttttcgccctgaaccagcgcagcggcagcttggtcactgcgggcaggatagaccgggaagagatctgcgctcagagtgcgcggtgtctggtaaactttaacatcctgatggaagataaaatgaatctttaccctatagacgtggaaataatagatattaatgacaacgttccaagattcttgacggaagaaataaatgtaaaaataatggagaatacagctcctggggttcggtttccgttaagcgaggctggggatccagatgtgggcacgaactccctccagagttaccagctcagccccaatcgccacttctccctggctgtgcaaagtggagacgatgaaactaagtacccggaactggtgctggagcgggtgctggaccgggaggaagagcgggttcaccacctggtcctcacagcctctgatggcggcgacccgccccgatccagcaccgcccacatccaggtgacagtggtggatgtgaatgaccacacgcctgtcttctctctgcctcagtaccaagtaactgtccccgagaatgtgccagtgggtacaagactgctcacggtacatgctatcgacctggacgagggagtcaatggggaagtgacatattcttttcggaaaataactcctaaacttccaaagatgtttcatctgaactcgcttacaggagaaatatcaactttagaaggattagattatgaagaaactgccttctatgaaatggaggttcaggctcaagatggtcctggtagtctgacaaaggcaaaagtactgatcacagttttagatgtaaatgataatgctccagaagtgactatgacgtctttaagtagctcaatccctgaagacacacctcttgggacagtcattgctcttttctacctacaagacagagattctggaaagaatggtgaggtgacctgcaccattccagaaaacctaccttttaaattagaaaaatcaatagataattattatagattggtcacaaccaaaaacttggaccgggaaacactctctttgtataacatcacactgaaagccacagatggtggaactcctcccttgtccagggaaactcacatattcatgcaggtggcagacaccaacgataacccacccaccttcccccactcatcctactcagtctacatcgctgagaacaaccccagaggggcctccattttcttagtgactgcacaggaccacgacagtgaggataatgcccagatcacttattccttggccgaagacaccatccagggggctccagtgtcctcctatgtctccataaactctgacactggagtcctgtacgcgctgcaatcctttgattatgagcagttgagagaactacaactaagagtgactgcacatgacagcggggacccgcctctcagcagcaacatgtcactgagcctgttcgtgctggaccagaatgacaacccgcccgagatcctgtacccggccctccccacagatggttctactggcatggagctggcaccccgctccgcagagcccggctacctggtgaccaaggtggtggcggtggacaaagattcaggccagaacgcctggctgtcatacctcctgcttaaggccagcgagccaggactctttgcggttgggctgtacacgggcgaggtgcgcacggctcgggccctgctggacagagatgccctcaagcagagcctcgtggtggccgtccaggaccacggtcagcctcctctgtcagccaccgtcacactcaccgtggctgtggctgacagcatccccgaagtcttggccgacctgggcagccttgagccctccgacggtccttacaactatgacctcacgttgtacctggtggtggcggtggccacagtctcctgcgtcttcctagccttcgtcctcgtactgctggcgctcaggctgcggcgctggcacaagtcacgcctgctgcaggcttcagaaggtggcttggcgaacgtgcccacctcgcactttgtgggcatggacggggtgcaggctttcctgcagacctattcccatgaggtctccctcaccgcggactctcggaagagtcacctgatcttcccccagcccaactatgtagacatgctcatcagccaggagagctgtgagaaaaatgattctttgctaacatccgtagattttcaggaatgtaaagaaaacctgccaagtattcaggtgagcccagcccttcctttatttccatgaggaatttatttgcatgatatttctctattattttgcaaaacaaatgttttgaaaatagggatttaaaaaactttatagaggtaaaaatgagtttaccagtttccttcagtggtgacactttaatatagaacacataggatatagtatttctttagtgaaagcctatggacaagattatgaatatgtggactatcacattttataatttccacctactttccaatctatgttccaacctactttcttaactcatatattttatacattggaatgaatcgagtctttcatattgcacaaggttagcaggaataaaacacacctcagctgtcttctcaggattctctttagcattcaaatatgtaaaaggttctgaaagatttcttccatgtgaagatttttttctgtggctgattctgcctccatgtacctcagcttggtggtcctaaaaaatcttgattgcttcttgacctatttacagtataatcatttattaatggggtggtagtagaaggttggatttatgcctaaagaatgaaatgtgtgtgtatcacacttcactaagatctatatcaaagacagacatcaagtctaatgccacactaaaggccatcggacaaaaccaataaaatatgtcaaataaaatgtcattttaagtgttgtaattggcatttgtgacataggcaattacatgttttaacagagaattccagtatgttgttttagtggtacagccagatgaagtgtgtctgtgggctatcaaagtgggagattggggatactggctttgtttcaactgtctcacgtactcaaaccttagaccatcttatgtacacagatcctagaccagtagttgattttatttattaggtctactgaaaaattcagttggaaataacccaatctgggattaactacttccatattcttttgtataacattttagtaaagctcagtatatcaagtgattgtcatccagaaggggtggatgacaaggtaatcttgattccagagacctttgagtattaattaaaaacacacttttagccaggtatggtgttgcaagctgtagcccacctgcatgggaggctgaggcaagaggacagcttgaacccaagaattggaggcccacctagataatataacaagactctgtctcttcaaaaaaagacttctttttagactagtgttgtatttggtagtattttgcacatgatagactctgtacaatagtgtgggggatacattttttttttttgacatggagtctcgctctgtcacccaggctggatacattttacaagttctgcagtgttcacatttcagatgtacaatcacttggggtagaagacaatgttgctgacaccaacaatgttactgagggaagatcctatggcagaactacggttataaggtattttgtaaaagaaaatctcctgaccaaaatttattagatgcataaaattgtttttaagcaatggagagacataatcactaaactcagtgagctattgcaatcaaactttccagggattgtttccttcaattcagaggtcaccaaggaatgtaaaataagtgcagaggtaggaagcagtgcttcagtgcagcagatctcagtgactttgtgttttgaggctatgtattatccccctgataactttgaagatgaatgttgtatttcataaccagtaaaataattgtgtaatgaggagaggagtaggctactgcctgtgatcatcgaaatgagaatcacataatattcctgtaatgaaatcactgaaactattgggaagggggtgtatttgaagataagtataaattgcaccttctaaaaggcaattttggtattactgatactctccggaaaaagttgaaataaatcaacttggaggtacttagaaaagtggagaaaatgttaggaacaatgaaagaaagataaaatgtatccagtatatttctaatgagtaagtatggaaaattactgtactctgagacggtttaggccaagtctgtgttatggctatctttatatagatagtgcatgtttgaagattggggaaagcttatgtcaataaatgtttatgtacttaatctacatgatttgcctaaaaatcctcaaagttgggatgaaggcattcctaagagtacatttttagacgtcattaaatatacagacgtatccacgtagtttttgttctttcagttaggcacacaattataattattgcactggttaacttgaagcagcagaggctgtagtttcctagtgctgactctgggcgccgctgttggccaaagtggagagcttggcgctccagatctcctcgcgcagccgcagcgcgctttccagggcagccccagctcagactccccagcgccagcctttacaccgcttcctcctcggaaaaagaagaattttttcttgaactggaactgcaactaaagtccgttcggagatccaaaaatctgcaatacagaggttatttgtaacccggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacacgatttatattaggatctgcccatgatgcggatattggtagcaacacactgcagaattaccaactcagtcccagtgatcatttctcactgataaataaagagaaatcagatggcagtaaataccctgagatggtattgaagacacctttggacagagaaaagcagaaatcctaccacttgactttgactgccttggactttggagctccacccctaagcagcactgcacagatacacgttctagtgactgatgccaatgataatgctccagtgttcagtcaagacgtatacagggtgagcctttcagaaaacgtgtacccggggaccacggtgctacaggtgactgccacggaccaggatgagggtgtcaatgccgagattactttctctttcagtgaagctagccagatcacccaatttgacctgaactctaacaccggggaaattactgttttaaatacattagattttgaagaagtcaaagaatattccatagttttggaagcaagggacggtggaggaatgattgcgcaatgcacagtggaggtagaagtcatagatgaaaatgacaacgccccagaagtgatattccagtctctacccaacctaattatggaggacgccgagctgggaacacatattgctttgctcaaagtccgtgacaaggattccagacacaatggagaagtgacttgtaaattggaaggtgatgttccatttaaaatattaacttcttcaagaaacacgtataaattagtgacagatgctgttctagaccgcgagcagaatccagagtacaatataaccgttacggcaacagatcggggcaagcctcccctctcctccagttccagcatcaccctgcacattggtgatgtaaatgacaacgctccggttttctcacagtcttcctatatagtccacgtggccgagaacaacccgcctggagcctctatttcacaagtcagggcttctgatccggacttggggcccaacggccaagtctcttactgcatcatggccagtgacctggagcagcgggagctgtcatcctacgtgtccataagcgcggagagcggggtggtgttcgcgcagcgcgccttcgaccacgagcagctgcgcgccttcgaactcacactgcaggcccgcgaccagggctcgccagcgctcagcgcgaacgtgagcctgcgcgtgttagtggacgaccgcaacgacaatgcgccacgggtgctgtaccccgcgctgggtcccgacggctctgcgctcttcgatatggtgccgcacgctgcagagcctggctacttggtgaccaaggtagtggcggtggacgcagactcaggacacaacgcctggctgtcctaccacgtgctgcaggctagcgagcccgggctcttcagcctggggctgcgcacgggcgaagtgcgcacagcgcgtgccttaggcgacagggacgccgtccgccagcgccttctggtcgccgtgcgtgacggtggacagccaccactctcggccactgccacgttgcacctggtcttcgccgacagcttgcaggaggtgctgccggatatcactgaccgccccgacccctctgacctccaggctgagctgcagttttacctagtggtggccttggccttgatctcagtgctcttcctcgtggccatgattctggccattgccttgcgcctgcgacgctcctccagccccgcctcctggagctgcttccagcctggtctctgtgttaaatccgaatccgtggttccccccaactacagcgaggggactttgccttattcctacaatctatgtgttgcacatacaggaaagacggagtttaatttcctaaaatgtagtgagcagttgagttcaggacaagacatactttgcggtgattcatctggggccttatttccactttgtaattccagtgaattgacttcccatcaggtgagtttcctttaagtataatttaatgctcattgcctacccatttctccatattcacaagaaaatatacatatttgcaggaaaatatataatttttagatgtcatggatcattttaggaaagttgtagtcagttaaaaagctgtcatatcattctacaaaggaggagtaaagtaggagcaattgtgtggcccaacatttgtttgttttttagccaagcttagatttataaagcaatgagggtgtggttttaaccacaaagtgaaagtgttagacagttgttggctctctcctaaaaagtgaatgagatttttcctatacattttccttcttgttgactaatatatgatgaatacttttttcagcttggatataccataaatataaaaataataaagccaaagaatttaagctaaaattcaacacttttcttaactaatttaactggtatggtctccatagtagtccactgttttgtttcctgtgttaacttcccttttgtttcaaaagctcttagaataaggagtcaactggatttttatgtccatggaccccttgtgattatatgcagtgtacgctgtgtgtgcgtgtgtgtgtgtgtgtgtgtgagagagatccttttacttagaaaaaggtctactatgctcattagaagatcaaaagcagattctccttacttgtaacataggagtttcaggattaatctgtattcaagctcattctatatccttcatcaaagaaaagacaatgttttgtgtctgttgtccctctcacacacagccctaatatataatgtgtaactgccttatctgcagccctaaactaatatagctagaggtcttctaatcattctcctacctctaggaaagaaatatagtcttgaaaactgccaatctggtgtgcatacaaaatatatacaaaataccaaggaacattatatgagccttttgctaggtatatctaagcaactgcttcagttaatggccactttacaaattgctgaaagaaggaaacgtctttcgattcttttttttttctttttttttttttgagacagagtctctgtctgttactcaggctgtagtgcagtggcacaatgatagctccctccagcctcaaactcctgggctcaagcattccttctgcatcagcctcctgactagctggaactcaggctcatgccaccagacctggctaatttttctgttttcagtagagaaaatattttctttcactaatttaactggtatggtttccattgtctacccagttttccatatgcataagaaaatatattcacaggaaaatataaagttttcagatttcatgagtggttttaagaaagttttagtcagtgaaaaaactatcataccagtcttcaaaggaagggtgaaataagttcatctgctacgttgcccaggctggtcttgaagggaaacagacttttttgtagtcatacttatcctttggcttcttagtaagtattatatagtcattactttttgcagttttttagatcaaagtgttaatgtaggtaaagttaattttagaatatatgtaaaagtcaagtctgctttaaatttaatcatctctttggtgaaagggatgggatggagctttgctttttatcatatattcatctgtacctttcaagtattcaaatagaaaaatataaacaatgtaaataaaatagcaaaacaatgtaatatctcataaaactgcaatggtaaaagcatttatcctattgaaattccacaatttttatttgaaaatattatcgacatgtaattcaagtggcatttagaagaataatttaaaagcaacaactctatagaaagcttgtaaaatgattaagtagtttaaaccaaataaaacaatttctgagtcagtcatctccagtaggtctattttagtctcaagataaattcatttctggtgacaactgaagttcttagttatttgttagtatatattggagacatttacaataaagcttagagcacaatgggaaatgaaagtatcatgttttttttaagaccaaatgtattgcagaaatgtgagtaatttaatccgatgctacaatctgatcattctgatctaatctgatcatttaataacactaaataaaaccttcatctcacattctttggctgtttcttttaaaatatgggtttacggataaatcaaataaattcaaaacaaagtaataagcaaatgatttttttttctcagtaatctagtagagtattacatttagaagtaatctgtatctcagtgcagtaactatttaggactgtaagcgccgctgttcacctactggaagacaaatgcaaccgaaaacactcagatctcacacctcacgaagacccgcagatgccacaaactaactgctggactgcagcgaaacccgacccctgtttggaggcactccaggtttccggaggattgtcatctccatagctgcggcaagaaactaaataagacccatttatgcacagtgaagattctgagaggattctgcagcaaaacaacaatggccgctccacagagtcgccccagacgcggcgagctgatcctgctgtgcgcgctgctgggaacgctgtgggaaatcgggaggggacagattcgctactctgtgccagaagagacggacaaaggctccttcgtgggtaatatctccaaggacctggggctggacccccggaagctggcgaagcacggagtccgtatcgtctccagaggtaggacgcagctctttgctctgaacccgcgcagcggcagcttgatcaccgcgggcaggatagatcgggaggagctctgcgctcagagcccgcggtgtctgataaatattaacaccctggttgaggataaaggaaaactctttggggtagaaatagaaataattgatattaacgataataacccaaaattccaggtcgaagatctagaagtaaaaattaacgaaatcgcggttcctggagcacgttatccactcccagaagctgttgacccggatgtgggcgtgaactccctccagagctaccagctcagccccaatcaccacttctccctggacgtgcagactggagacaatggagccataaacccagagctggtgctggagcgcgccctggacagggaggaagaggctgctcaccacctggtcctcacggcctcggatggcggcaagccgcctcgctctagcacagtgcgcatccacgtgacagtgttggatacaaatgacaatgccccggtttttcctcacccgatttaccgagtgaaagtccttgagaacatgcccccaggcacgcggctgcttactgtaacagccagcgacccggatgagggaatcaacggaaaagtggcatacaaattccggaaaattaatgaaaaacaaactccgttattccagcttaatgaaaatactggggaaatatcaatagcaaaaagtctagattatgaagaatgttcattttatgaaatggaaatacaagccgaagatgtgggggcacttctggggaggaccaaattgctcatttcggtggaagatgtaaatgacaatagaccagaagtgatcattacgtctttgtttagcccagtgttagaaaattctcttcccgggacagtaattgccttcttgagtgtgcatgaccaagactctggaaagaatggtcaagttgtctgttacacacgtgataatttaccttttaaattagaaaagtcaataggtaattattatagattagtgacaaggaaatatttggaccgagaaaatgtctctatctacaatatcacagtgatggcctcagatctaggaacaccacctctgtccactgaaactcaaatcgctctgcacgtggcagacattaacgacaaccctcctactttccctcatgcctcctactcagcgtatatcctagagaacaacctgagaggagcctccatcttttccttgactgcacacgaccccgacagccaggagaatgcccaggtcacttactctgtgaccgaggacacgctgcagggggcgcccctgtcctcgtatatctccatcaactctgacaccggtgtcctgtatgcgctgcaatctttcgactatgagcagatccgagacctgcagctactggtaacagccagcgacagcggggacccgcccctcagcagcaacatgtcactgagcctgttcgtgctggaccagaatgacaacgcgcccgagatcctgtaccccgccctccccacagacggttccactggcgtggagctggcgccccgctccgcagagcgtggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagatgcgctcaagcagagcctcgtggtggccgtccaggaccatggccagccccctctctccgccactgtcacgctcaccgtagccgtggctgacagcatccccgaagtcctgaccgagttgggcagtctgaagccttcggtcgacccgaacgattcgagccttacactctatctcgtggtggcagtggctgccatctcctgtgtcttcctcgcctttgtcgctgtgcttctggggctcaggctgaggcgctggcacaagtcacgcctgctccaggattccggtggcagattggtaggcgtgcctgcctcacattttgtgggtgttgaggaggtacaggctttcctgcagacctattcccaggaagtctccctcaccgccgactcgcggaagagtcacctgatctttccccagcccaactacgcagacatgctcatcagtcaggagggctgtgagaaaaatgattctttgttaacatccgtagattttcatgaatataagaatgaagctgatcatggtcaggtgagtttagttctttgcttgcttttaatttccagatgaattttatttggcataaattatgttttgaaaaacattgtgaagatagttgaaaataatttttaaggtgtatcacagagttttgggtttattttggtggtgttactataaaattgaactctaatagtcataggttattgtttcatttgcttttaaacgacttggaaaagattgttcaaccattttaagccttccagtattttattcctattatcactcattcacttaagaagtagctacccgtccatactggtaattttgctattgtttgtttgtgtgtgtgtgtgtgtgtgtgtgtgtgtgtgtgtgtgtgtgtatcccaaactagaacttcagaaaattatcaagaagtctaaagccttgttattagcttagcaaaagtaaaatatatctcagaatttttagggttatgtttagcatttgaacctgtaactaggctcttgtagatttcttcactttaaacctcttttctgagccctgtttctgtaccagtgcccttcaaaactttaatacttcttaccatccttcaaaacatgaacaaactttaaagatggatcttggtgggagatgagactggttactaaatattaagtatgtgagtcagtggtcacctgggctccatgcccatggagacatgaaatctaaagcctagaatgtccattgctcccccaaacaaaaaacaaaagcaaaaacattagatctgaattaaaatgtaattttaaactgttgaaagtgacttttgtaaaatatgtaagaacatatttcaatacaattccaattagctgtttcggttgtgcattgatgtgaagtggtgagaatgttgatattaagaaccaatgtttcaggtacacaagttctaaataagctgatcaattcaattaaagttattcagtcttggctggacacagtgcctcatgtctgaaatcccagcactttgggaggctggggcaggaggaccgcttgagccccgggggtttgaaactgcagtgagctatgatcatgccactgcactccagcctaggtggcagaactagaccctgtctctaaaaaaactattattaggccgggtgcggtggctcacgcctgtaatcccagcactttgggagactgaggtgggtggatcacctgaggtcaggagttcaagatcagcctggcaaacatggtgaaaccccgtctctactaaaaactacaaaaattagccaggcatggtggcatgcgcctgtggtcccagctactcgggaggctgaggcagaagaatcacttgaacccgggaggtggaggttgcagtgagcctcgatcctgtcactgcactccagcctgggcaacagggtgagactccgtctcaaaaaaaaaaaaaactaatattaatagtaaaaactcggtataggctatccattattgtattcctgcataccttcttgtagcatttgaataaagctaatacctgaattgattgttgtaaggtagaagtagatgacccaataaatgtttgttattaatgaaaaggacatttcctaaggattgtgtagtgttctactgtatggtgcatattcagtggagtgggagttaacttcatagtttgtgtaccatttggatgcacatttgagaggacaacatattattggcactttgcaattttaaaaactcggatgaaagttgccctggtaggaaagaaaatccttactctccctaaaaatgttggctagttgtttttattaatctgacaaatggactaaagaaggttgaccaatgtccacaaatttatgtaaatgaacttatgagcttcatttatccaattccaaagtcatttcagataggataataatgcaatccactagaatatccctttgtaccttgtattgcagaatagataagcatttccccaataactcttaagaatgaatttatgtactgtaaaagatatgacataagagaagtattttgagatatgaagaagagcaacgtagtagggtatatcatttcttagctacatcatatgggcagtatacttgaatgaatatttcctgaagtagaagagtaaagaaaaattatttttataaagaatgttaatatagtcaggaagaggagatgtttggggattggtataaaattgccacaactttacaaaatagttttaaatagtatagatttccctaatatgtgtaatataaaacactagaaatattggggagttggaaatcatagaaatgaacagaagaatgataaaattgtttccatagctaataaaaaatgaatttttgaaatcagtatagtatgaaggctctgagagcaagaactgtatcatattaattattatattgccagtgacaagggcaatacttagttctagctaagagttcaaggtatgtttgcagaatggtgaaagaatggaccaatgtatgcaggtttgtataaaaacccaacgtgatatttctaacaatttggaaaacagagaaagataccttaaagaagttgttataattttttattaagtatatggacgtaaaaacttggcttgttaagttaggcacacaaaaacaattactgcactggttaacttgaagccgcagaggctgtagtttcctagtgctgactctgggcgccgctgttggccaaagtgcagagcttggcgctccagatctcctcgcgcagccgcagcgcgctttccagggcagccccagctcagactccccagcgccggcctttacaccgcttcctcctcggaaaaagaatcgtttcctaaactggaactggaactaaagcccgttcggagatccaaaaatctacaatacagaggttatttgtaacctggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacaagatttatactagaagtagcagaagatgcagatattggcttaaactctctgcagaagtataaactctctcttaacccaagtttctcattaataattaaggagaaacaggatggtagtaaatacccggaactggcactggagaaaaccttagaccgggaacaacagagttaccatcgtttagtcctgactgccttggacggtggacatccacccctaagcggcaccactgagctccggatccaggtaaccgacgccaatgataatcccccggtattcaaccgagacgtgtacagagtcagccttcgggaaaacgtgccaccaggcaccactgtgttgcaagtgtcagccactgaccaagacgagggcatcaactcagaaattacttattccttctacagaaccgggcaaatctttagtctgaattcaaagagcggagaaattaccactcaaaagaaactggattttgaagagaccaaggaatattcaatggttgtagaagggagggatggtggtggactggttgcacaatgtacagttgaaattaatattcaagatgaaaatgacaatagcccagaagttacattccattctctacttgaaatgattctggaaaacgcggtgcctggaacactaattgctttgatcaaaatacatgaccaagattctggggaaaatggggaggttaattgtcaattacaaggcgaagtcccttttaagattatctcttcatccaaaaattcgtataagttggtaacagatggaaccctagaccgagagcaaaccccggagtacaatgtcaccatcacagccacagacaggggcaagccgcccctctcctccagcataagcgtcatcctacatatcagagacgtcaacgataacgctccggttttccaccaggcgtcctacttagtcagtgtacccgaaaacaaccctcctggggcctccatcgcgcaagtctgcgcctcggacctggacttggggttgaacggccaagtctcctactctatcatggccagcgacctagagcctctggcactggcctcttacgtgtccatgagcgcgcaaagtggggtggtgttcgcgcagcgcgcctttgactacgagcagctgcgcaccttcgaactcacactacaggcccgcgaccagggctcgcctgcgctcagcgcaaacgtgagcctgcgcgtgttggtgggcgaccgaaacgacaacgcaccgcgggtgctgtaccccgcgctgggtcccgacggctctgcgctcttcgatatggtgccgcgcgctgcagagcccggctacctggtgaccaaggtagtggccgtggacgcagactcaggacacaacgcctggctgtcctaccacgtgctgcaggctagcgagcccgggctcttcagcctggggctgcgcacaggagaggtgcgcacagcgcgtgccttgggcgacagggacgcggcccgccagcgcctgctggttgctgtgcgtgatggtggacagccgccactctccgccaccgccacgctgcacttggtctttgctgacagcttgcaggaggtgctgccggatatcactgaccgccctgtaccctctgacccccaggctgagctgcagttttacctagtggtggccttggccttgatctcagtgctcttcctcctggccgtgattctggccgttgccttgcgcctgcgacgctcctccagccctgccgcctggagctgcttccaacctggtctctgtgtcaagtctggacctgtggttccccccaactacagtcaggggactttgccttattcctacaacctatgtgttgcacatacaggaaagacggagtttaatttcctaaaatgtagtgagcaattgagttcaggacaagacatactttgtggtgattcatctggggccttatttccactttgtaattccagcgagtcgacttcccatcctgagttggtgagtttcatttatgtctattctttttcattacccacccaattttctgtatttacatgaaactatcgtacattttcaagtccaatgagttgtcttagggaagtcagagctgctcagaaagctgtcctaccattctttaagaggagcagtaaattgtgagtttttatgtcgcataaaagaagtagccttatagatttacaaagtagtgagagtttgctcttagcttcctctctagcaaaaacatttggtgcgtttttttgtcctctttctcaaagctaatgaattttacctattcgttgtctcattctttaacatgtttatattttattgtatgtagataaaccattaaatttaatgtatgtaatcatttaattcatcttttaaagcaaagaaactgctagtagatgtctttcttcactgatttcactggtagttttcatctctttcttatgttcctcatatatgctttcttattcctacctaatggatttatgattttttgaatctcctaaaattttattaaaaatactatatgttggctgggtgcagtggctcatgcctgtaatcccagcactttgggaggccgaggcggttggatcacatggtcaggagttcaagaccagcctgggcaatatggtgaaaacccgtctctactaaaaatacaaaaattagctgggtgtggtggcgggcgcctgtaatcccagctactcaggaggctaagacaggagaattgcttgaacctggcaggtggaggttgcggtgagccgagatcactccattgcattccagcctgggcaacaagagcaaaactccatctcaaaaaaaaggaaggagaaggagaggaagaagaagaaaaatactacatgttatgtgtatgagagagaaagagagagactgattcactgaacttagaaggtccaaatcatccaaataattttctaagtttatccaggttttcttggatgcaaaatccttttccacctctatataattaccagaagaaacttacaaaaaaaaggaaatgctattgcctgaatttctcttgctcggaatcctgacatattcttgaagaaggggaaaaagacaccggatttgtcttatcgtttggagctttaaatataaatgactggatgttttctcaacatccttgtaggatggaaggtgaatacaggattattccatttttaagacaaaaactactagtcttgtgtacatacaaagctcccattacatggtataagtcttttgcttggtttcccttagtatgtgattcagtaaatgggttccttacaaagtgctgagatttcttataataccacttacttttaacctttcagtagttttctttgttgtatattttgtgttctttttcccaaattattatataagtttaagtgatgcttagaataatgtttaagaccactttaaaattgcataatttattgatgaaggattaaaatagaaacttgcttttcagtgtatatgcatttgaatcattgaaacacagtctgtgcatgcattacatattcacattaaaaaactaagcatttttgaaatagcagaaaagtttaagcaattacaaaaatgtgaaaatttccaactttaatcctgttaatatttagcaatattaggcgagaacatctgtaactattgctgaattaatattacttttataatacaaaaatttaaaataaacgtttttccaggaattttatcatcaaaataaaccccagaaaataatttcaaagtggataatctatccttatatatgtattaatacaattatatattttacatttacaaatatataggtataaaaattaaaaatgaatgtacttccaaacaagattgcacataaaaattacttcagaaaattgttaagatacacagaaaaaattgaagcatcataaaaaggaaattataatagtttacatatctagaaatagagtgcaaagttctaccaagaataagaataaattaatattaagcaatggtttgtgattttataatacacttacagaaattttattccactttatttacaactcagatatctaaaaaatagattgcttttgaaatacaaatgcaagaaacaattggagaaatctaaaatcataattagaagagagtagtgttttctttatcagccatctgatataatgttacacatcagtgggtgtagtaacggcttaggactctgagcgccgctgttgatcaactctaagcgaaaatcaggactccatccggatttccagttctgcggctacacaaaacccggcagataccacaaacctgctcccaggctgcagcaaaactcagcctctttcttctaaggaaaagatcaccatactttgcagggtggaagaaagaacctgatgaagcagcgcgcacagagatccttttgagaaaattccaaagcgaggcagcaatggcagctccaaccaaatgccagctccgcggaagattagtcctgctatgctcgctcctggggatgctatgggaggccagggccagtcagattcgctactcagtgcctgaagagacagaaaagggctatattgtgggcaacatctccaaggacctggctctggagccccgggagctggcggagcgccgagtccgcatcgtctctagaggtaggacgcagcttttctctctgaacccgcgcagcggcaccttggtcaccgcgggtaggatagaccgggaggagctctgtgctcagagcccgcggtgtctggtgaactttaaagtcctggttgaagacagagtgaaactgtacggaatagaaatagaagtaactgatattaacgacagcgccccaaagttccaggccgaaagtctggaagtaaaaattaacgaaatcgcggttcctggagcacgttatccacttccagaagctattgatccggatgttggcgtgaactccctccagagctaccagctcagccccaatcaccacttctccctgaacgtgcagactggagacaatggagccataaacccagagctggtgctggagcgcgccctggacagggaggaggcaactgcccaccacctggtcctcacggcctcggatggcggcgagccgcgtcgctccagcacagtgcgcatccatgtgacagtgttggatacaaatgataatgccccggtttttgctcaacggatttaccgagttaaagtccttgagaacgtgcccccaggcacctggctgcttactgcaacagccagcgacctggatgagggaatcaacggaaaagtggcatacaaattctggaaaattaatgaaaaacaatctctgctattccagcttaatgaaaatactggggaaatatcaacagcaaaaagtctagattatgaagaatgttcattttatgaaatggaaatacaagctgaagatggtgggggattgaaagggtggacaaaagtgctcatttcggtggaagatgtaaatgacaatagacctgaagtgaccattacatctctgtttagcccagtgagagaagacgcacctcagggaacagtaattcttcttttcaatgctcatgaccgagactccgggaagaatggtcaagttgtctgttctatccaggagaatctatcttttacattagaaaattcagaagaagattattacagattgttgacggcccaaattcttgaccgagaaaaagcctcagaatataatatcacggtgactgcaacagacagaggaactccgcccctgtccacagaaattcacatcaccctgcaagtgactgacatcaatgataatccacctgctttctctcaagcctcctactcagtctacctcccggaaaacaacgccagaggtacttccatcttctccgtgattgcctatgaccctgatagcaatgagaattctagagttatttactccttggcagaggataccatccaagggtctcctctctccacctatgtctctattaactcagacactggtgtgctgtatgctctgtgctcctttgactatgagcagtttagagatttgcaaatgcaggtgacggcaagtgacagtggaagcccaccacttagcagcaatgtgtcattgagactgtttgttttggaccagaatgacaatgccccagaaatcctgtaccctgccctccccactgatggttctactggtgtggagctggcaccccgctctgcagagcctggctacctggtgaccaaggtggtggcagtggacagagactcaggccagaatgcttggctctcctaccgcctattcaaggccagtgagccagggctcttctcggtggggctgcacacaggtgaagtgcgcacagctcgggccctgctagatagagatgcgctcaaacagagccttgtggtggctgtacaggaccatggccagccccctctctcggccactgtcacgctcacagtagccatagctgacagcatcccagacatcctggctgacctgggcagtcttcagatccctgcagacctggaggcctcagaccttaccctctacctcgttgtggctgtggcagtcgtctcctgtgtcttcctcaccttcgttatcacgctgctggccctcaggctgaggcactggcactcctcgcatctgctgcgggctaccagtgatgggttggctggtgtgcccacctcacactttgtgggtgtagatggggttcgagctttcctacagacctattctcaggagttctccctcaccgctgactcaaggaagagtcacctgatcttcccccagcccaactatgcagacacactcatcagccagcagagctgtgagaaaaatgagcctttgtgcgtctctgttgattccaagtttcctatagaagacacccctttggttccggtgagttcattttttttctttctttcttttctttttttgttttttgttttgttttgtttttgagacagagtcttactctgttacccaggctggaatgcagtggtgtgatctcggctcattgcaacctccgcctcccaaattcaagcgattctcctgcctcagcctcccaagtagagtagctgggactagagtagagtagctgggactacaggcctcccaagtagaataactgggactacaggcacgtgccaccacgcccggctaattttttgtgtgtttttagtagagacggggtgtcaccatgttggccaggctggtcttgaattcctaacctcaagtgatccacccacctcagcctcccaaagcactgggattacaggcgtgagccactgcgcctggcccttaactttctattatagttagctttctctttaactgtctgtacttaaggtagtataagttgatatcagtgtgtttctcatcacttttcactgggcctaattgttgctccaacactgaaaggaggcatttattagttatatttgctgatataactttcatgttctcataataattaacctgctgtcaacgtaaaccatacttcatggggtagctctcagcctgcattgatgtgggctttttgggtagggttgcttcattggttgcagtggactcatatcataaaattcttactcctttttttttttttttaagagatgggggtgtcattctgttgtccagggtggaatgcagtggtgtgggtaaagcttactgcagtctcaatctcctgggcttatgcaatcctcccacctcagccttcacagtagctaggactgaggtgggagggctagcaagctatgttgcccagactggtctcaaacgatcttcctgcttcagtttcccaaagcactgggtgaggtgtgaaccacctcacccagcaaattcttactcctacgatcatttattcaggtcatactatgtttgtaagggtaaactgataaaaaggtaaatgtattcttcttagagaaacagctgaaagcccagatttattgcttctattcttccatttctatgacaggaaaacacctctttgaggttatatttttcagatcacaagtgtgtaaagtctgtttgtgtttacagatattttctgacgaagattcaaacttcagttatccacttccaaaccctagtaaaccaattttttccctttaatggtgaaagttgtcacatcttttattctcatatcttcaaaggtcttaatttcctaatgctttaatgttaaattatggagaatagtaggacattcttcttttctatagtatatgcttgctcaagagaagtttctaagactggacactgtgaaatgacaaaacaaggaattaaaaatatttctctcacttatatattatttctggctcaattctccaacttttgagtctagaaatgaacttgcatatcagatataatttaagaaaatattctcaggaactgctgggaagattctaaaactattttactgtttttagctataaggaagagaataatgtattatttaatgttattttaaacatagtgttgtttcaaatagtaaataacatttcacaagacatttgaaaataagctttgaagttgactcaaaattctatgctaaacatgtgatccatagatacactgatgactgctggcatttctgtggaaatgaagaattgttttatttgtttgtaattatttgggtttcagttgctttatttttaagaaaaaaaagctgaagtgtctgggaatcctttatgacatacagacattttaattatttcaaacacgttttcccccttaagtgggtagcaaaaaaaataaagcatacttcaggctcatatttttaaccatgcaacaagaaaattgttacaatttctgttctgaggagtagccttcatacttagtatttataaatattgaaatgtatgttaatttggggaaaacataacagatatccatgaaggcttgtatgtcatggtaggtagttactattcgataccacaaaaatgtctcttgcccttaaaaccagaacacgaggctcaccagacagatgactgaatggagtatggaaaatctttatttctgtttttcttaggctatgtaggacttaacttattgtgcattggtaacagattgtagaacataagctgaaagataaaattcttgaccttaatgtctcatcttaaaaagaagcattggttgacattctatatctcgtattacttaaaaataatgggggagcgcagtatatattaaacaaagattggctttgtggtgatcattgttgaaggtggggtgatggctatgtgaaggttcactatatatactccctactgttgtataagtttgaaattgtgcataatagatttatttaaaacacaaagcatagaaatatctactataatattatggtgagagcaaaatttgagggggatgtacacctgcattttcgaagaatatatacatttcggagaccgaattcaaaatgaaaaaccgggctgctgtcccgcacggagcctctgggcgccgctgtcggccagtgcagagcaagcgctgacgccggggatccgtcagcctctggcctgggattccctgcgcagccaacaacagaaagaagaaaaccagctcccacacagagcctcccggctgcgcagacctttcccagcacagcggattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtgctatttcctttgctgctgcctttgttctaccccaccctgagtgagccgatccgctactcgattccggaggagctggccaagggctcggtggtggggaacctcgctaaggatctagggctcagtgtcctggatgtgtcggctcgcaagctgcgagtgagcgcggagaagctgcacttcagcgtagacgcggagagcggggacttacttgtgaagaaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaatttgataaaaaggaaatacatttagaaattttcgaatctgcatccgctggtacacgactatcgcttgaccctgccacggatcctgatataaacataaactcaattaaagattataagataaactctaatccttatttttcattaatggttagagttaattccgatggtggcaaatacccagagttatctctggagaaactcctagaccgggaagaacagagatctcatagcttgatattgactgccttggacggaggggacccaccaagaagtgccaccgctcacatagaaatttctgtcaaggataccaatgataaccccccggttttcagcagagacgaatatagaattagtcttagtgaaaatctgccccctgggtcccctgtgttgcaagtgacagccactgaccaggatgagggggtcaatgctgagataaactactacttccgaagcactgcccagagcacaaaacatatgttctcattggatgagaaaacaggtatgattaagaataaccagtcatttgattttgaagatgtagaaaggtacaccatggaagtggaagcgaaggacggaggtggtctctctacccagtgtaaagtaatcatagaaatccttgatgaaaacgacaacagcccagaaataatcatcacttctctctctgatcagattttggagaattcacctccaggaatggttgttgccctcttcaaaacacgggatctggatttcggaggaaatggagaagtcaggtgtaatatagaaacagacattccattcaagatttattcttcttccaataactactacaaactggtgacagatggagccctggaccgagagcagacaccagaatacaatgtcaccatcgtagccactgacaggggcaagccgcctctttcttccagtagaagcatcaccttgtatgtcgctgacatcaacgacaacgccccagttttcgaccagacgtcctacgtggtccacgtggccgagaacaacccgccaggagcctccattgcgcaagtgagcgcctctgacccggatttggggctcaatggccacatctcctactctatagtggcgagtgacctagagcccctggcggtgtcgtcatacgtgtcagtgagcgcgcagagcggggtggtgttcgcgcagcgcgcctttgatcacgagcagctgcgcgccttcgcgctcacgctgcaggcccgcgaccacggctcgcccacgctcagcgccaacgtgagcctgcgcgtgttggtgggagaccgcaatgacaacgcaccgcgggtgctgtacccagctctgggtcctgacggctccgcgttcttcgatatggtacctcgctctgcagagcccggctacctagtgactaaggtggtagcggtggacgccgactcgggacacaacgcctggctgtcctaccacgtgctgcaggccagtgagcccggactcttcagcctggggctgcgcactggggaggtgcgcacggctcgagccttaggcgacagggacgcagcccgccagcgcctgctggtcgctgtgcgtgacggtggacagccgccactctctgccaccgccacgcttcatctggtcttcgcagacaacttgcaagagatactgccagacctcagcgaccgccctgtactctctgacccccaggctgaactgcagttttacctggtggtggccttggccttaatctcagtgctcttcctcctcgccgtgattctggccattgccttgcgcctgcgacgctctctcagccctgctacttgggactgcttccatcctggtctctgtgtcaagtctggacctgtagttccccccaactacagtgaggggactttgccttattcttataatctgtgcattgcacatacgggtacaaaagagtttaatttcctaaaatgcagtgtgcccctacattccaatgaagacatggtttgcagtgtttctcctggagccttaattccacctcatggtggggaggatttgacttcacatcctgagactctgacttcggtgagtttctcttttttgtgtgtgatttatctaatagtctactagtttctcatattttaggcatactactttattttcatatctagaatcatatgtttaaaatccatagctttttacaatattttctcaatgttttttcaattatagttttcactatgtatttggttcataagttgctctatctttttgtaaaataatgtcaccagactgaagatattttgtctttgtcttttttttttttttttttttttgagatggagtctcgcactgttgcctaggctggagtgcagtggcgtgatctctgctcactgcaacctccgccttctgggttcaagcgattctcctgcctcagcctcccaagtagctgggattactggtgcccctcaccacagctaaattttttgtatttttagtagacatggggtttcactatgtcgaccaggctgttcagaaactcctgtcctcgtgatcctcccaccttggcctctcaaagtgctgggattacaggcgtgagccacaatattttgtcaagttctgactatcgaacagaagcagtggtcttggcatctaagaaaacaaacaagtaacctatctattcaaatttgcgaagacttagtgaatttacgatatcttatttatatatttttaaagcctaaaaatattcagaagacaggcccagtggctcacacctataatcacagcactttgataggctgaatcggaaagtatcacttgagcccaagaattgagaccagcctgggcaatatagggagaccccccatctctactaaaacaacaacaacaaaaaaaaacattagcagagtgtggtagcattcccctgtggtcccagctacttgggaggctgagctgggtggattgcttggtcctgggaggtcaaggttgcagtgagccctgatcttgccactgcactccagcctgggcgacagagtgcgaccctgtctctaaaataaataaataaatatgcaggcagggccaagtgtgctgtaatcccagcactttgggaggtggaggtggagaatctcttgagcgcaggaatttgagaccagcctgggcaacacagggagactccatcgctacagaacatttaaaaattagcagggtgtggtggcacatgcctgtggtctcagctactctggtggctgtggtgggagaatcgcttgagcccaggaagtctaggctgcagtgagctgtctaggtgacagagtgagaccctgtctcaaaaaaaaaagacatttctaagaaataaatgaaatactattgcctttgcactcagtctctgtctctgattctctgatagaagatttttgaagaaaaaagataaaatctttgaagagttctatacttggaaggcatagtgacataaacacttctgaacatcctgttctctgtgtgaaagaagtgaacttctataccctttgcatttgagggaacaattgctactgggttgatgggcacacacagttgaagatatgtgaaccactggactttggcctctgatacaaactgcctaagagaagagattatttatactggtattaatgctctgatgaaaacaggtcatttgacataaacacttacttgttaaaaacctatatcactacatctaactttgttttctaaaacttttagtacttcaaattctacgtatttcttttctcattacaatgcaaacagtttaatttgcaactgtaatatatgttcattttagtttgtgattacctgcttaatcatttaaataggtccatttaacttgtatccctgtaagataaagtatgttttacacaaaaaggttaattaaggctcagtaaaactattctagaagagtactttaaaaacctcttacacaatcctaagctaaataagtttaatgaattaagtagttacaattataaagcttcagagtgaattatctcatgagtttatttaatataatctttgtatgaatgtatactaaataaaattggcctattcaaatcacaattttaaattataagacttttctgaatttacctagacactaatatgacctaaaataagtattatttaccttttattaaagtgtgtacatttctgttgggaaaacgtgttgcaaatatatatttaaccaaacattatcttgaaatatttacaatattttcactccactttatcacacctcccctaagaaacctacatatagtaaattatttaaagataggagtggagaaaccaaagaatctatgtaaaatataataatccaacagaatagtttactttccattgcatgtatcacttgggtgcagtaacttcttaggactctgagcgccgctgttcacctactaggagagaaaacgcagccagagctcaatccggattctcagggcttcaactacacaagccccacaaaccggctgctgggctgcagggaagctcactccagaatttaaagtgcccaggctacagagacaccctgaagccacagaaagacaaaggaaccggttgaaacacacaacgtgtccagtgaggactttgcagaattctgtaaccagactacaatggccgctcaaaggaatcgctcaaaggaatcaaaggattgcagcgggctggtcctgctctgccttttcttcgggattccatgggaggctggagcccggcagatctcctactcaattcctgaggaattagagaaaggctctttcgtgggcaacatctccaaggacttgggtctggcgccccgggagctggcggagcgcggagtccgcatagtctccagaggtaggacgcagcttttctctctgaacccgcgcagcggcagcttgatcaccgcgggcaggatagaccgggaggagctctgcgctcagagcgcgcggtgcgtggtgagttttaatatccttgtggaagacagggtgaaactttttgggatagaaatagaagtaactgatatcaatgacaatgctccaaaattccaagcagaaaatctagacgtaaaaattaatgaaaatgtcgctgcgggaatgcgttttcctctcccggaagctattgatccggatgtgggcgtgaactccctgcagagctatcagctcagccccaataagcacttctccctaagagttcagagccgtgccaatggcgtcaagtacccggagctggtactggagcactccctagatcgcgaggaagaggccattcaccacctggtcctcaccgcctccgacgggggtgaccctctccgatctggcactgtccttgtcagtgtgactgtcttcgatgcaaatgacaacgcgccggtcttcaccttgccagaataccgagtgagtgttcctgagaatttgcctgtgggcactcagctgctgacagtcacagccaccgacagggacgaaggtgccaatggagaagtgacatattcattccgaaaattacctgacacgcaattgttgaagttccaactaaacaaatatactggagaaataaaaatatcagaaaatctagattatgaagaaaccggtttctatgaaatagaaatacaagcagaagatggaggagcatatcttgcaactgcaaaagtgttgattacagtagaagatgtaaatgacaacagtccagagctgaccatcacgtctctatttagtccagtgactgaagattcacctctgggaacagtcgtagcccttttaaatgtgcatgatttagactctgagcagaatggacaggtaacctgttccattttggcgtatctaccatttaaattagaaaagtccattgacagttattacagattggtgatacacagagcccttgacagggaacaggtatcctcttacaatatcacagtgacagccacagatgggggaagtcctcctctatcaacggaagctcactttatgctacaagtggcagatatcaatgacaacccacctaccttctctcaagtctcctactttacctatatcccagagaacaacgccaggggtgcctccatcttctcagtgacagcgctggacccggacagcaaagagaatgcccagattatttactccctggctgaagacaccatccagggggtacctctgtcctcatacatatccatcaactcagacactggcgtcctgtatgcactcagatccttcgactatgagcagtttcatgagctacagatgcaggtgacagccagcgacagcggggatcctccactcagcagcaacgtgtcgttgagcctgtttgtgctggaccagaacgacaatgcgcccgagatcctgtaccccgccctccccacagacggttccacaggcgtggagctggcgccccgctccgcagagcccggctacctggtgaccaaggtggtggcggtggacagagactccggccagaacgcctggctgtcctaccgtctgctcaaggccagcgagccgggactcttcgcggtgggggagcacacgggcgaggtgcgcacggcgcgagccctgctggacagagacgcgctcaagcaaagcctcgtagtggccgtccaggaccacggccagccccctctctccgccactgtcacgctcaccgtggccgtggccgacagcatcccccaagtcctggcggacctcggcagcttcgagtctccagctaactctgaaacctcagacctcactctgtacctggtggtagcggtggccgcggtctcctgcgtcttcctggccttcgtcatcgtgctgctggcgcacaggctgcggcgctggcacaagtcacgcctgctgcaggcttcaggaggcggcttgacaggtgtgtccggctcgcactttgtgggcgtggacggggttcgggctttcctgcagacctattcccacgaggtctctctcaccgcggactcgcgaaagagtcacctgatcttcccccagcccaattatgcggacacgctcatcagccaggagagctgtgagaaaaacgatcctttgtctttgttagatgattcgaagtttcctatagaggataccccattggttccagtgagttttattttcatttttacttttgttaaaaaaaaaaagattggtttttactttgaagtttgcggcatgatggtggaaagtgtaaatgctaaaacactgatgagtagaatttgatgtttattaaggttttttttttttttttttttttttttttttttactttctggtaaaattcacctagtctcaatcaaggcctatatatcataaggctttgttatgattagctttgcagaaccttgtagtttatagtgttgttgagtacaatattgacaattcctaagacagacttccatacagaagtgcctgtcaatttatatttcctcctgggtggtcacatattgaaactccagccccttaagcaaccctcttgttctgaaggcaggtctggtaagaataggtaagtatcagaaagaaatcacctctggaaacacaacccaaatccaagaatactcaatgcagttcttcccaaggagaagggcaataggcctttttcaaactacattttatatatttttcaatctatactttgtggtgatagttgcagttgaatatactaagtttttcattaatattgaattaacaatttatttataacaatgtatgcttagatttttccagccctatttataactgataacactgcagtatcctttttgcatacaattctctaatttcacactgctatgtggaagatatagcattttaatttaactttcattgctcaatagggatcctgaggaggctatagagggtgaaattaagaatatttgggattctgcttttgtcttttttgttaaattttctagtgactaaggctgaaagtaaatatgggttgggaagacagataaatttgtacatgttcccgagaacaggagcaagagatatatgacaaagctatttcagtggctctttaatgtataaggaggcaaacacctgaaactctgaaaactctgaaattgagaggcaaaataaacttagagtcaagaaagaaatgccatttctgcagatcagaatataaacaccaaccacagctgtaaaaaagaaaagaatatatgcaacgaagggaaattatataaacaaaggatcattggaggtactgatgagttcatttagttcaatgaaaatagtgacgtattaggtagatctcttaattttattactagtattctactaaatgtggtagtataaagtcaaaaagcattccgaagtttctcaagacccttataattccatgatttttttcaggtcagtcaacatttgttgaatgataggtctgtggaaggaaagcacactctttagggtcatagttattaactattaaaccattgaaactattattttatatttgtgttaatgagagtcaaaattattgtgcattcatctcaaataattctattattttgaaaaatacaggttttttttttaaaaaaaactgctcttgacattgtagctattgtgagaaaatattttgattataattatttaaaagcaatacaggacaccctggatgatggtaatgactagggcaatggttgcattccagtacttaagtatgaaataaggaattattactttctgggtgaatataggctagaattgaagacaaaaaaatttgttgcttatcttcagtacttccagcttcatagataattactcttaaaaggaacaagaatgactgcctctggatggaggaattggatagcaatgggccgtgggataggagacctataaaccttcatgctatattattttgtgcctttttaaattttgaagaaaaaatattcatttattcaagatatatgtaaattcagtaaataaaaagatatgatagttatgaccaagtggaaatatatttcctgatgtaaaaggaatcactgaggaaaaagattaaaatattttggctgtcaactcgtagtttaaaaaaaattccttgaaagaggtagagaaaagtcaagttgcagtcccacacagagcctctgggcgccgccgtcggccagtgcagagcaagcgctgacgccggggatccctcagcctctagcctgggattccctgcgcagccaacaacagaaaagaaaaccagctcccacacagaggctcccggctgcgcagaccttgcccagcacaccagattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtactatttcctttgctgctgcctttgttctaccccacgctgtgtgagccgatccgctactcgattccggaggagctggccaagggctcggtggtggggaacctcgctaaggatctagggcttagtgtcctggatgtgtcggctcgcgagctgcgagtgagcgcggagaagctgcacttcagcgtagacgcgcagagcggggacttacttgtgaaggaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaattccggaaagatgaaataaacttagaaatcagtgaatccgtcagcctggggatgggaacaattcttgagtctgcagaagatcctgatattagtatgaattcgctgagcaaataccaactaagtcctaacgagtatttctcattggtggagaaagacaatcctgatggtggcaaatatccagaattagtattgcagaagactctggaccgagaaacgcagagcgctcaccacttggtactgaccgccttagatggtggggaccctccccgaagcggtactgctcagataagaatcctggtaatagatgccaatgacaaccccccagtgttcagccaggacgtgtacagggttagccttcgggaagacgtgcctccaggcacctccatcctgagagtgaaggccactgaccaggacgagggcatcaactcagagatcacttattccttctttggtgtggctgacaaagctcagcacgtgttctctctggattacactacaggaaacattctaactcagcagcctttggattttgaagaagtagaaagatatacgataaacatagaagcaaaagaccgaggatctctctcaacacggtgtaaagtaattgtagaagttgtagacgaaaacgacaacagcccagaaataatcatcacgtcactctctgatcagattatggaggattcccctccaggagtggttgttgccctcttcaaaacacgggaccaagactcaggggaaaatggggaagtcaggtgtagcttaagtagaggtgttccatttaagattcattcttcttctaataattactacaagctagtaacagatgaggccctggatcgggagcagaccccagagtacaacgtcaccatcgcagccacagacaggggcaagcctccgttatcctccagcaaaaccataaccctgcacattactgacgtcaatgacaacgcgccggttttcggacagtcagcctacctggtccacgtgccagaaaacaaccagccgggtgcctccatagcgcaagtcagtgcctctgacccagacttcgggctcaacggccgtgtctcctactctctcattgccagcgacctggagtcacgaacgctgtcgtcctacgtgtccgtgagcgcgcagagcggggtggtgttcgcgcagcgcgccttcgaccacgagcagctgcgcaccttcgagctcacgctgcaggcccgcgaccagggctcgcccgcgctcagcgccaatgtgagcctgcgcgtgttggtgggcgaccgtaacgacaacgcaccgcgggtgctgtaccctgcgctgggtcccgacggctccgcgctcttcgacacagtgccgcgggccgcgcagccaggctacctggtgaccaaggtggtggccgtggacgcggactcggggcacaatgcctggctgtcctaccacgtggtgcaggccagtgagcccgggctcttcagcctggggctgcgaacaggcgaggtgcgcatggtgcgtgctttgggtgacaaggactcggtccgccagcgcctgctagtcgctgtaagagatggaggacagccacccctttcagccactgccacgctgcacctggtgttcgcagatagcttgcaagaggtactgccggatttcagcgaccatcccacaccctctgactcccaggctgagatgcagttttacctggtggtggccttggccttgatttctgtgctctttctcctcgcggtgattctagctattgctctacgcctgcgacagtctttcagccctactgcaggagactgctttgagtcagttctctgctccaagtccggacctgtgggtccccccaactacagtgagggaacgttgccctatgcctataatttttgtgtgcctggggatcaaatgaatccagaatttaattttttcacatctgttgatcattgtccagccacacaagataacctcaacaaagatagcatgctactggctagcattttaactcccagcgttgaagcagataagaagattcttaaacaggtaagtatttaaaaatgtatttaatcctttttatattacaatatgccaatatattccaatatagtggtattattttaagattctagataacttcttcatagagttcgcaaaatataggtcaaatttatggttatcattattaaaacaaaagtttaaattaaatgcctcagtcttcctactattcaaagacattttaaagcaaactacatgggtaatctccggtgacatttttatgaagtaaaatacctttcggttaaaaatataaaatacaggtatatttttacggcatggtattttaattgaaaccctgatgctactcaatttttctcaagtatttcatcttcatttactcaataaaggaaccttgtaagaattatagttaggcatcctacctgatgattttatcgggaccgtattatttccacttccagaaatgtcgttcctttcagtcggttaaaatcaattggaaccaactacaacctacaagttttcagctccagtaatattttgaaaactttttaaaaattaagcaagcccttttaataattactcctttcgcaggtgttcttggtaaagttttaacgtcacataatgtaagtattgtgtatcatcgtttttaagctctacaaatacgtgtgattcacaaaggtgagcgtaatcatttcttctggaatttcttagtcgttgcaataataagaatgggctctaggcgccgctgctcaccaatcagggaatgggaagctgcgcgccattgagtccctccctcccccgcctctaccacacaaagcggaatgagatggatactcacagatcctgacactggagacttagaagtattttccttcgctttctgatatattttggatgtagtcggcctaggacttcatagatacataagccgattcacaaccaaccagctcgagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccccgggagctggcgaagcgcggagtccgcatcgtctccagagggaagacacagcttttcgctgtgaatccgcgaagcggcagcttgatcacggcaggcaggatagaccgggaggagctctgtgagacggtgtcctcctgttttttaaatatggaacttctcgtggaagacaccttgaagatttacggagtggaggtggaaataatagatattaatgataacgcccccagcttccaggaggacgaagtggagataaaagtcagtgagcacgcaattcctggggcgcgatttgctcttcctaatgctagggatccagatgtgggcgtgaactccctccagagctaccagctcagccctaataattacttttccttgcaactgcggggcagaacggatggggccaagaatccagagctagtactggagggaagcctggaccgagagaaagaggctgctcacctgctcctcctcacagctttagatggaggcgatcccatccgaaagggcgcagttcccattcgtgtggtggtcctcgatgtaaatgatcacatcccaatgtttacacagtccgtatatcgcgtgagtgttccagaaaacatcagctccggaactcgggtgctgatggttaatgcaacggatccagacgagggaatcaacggggaagtaatgtattcatttcggaacatggaaagcaaggcttctgaaatattccaattggattcacaaactggagaagttcaagtacgggggtctctggattttgaaaaatatagattctatgagatggaaattcaaggccaagatggtggaggtctctttaccaccacgacgatgttgatcactgttgtggatgtgaatgataacgctccagaaataactatcacctcttctattaattcaattctggaaaactctcctccaggtacagtgattgctcttctaaatgtgcaagatcaagattctggagaaaatggtcaagtctcctgttttattcctaaccacctgccttttaaattagaaaagacttatggaaattattacaaattgataacaagcagagtgctggacagggagttggtccagagctacaatataacgttgacagccacagaccagggaagcccgcctttgtctgcagaaactcatgtctggctgaatgtggcagatgacaacgataaccctcccgtttttcctcactcctcttactctgcctacattcccgaaaacaaccccaggggtgcctccatcttctcagtgaccgccctcgacccggacagcaaacagaatgccctggtcacttactctctgacggatgacactgtccagggggtgcctctgtcctcctatgtctctattaactccaacactggtgttctctatgccctacaatccttcgactatgagcagtttcgagacttagaactgagagtgatagcacgtgacagcggggacccgcccctcagcagcaacgtgtcgctgagcctgttcgtgctggaccagaacgacaatgcgcccgagatcctgtaccctgccctccccacagacggctccactggcgtggagctggcgccccgctctgcggaacctggctacctggtgaccaaggtggttgcggtggacaaagattcaggccagaacgcctggctgtcctatcgcctgcttaaggccagcgagccgggactcttcgcggtgggggagcacacgggcgaggtgcgtacagcgcgggcactgctggacagagacgcgctcaagcagagcctcgtggtggccgtccaggaccacggccagccccctctctcggccaccgtcacgctcaccgtggctgtggccgacagcatccccgaagtcctggcggacctcggcagcctcgagtctctggctaactctgaaacctcagacctctcgctgtacttggtggtggcggtggccgcagtctcctgcatcttcctggtctttgtcatcgtgctgctggcactcaggctgtggcgctggcataagtcacgcctgctgcaggcttctgaaggcgggttggcaggtatgcccacgtcacattttgtaggcgtggacggggtacaggctttcctgcaaacctattcccacgaggtctctctcattgcggactcgcagaagagtcacctgattttcccccagcccaactatggggacacgctcatcagccaggagagctgtgagaaaagcgagccactcttgatagctgaagactcagctatcattttaggcaaatgtgacccgacaagtaatcaggtgagatttatttctctgcctcctaattgttggtgtcttggcacaagtcttttaaggagatgttttttgagcctgttatgaaaactgtttggggggggggtggggcggcatatatttagttcatatatatttagagcaatacatgtgagttttactttgcctttcatgagattacgataatctttcagaacgtttttgtgaaagtcatttttcaatcttggcatattttcttttgatttcaaaggggccattcaactatgctggtttggtttgaagtaagttgaattttagtattatttttctattatcagtgtatgaggctctcaatttattatatatagatacaaattaatgattcacaaacactttttatttccatttcaattttgctgtgccttcactgatttgtagttatattccaccattatttgctattactgctaatgttcaaattttgatcctgttgatttaatagcatgctccctctagctctccttctcatctatctatctatacacatgcacacacacttatacacgtaagcttttctctgagcaattttattttgattcttggtggctggtaatatgcttagatcctgttgactatttcaactttgtctcatttcttcatcctatcaacacagacatattgactggcttttaactactggatttccttgggagataaaatttagatcacattttttcttaagctctagatgtcttttccattactatggtgaagttacattgactgttctgaggaaataattgaattattgaactggtattatttccttttattcttttactttggtgtctgtgtttgtatgtatggaaggttttttaatgtagtaaatccatatatagaaataacttgattttgattcagtgcttctcaaaaacctattttcaaatgtgctaaagatgtctacagatttattcaaatagagtagtttgtgaatatataaatagattgaaggtatttggactttaattaaactgatttagctagtatccttctggctatttttttgttcattttcagtgtagttgggagtcatagattccttctttctttctttataaggtcattcttatggcaaatagtacattcagttcttttattcagaccaacttgttattgaagcttgatagttgcctgacatacatgttatctgaagcaatgtctaggaaagccaaatgaggaaaggagacttatctagggtttttgatcacaggaatcatttccataatcaattcagtcaacactctcacatcacttctaggtatttgccccaaattacttggatatttatgttccctttcaagtttagttttctcatttaggaatttaccttatgtcattagttgtaaactgactatctagggctcggacaaaaataatttcaactgtaggaaaggcaagtcttccaacagatgcctacatttttcttgaagtcaagaaaaatgttcaggtattttgagcatctagggataggatttatacttgtggaattccaaactgagaaaaatgatgtaaggcattgtactttgactggaattagttaaataaaaaggatatgaggtatttggctgggaaaaggagattgttccatattataaaacctcatctaaactaacttcccaagatcgtggagaacaaaaaggaagggttggctttgaaatgtgatattaagagggttatgttgattcggaggtagtgataaagttctgttaaggtataacatatagtcccattaaatagaggataaaaataaaacaccatcacatttcatgttattaattcctatggcaacctactaggctatacctttatattctctttatgatgaaacatgaaacaataatccttttcagaaacctcttttataagtgataagaagggtttggctaactttattctgaatatgccctatatagctttcagtgctcctccagttttctctgataaaactaggaggaaaattatctgcacatcagattgaaaataatactgcatatcatttcatagtggtcaaaattttcccataccacttgatggggatgttttcccacaaggtttttgttctacaacaggagagaagactttgcctagttcttccaatatgtgcattgcttctgcttagaaaaaaacaaacttttaaattctctttgctgggttaatgactgttctatagattcccatctctaaggaatcttctttggtagtaaacactggaaaacagtcactacgaaaactcataaaatgtctagtttcctatacattagtccaacacatcagtctaattctgaatcccattgaattagcaaaggcttccggctgcagttttctaaatagactcagagccctgctgttggccaatgtgctgcaagaactggagcctgggatctaccaggacgatattctgttcagtcacagaagcaagtcggagagtggccaagacttgggctttctgctcctgcaaatctgattccatacggattggggtgccctcaaactgggagcattgagttttctatgtatggaagtaaatattttaaaagcactttgtgaaacattttctcttaacgtcggagactgcagcaacgcatgggaaggatgggaaacagggtgaagcagagaagcaggacccggcagtggcaagcactcttccctttcctgctgcctttgttctgcggggcaccctcggagcagatccgctactctattccagaagaaacggtccagggctccgtggtggggaaccttgcggaggacatgcggctgcatgttcaggatttattgacctgaaaccttagagttagtgcagagaaacaatactttaccgtgaacacggagaatgggaacatacttgtgagtgacagaatagatcgagagtcactgtcttcaaaatcctctgtgtcatacccttagagattgtagcagagaatcctctaaatgtttttcacataaatgtgatgatagaagatataaatgataacccacctcattttccccaaaatagcattgttttacaaatcaatgaactagcaattccaggcattcggtttggcctggaatctgctatagatgcagatgtagggcctcactctctccagagttaccagctcagttctaatgaacatttctctctgatgatggacaagactaaaggcaagaacgctccagaattagtgctggagaagcccctgggccaggagcaacagagctctcatctcctggtcctggaagcaatggacatgggtgacccagtcccaactggcactgctgcaattcaaattgaggtcactgatgccaacgataatgccccagtttttagccaggatgtatacaaagtcagccttagagagaatgtgcccccaggcacctctgtactaaaggtgacagccactgaccaggatgagggtgtcaatgcggagatcacctactctttcaaatccctacgagatgatattggaaatatgtttgtgctagaccatcaaaatggggaaattaaatccaaagacttaatagacttcgaatttcgtagcagttataccatgagagtagaagctaaggatggtggaggcatgaccagcgaatgtaaaattatactagaaatcctagatgagaatgacaatgccccagacgtggtttttacttcagtgtccagttctgtaactgaggacgcagaaccctggacggtgatcactctgttcaaaacacatgataaagattcgagagaaaatggggaggttacatgcctcataaacgaaagagttccttttagaatcgaatcttccgccaataatgactataagcttgtaacagatgggaccctggattgggagcggatcccggagtacaacgtcaccatcactgccactgacaagggcaagcctccgctctcatccagcacaagcctcaccctacgcattggtgaagtcaacgacaatgctccggttttccaccaagtctcctacgtggtccacgtggccgaaaacaaccttcccggagcctccatcccacaagtcagcgcctctgacctggacctagggctgaatggccaagtctcctactccatcgttaccactgacttggagctgcgggcactgtcgtcctacgtgtccgtgagcgcacagagcggggtggtggtcgcgcagcgtgccttcgaccacgagcagctgtgcgccttcgagctcacgatgcaggcccacgaccagggctcgcccgcgctcagcgccaacatgagccggcgcatgttggtgggcgacctcaatgacaatgtgccgcgggtgctgtaccccgcgctggggcccgatggctccgcactcttcgatatagtgccacgcgccgcagagtccggctacctggtgaccaaggtggtggcggtggacgcagattcgggacacaacgcttggctgtcctaccacgtgctgcaggccatcgagcccgggcttttcagcctggggctgcacacgggaacctgctggttgctgtgcgtgacggaggacagccgccgctctctgcgccgctacgcttcacctagtcttcgcagacagcctgcaggaggcactgccagacttcagtgacagtcctgtgccctctgattcccaagcaaagctgcagatttacctggtcgtggccttggccttgatttctatgctcttcttcctcgcagtgattttggcggtcgccttgcacctgcgatgctcttccagcccctctgcctggggttgctttcaccctggtctctgttctaagactagaccaggggtttttcccaactacaatgagggaactttgctttattcctgcaatctgtatgttccctcggattctagaaaaagaagatttaattttctcaccatgacaccagaaacagtccccccacaagatctttctaatgaagtttctctggtagcaagcttcactgaagagaataacaagataagctctaactctgttgctcctactcacgtgagttccaatgaatgtctttcatttacaaatggatgaggtttaattttcaaaccaatattttggcaagaaaatcttaaacatattatatctactattgcttcaggtttgtttgcccactcttaatatttcctgttcctttctgtgtgggccagtaacttcattattagctttcatgtatttttgaaacattttcaccatttttacgggagactttttttttttttggacggagtctcgctctgtggtccaggctggagtgcagtggcatgatctcggctcactgcaagctctgccttccgggttctggccattctcccgcctcagcctcccgggtagctgggactacaggcgcccgccaccacgcccggctaattttttgcatttttagtacagacggggtttcaccgtgttagccaggatggtctcgatttcctgacctcgtgatctgcccgcctcggcctcccaaagtgctgggattataggcgtgagccactgcacccggcccggagacattgtttatacacacacacacacacacacacacacacacacacacgtgtgaaaagtgggtattatgatactgctgtcattgagatattttaattgaggaataaatttttttcctgtgatgtttcttgggacatcaatatttgagtatataaggctttttctttaatccattaactataaattttgaagaaaatgcatgagaaaatggagaaaatgtgttttttttttaaaaaaaattgagattaaggtctcattatgttgcccaggctggactcaaactcttgggctacagtaatcctcccacctcaatctccagagtagctgagactacagttgcctgaaactgtgcctggcagagaaaaaagcttaaaaaaataagaacatggtaatgatttgataatattcagttacatttacttttgattcttgtaattcaagtaaactcaattttatgtctgatattttctcacagctacctatatatttcttcccaatttaaaatatattattttattttatgcctagcaaatatctttacagtataaatatttacgctcatgaaagtacgtagccagttatttcttagggagaattttttccctatattttgatgggcttccaaaagtattaccagtaattctcagtaattacaattaggtcagttacccaggaaaaggtaagtctgtaacattctttggactaccaattttcttttactaagtttcctgaacaataaatatttttgaaatataatgtattaatagaattctggagtacttccattatttccagtcaatgcaagttggaatgcttctactttatgctaaaaatattaatgtttctttttcacttgggttcttgttaagtgtgattctgataatgtatacaatcacatatcatttttaggtttccataatatcatgaaaatttgatttttaagcgttacatgtcaacaacctggtaaagtaatccttccattcaggatcattcaaggaatctatttaaaaatattttccccaaattatagctgaatcagaaagtttaaattattatattatatgatttgtcaaaaagagaaactcctagggagacatctccataataggtgtgttgggggaacagtaatctcaaagcagatgcactaacattataagattaaaatcattgtttatagaaacttccaattcatttaaaagctcattggggaaaaaaaagctcattgggaaaaaaaaaaaaagctcactaaagtttctattaaagcgaatacggtagatttccatccccttttgaagaacagtaggtggagctatttaagatataaaaacgaaatatcctttctgggagttcaagattgtgcagtaattggttaggactctgagcgccgctgttcaccaatcggggagagaaaagcggagatcctgctcgccttgcacgcgcctgaagcacaaagcagatagctaggaatgaaccatccctgggagtatgtggaaacaacggaggagctctgacttcccaactgtcccattctatgggcgaaggaactgctcctgacttcagtggttaagggcagaattgaaaataattctggaggaagataagaatgattcctgcgcgactgcaccgggactacaaagggcttgtcctgctgggaatcctcctggggactctgtgggagaccggatgcacccagatacgctattcagttccggaagagctggagaaaggctctagggtgggcgacatctccagggacctggggctggagccccgggagctcgcggagcgcggagtccgcatcatccccagaggtaggacgcagcttttcgccctgaatccgcgcagcggcagcttggtcacggcgggcaggatagaccgggaggagctctgtatgggggccatcaagtgtcaattaaatctagacattctgatggaggataaagtgaaaatatatggagtagaagtagaagtaagggacattaacgacaatgcgccttactttcgtgaaagtgaattagaaataaaaattagtgaaaatgcagccactgagatgcggttccctctaccccacgcctgggatccggatatcgggaagaactctctgcagagctacgagctcagcccgaacactcacttctccctcatcgtgcaaaatggagccgacggtagtaagtaccccgaattggtgctgaaacgcgccctggaccgcgaagaaaaggctgctcaccacctggtccttacggcctccgacgggggcgacccggtgcgcacaggcaccgcgcgcatccgcgtgatggttctggatgcgaacgacaacgcaccagcgtttgctcagcccgagtaccgcgcgagcgttccggagaatctggccttgggcacgcagctgcttgtagtcaacgctaccgaccctgacgaaggagtcaatgcggaagtgaggtattccttccggtatgtggacgacaaggcggcccaagttttcaaactagattgtaattcagggacaatatcaacaataggggagttggaccacgaggagtcaggattctaccagatggaagtgcaagcaatggataatgcaggatattctgcgcgagccaaagtcctgatcactgttctggacgtgaacgacaatgccccagaagtggtcctcacctctctcgccagctcggttcccgaaaactctcccagagggacattaattgcccttttaaatgtaaatgaccaagattctgaggaaaacggacaggtgatctgtttcatccaaggaaatctgccctttaaattagaaaaatcttacggaaattactatagtttagtcacagacatagtcttggatagggaacaggttcctagctacaacatcacagtgaccgccactgaccggggaaccccgcccctatccacggaaactcatatctcgctgaacgtggcagacaccaacgacaacccgccggtcttccctcaggcctcctattccgcttatatcccagagaacaatcccagaggagtttccctcgtctctgtgaccgcccacgaccccgactgtgaagagaacgcccagatcacttattccctggctgagaacaccatccaaggggcaagcctatcgtcctacgtgtccatcaactccgacactggggtactgtatgcgctgagctccttcgactacgagcagttccgagacttgcaagtgaaagtgatggcgcgggacaacgggcacccgcccctcagcagcaacgtgtcgttgagcctgttcgtgctggaccagaacgacaatgcgcccgagatcctgtaccccgccctccccacggacggttccactggcgtggagctggctccccgctccgcagagcccggctacctggtgaccaaggtggtggcggtggacagagactccggccagaacgcctggctgtcctaccgtctgctcaaggccagcgagccgggactcttctcggtgggtctgcacacgggcgaggtgcgcacggcgcgagccctgctggacagagacgcgctcaagcagagcctcgtagtggccgtccaggaccacggccagccccctctctccgccactgtcacgctcaccgtggccgtggccgacagcatcccccaagtcctggcggacctcggcagcctcgagtctccagctaactctgaaacctcagacctcactctgtacctggtggtagcggtggccgcggtctcctgcgtcttcctggccttcgtcatcttgctgctggcgctcaggctgcggcgctggcacaagtcacgcctgctgcaggcttcaggaggcggcttgacaggagcgccggcgtcgcactttgtgggcgtggacggggtgcaggctttcctgcagacctattcccacgaggtttccctcaccacggactcgcggaagagtcacctgatcttcccccagcccaactatgcagacatgctcgtcagccaggagagctttgaaaaaagcgagccccttttgctgtcaggtgattcggtattttctaaagacagtcatgggttaattgaggtgagtttatatcaaatcttctttcttttttttttttaattgctctgtctcccaagctggaatgcagcggtacgatcatagctcactgcagcctcaaactcctaggctcaagcaattatcccacctttgcctccggtgtaacagggactacaggtgcaagccacctactgtctgcctatctatctatctatctatctatctatctatctatctatctatctattactttcttgtacagacaggagtctcactatgttgagcaggctgatctgaaacttgggctcaggctagcctcctgcttctccctcccaaactgctgggattacaggcgtgaaccacagtgccccgcccttatcagatattcttttctggctgggcgcggtggctcacgcctgtaatcccagtactttgggaggccgaggcgggtggatcacctgaggttgggagtttgagaccagcctgaccaacatggagaaaccccgtctatactaaaaaaatacaaaattagccgggcgtggtggtgcatgtctgtaatcccagctacttgggaggctgagtcaggagaattgctttaacctgggaggtggaggttgcaatgagctgagattgtgccattgcactccagcctgggcaacaagagtgaaactctatctcaaaaaaaaaaaaaaaaaactttatcctctagtttcatccattgatgacacttgctttaatcacttattacaatcacctccaaatgaagattttataattccattgtttcttctacagttgttaattggctttctaccttgaagaagagttttatattctctatatatgtttgtttctatgattctggaagcatggttttctattttattcaatggcctgtaatctgttaatatcaattatttattttgatgctgaaattgtcccaggattggcctttgggactccctttaggctgatttctatgtcctttctgttacagcaagcttgggattatatccaagatttgtaattccaatgtacttacttctgtcagtgtaaacaaagtacgatttctggactagatgacttgggcattgtgggggaggtggaaattagaggtattctctgtttttcctgtaggatcttgcatttcttcctcttgctgcttgtctctttgtgtcgggaacaggccccccaaaatctggccataaactggccccaaaactggccataaacaaaatctctgcagcactgtgacatgttcatgatggccgtaatgcccatgctggaaggtagtgggtttaccggaatgagggcaaggaacacctggcccgcccagggcagaaaactgcttaaaggtgttcttaaaccacaaacaatagcatgagtgatctgtgccttaaggacatgcccctgctgcagataactacctcaatccatccctttatttccgcccatctcttcgtttcccataagggatacttttagttaatctaatatctatagaaatgatgctaatgactggcttgctgttaataaatatgtgggtaaatctctgttcagggctctcagctctgaaggctatgagacccctgattccccacttcacacttctaaaaaaaaaaaaatttttttttctgagcttggagaaatatatcccttagtacacttggcatttataaagcagacatcaataaatttatatatatgtgacagataccaacaacaatccagtccccttccctcataccttatttatgtacatatattttatataatagatataatttattaacaatttataaaattactttgttaatactctatatcattttctagctgaatttatcaatgataatgctcttttcccacttttatttttttcccattgaccatgcagcagttttgtgtagaccgtctgataacaactgatctgtttatctaggggggagaaatctaattcaatggaaaatataaataaaattgtgataaacttttgtaaatagagtggcttttaactacacttgagatggctagcaaattcataaagtgaatttactttctttcaaagttcagtaattctttctggccattagggatatgtccatttatactttctcagtatcccaagtcatttcatggttttaaatcattcatgaacttccaaatatagtgaatttatttcttctgcatttaaaattttatcacttaaatatacaatataccgtattgccatgacgaaaaatggtaaagactatttttcacttctgttatgcatttcattaatacgatatctgtatgtgtttccaagttagacatttcttttgcccatttcctacactaatgatactaatgatgactttgtggaatattcagaattaacaaaatgtgttttgagtgctttttttagtactggggcaaatttgcagtaatatcgcctgctttttacattaaattccccataacttttacaactatgggaaaatttctgaaacgtgcacagattccaagtgttttctgagaactttatgcttattgtagagtggttacagacactgaatgctaaagtgtattactctttgaaaagcattgcttgatttcttttggtgaattctgtaaaggtgcagggaaacataacgtcccaattattttttctttcttctttgtttgctgcctatctactttgaaagatacaatagttaaaacccagaaaagagattggaaaccccttagagaatgaaagacatccaagggctctaaaatgcggcagttgctgcttctgagaccaaaaaagggggcaaaatatagagtgtgtggttctacttgtgtgattttttgaaagaaagtatttgaatttatctaaaaatactaaatttgtatttacattagttttcaaatagaatttaataagtacagtgttctataggtaatattgagagaaatagaggacaatgaaacctctctcctccatcatcttgtatgaactaccaaaatgtttatcatatggacagttctcatatatagtcaaatagaaagaaagacataataggaaaacaaatgacttgggaaactaagctaacatggtctaattattctgacctctgctcacctaacttgatttaggaacaaatcattgagagttagagcatgaatagtcaagactgttagaccatatctcaaatatcagtgacttcaatcaactatgtttccagtttaagctgaataggctttattaaatagttgttgaatgaatggataaacaaataatgtactctggggattacctgataccaggattctgaattttcagatgtatcatagaaggatagcagctttgcaattaggtaaattgttaactgtgtcacctttagcaagttatttaatctctttgagcttcagcaaagtaggaataatcatatctaatttgaaaggtcgtggtgatggctagggctaacaaaaatctgattcacaacatgcaattaattaacagtagccatttttagtggttgaccaaaaaaaggatttatattttcaatgccagcacactcgatgttctgttgggaaaaataataatgatttttgtgtgcttctccatatggtataatggaatgatttgtggatggaaataaaactgttctaaaatttttgtgacagctggtttaaaaatcttaagtgcctaggcacattcttgattgagaagccacagttttaggccataaaagatgggggaaagatttttatatgagacaattttgtgagtgttactttttctttgtctgaaccatagtgaaatctaaacaaggatcttgtgaaacttattttaaagaagcagtttacttcaatgggatcttagataatttcaccagaaaatggatcaccgaaaccagaaggctggtgatcattatttggtttgggccatataagaattgaaactaacggcttagctttaggatttttaggacacttgttgataatttaggattcataattaacatatgtgttgattgttttctgagactaactgggcaatgggtttggatgtgtttacatttattctgattccagtcataaaattatgtcaaggactttccttgtctttttatgtgtatgacagatgtgtatgtatccatttcatctaacaagttaaagcgttcagctataatttaaaatttgtagcttcactgttttatagtacctaaaattggaatgtaatcagtcagaagacattcatccactgctttcattccagaagtattatgctttttgaagcagcaatagcataggaatgttgaggagactatactatacttttatagcatatttaatctcgtagatcacttttcaatgaattataaggctgatgacaaatgagcaaattgtatcagttttctttatgacatgtaacagagtatagctgtgatcatgaattggatagttctggtgtaaaaatctgctttatccccatataagatgtcaggttcagaaaagcaaacacatagtttcgaagagatgttgatcaaactgatgaggctaaatctcaagaaagagacacagttaccctctaatgttacactttgagttcacctttttttttttttttgagacagagtctcaatctgtcgccaagctggagtgcagtggcactatcttggctcactgcaacctctgcctcctgggttcatgctattctcctgccttagcctcccgagtagctgggactacaggcacacgccaccacacccagctaatttttgtatttttagtagagatggggtttcaccatattggccagaatggtcttgatctcttgatcttgggatgcacccaccccacctcagcctcccaaatagctgagattacaggtgtgagccaccatgcccgaccactttgagttcacttttaagaaaccatacttaatggaaaattaccagtaacagggcatactgtttaggatgcattcctaaaatattaatggcaaaagatagccagcctatggcaaagctaattggaaaaaatattttataaaggatgagacttctggataccatatgggaagggctctggttcaggaaaatgtttttaaaaaactgtcattgaagagaccatagaatcaaacaaaataatttaatctgtatgtaaaagaagttggtaccaccataatttttcttatacatgtcatataaggatctactctgtgtattgtcattgagggcagatataatttcttagttcatcattaactctctgaagtatttcacacagtagtttgtacaccttctaagtactcaatacaatgcttgagttcaattattggaaagtggtctcttggagaaaaaagaatcatagtgcaaaaccaattattttacatggacttttcctctatatctaagccctaataagaggcagctgtctgatatacatacatacatacatacatatatatatatatatatatatatatatatatatatatatatatacacacacacacacacatatatgtatatatatatttggagtaggggatggagtcttgctctgtcacccaggctggagtgcaagtggtgtgatctcagctcactgcaacctctgcctcctgggttcaagcgattctcctgcctcagcctctccagtagctgggattacaggcgcctgtcaccatgcccagctaattttttaaaatatttttagtagagacagagtttcatcaagttggccaggctgctcttgaactcctgacctcaggtgatccacctgccttggcctcccaaagtgctgggattataggcatgagccaccgcaccctgccaactgtctgacttatcttaaaaggctaaggacctggtttgtttgtcaaattttgaaaatagatgcctcagttcataagatttccatattgtgtggcaggcgcctgtaatcccagctactcaggaggctgaggcaagagaatcacttgaacccgggagacagaggttgcagtgagctgagatcacgccactgcactccagcctgggcgacatagtgagactctgacaaaaaaaaaaaaaaatccatatgtgaaaattcttagaagcttcctatacaatttcagctgaagattcagccaacagttcattctgagactgtgttccatggaaaaagtaaagcccaggcatggaagtgggaatggaaagaaagattctaagcctacaaatactcaaacatcaagaagaaataaaaataagtcatcacttcgacttcatgtgctaacatcactgaggttataaattcccaggaatattttattgcgggagcaagactgcactgctgcctttcagcttgcaaattccagtgagaaacgtctttctctctgctctcaactaactctacagaacgctgtcctctcatttcttcaggctgcagttctagagtagggactcagagtgccactgttggccagtctggaaacagagataaatgagccaatccccagacattccggcttggtggcttttctaatttcatggaatgcaaatccaagagcagacccacaacattcctattatggctcctagttctacaaattataagcaggaacggaacggatttacaggcaatgagttcagctccttcttggctggagattctataatccaagaagagtttgaaaaggggcttatttgggctggagcagcagcaactctaactgtggaaaaggtggggaatggtgctggactgacagtctgggtagaaccaaggcgactactgcctcctttcctgctatttctatcctgctgggcattctctatgatgcagatccgttattcagtcctagaggagctggccaagagtttggtggtgggaaaccttgccaaggatctgggactcagtgtcgaggacatgcccacttgaaagcttcgggttaatgctgaggaataatacttcattctaagtggggaaagtggagacttacttgtgaatgactgaatggatcaggagcagatacgccccccaattatagcttgggccataacgctttgaaatagttgaaggccaggcatggtggctcacacctgtaatcccagcactttgggaggccgaggcgagcagattacgaggtcaggagttcgagaccagcctgaccaacatagtgaaaccctgtctctactaaaaatacaaaaattactgggcatggtggtgcaggcctataatcctagctactcggggggccgaggcaggagaatcgcttgaacccgagaggcaatcgcaccactgcactccagcctgggtgacagagcaaggcgccatctcaaaaaaaatgaacaaacggtagttgaaaattctttaaatgtttttcacattaatatggagattcaggatatgaagaatcatgcaccacggttcagcaggaatgttattaagttacgtatctctgagtttacccagctggaacaagatttgcaacagaacctgcagaagatcctgatgttgagagaaattccttacaaaattatcaccttagcagcaactctatatttctctttgaagtaaaagtgaccaacagtggaaagacatatgttgatcctgtgttagagaagctgcttgactaggaaaagcagagctcccatcccttagtgctagcagccttagacggccccccaacaaagcagcatcactcaactcctgatcctattggttgaagccaatgacaaccctgtgttcatctaggatgtgtacagcgtcggccttcaggaagatgtgcatccgggcactcctgtgctgagagtgagggccaccaaccaggactagagtgtcaaggcagagatcacatatggcttcacaacccagagtacccatatctagtttggccttgatcaaatagtggagaaatgaaaactttaagtacattggacttttaaagatttttaatttccatggttttggtagcaagtgacagagagggactcattgtccagtgtacagttgagaccgaatttctagaagataatgacaatatcctagaggcgatttttacttctaattccacaatgattcccaaagattctgcaccttggacagtaatcactgtccaggatttaaatcacaagatctttaaatcacaagatctggattcgggagaaaacgaggtcacatgtctgatataagaaaatgcaccttgagaaaaatcttcctccaataattaactacatgcttgtaacaaatggggccgtggaccaggaacagacccaaggtataacatcagcatcactgccactgacagaggcaaaccaaccctctcgtccagcccaagcatcaccctactcattggcgatgccaacgacaatgctctggttttctaccaggcctcctacgtcgtccacgtggccaagaacaatcttcccaaagcctccatagtgtgcaagtagacacctccaacctagacttgggacccaacagccaagttccctattccatcgtggccagtgacctggagccacaggcgctgtgattctaggtgtccttgagcgcacagtgcgccttcgaccaagagcagccgcgagccttcaagctcacgctgcaggcccgcgaccaggactagctcgcgctcggcgtcaacgtgagcctgcgcgtgttggtggacgacctgaatgacaacgcaccgcgggtgctgtaccccagctctggagcgcaatggcttcgcgctcttggatatggtgctgcacgccgcggagcctggctacctggtcaccaaggtggtggctgtagacgcagatgtgagacacaatgcgtggctgtcctaccacgtgctgcaggccagcaagcccaggctcttcagcctggaatgcgcaccgacgaggtgctgacagctcgcacgatgggccacaggaaagcgactcgccagcgcctactggtcgcggtgcactgcggtggacagccgctcctctcgctaccgccacgtcaccaccactaccgcccctcgtcgccgacagcctgcaggagactctgccagacctcagcgatcactctgcaaagctacagcctgaatccaaaattaatttatatctggtgattgccttagctttaatttcctttttattcttcctgattgcattgtttgtgctggttttaaagtgccgaagaccccaaaatgatcctgtctgagtctttcccacggatgtctatcccgcgctaagccccaggtttctgggtaactgtagctctatgatgccatattcctaccaggtgtgtgcttctcctacgaatccagggctgagtgaacttcttttttgaatccctacccctcaggactcaatagcagtttcactgcagaaagccccttggggaaggggatgattgtgattattctaattgcttgggcagaatccactctccaaggtgaaaaattcttgatgaaactaagttcagtcacaagcaggttttcttctagcattaaatattttcagagatctcagtaaaaagcatttctagcagcaagaccaaaggcctaagatgagaaatatttggcatggtgagcttgagggacagtagtcaggcagacaagagtatcagacatgccagagcatttggggcctgtaggtaaggagcatgttttgattatatatatttgtatgtgtttgattatattttataattttactttgatattcaaattgtactgatccaaaaataagggagggacaaatcttggccattgtagtatgagagatgtaaatttacaactcagaatccctgcttatcacttctccttcagcacacaactgtttcattttctatttaagaaacttcctctcactgcaaaaagacattctggctgataaagttagcctataatttcagtaaatctaagaatatgactaatggaagttgccagacctaaactttgaaaattattgttccactgaagagcgtcttatgactgagtgttccagtctccttctcaagctgaaccttgcttttcaaaccagattaagaacactatcataagttatactgcattttatttccctacccatgtccactgcatcattctctatagtacaaagagcttgtctcgccaggcgcatctataatcttagcactttggggcgccaaggcgggtggatcacttgagcccaggagtttgagaccagcctggacagcatggcaaaaacccatctctacaaaaaaaaaaaacaaaaattaacaaggtttagtggtccatgcctgtggtctcagctacttgggaggctgaggtgtgaggatcacctgagtctggggagattgaagctgcagtgagctgtggttgcgctcctgtactccagtctgggtgacagaattagaccctgtcccaaaacaaacaaacaaataaagagcttctctccttatgacttatttaaagcttgggaaattgttccaattcaaatgctttaaatggacttgagctaaaacagaatgtggtatatgaaatgttcttataatcaggtgattgtaaaaattgatccagataatgttagcatagcattttactgaactagtagtttacaaacacttcaaaaattatagaataacatttgcatataaaattcctcatacatttccctatcagtgaattggaagcttacaatatacaatattaccaaaaagacaaaaaaaatgaaaaggaaacagttacctttggaaaacataattaggtaaaatgggtaatatggaaagtctgaaaactgaaaaaattactgataagtcaagagaaaaggaatattagtaggaaaattcataaaagtgtgtctgactactcacagcaggtttccttattggtatgtattctgtggtccatctaagctatgttaattttattttaaatgctacctgggtattggcttctaaaaggaattcagtaaatcagataatttggcatcttcaatctagattctgatgctcacctgaaaagtctgctaaggattggaaaccaagaaaagtgaagtatctcaacagatatgtgtcacttgtgtgtactggattttttttttttttttttttttttttttttttttttgagatggagtttcactcttgttgcccaggctggagtgcaatggcatgctctcggctcactgcaacctccgcctcccaggttcaagtgattctcctgcctcagcctccctagtagctaggattacaggcatgtgccaccacgcccagctaattttgtatttttagtagagacggggtttctccatgttggtcaggctagtcttgaactcccaacctcaggtgatcttccctccttggcctcccaaagtgctgggattacaggcatgagtcactgcgcccggtcgcgtactggatttatattgtgtaatactttgctctagcagtatagtaggtgagacagtgactgtgtctagtgagcaaaaggcacttatttgacacttttgactcttcctttctacttaccttatttaaaattgatttttgcatgtggcatgatgcaccagttcattgaggtaggggttgaagttatttcccatttttttcaataccatttattaaaaatattttcctctttctgttgaatttgcttggtgcctttgttgaaagtcatttcactgatatatgtagttctatttctatattcttgatcatgtttcatttgtctattcttttactaatagcacactgtctcaattattgtagctttatagtaagtcttgctacaaagtcttactacaggacaaagcttgtaggatttttgaatgggatggcattgcatctatacctttatcagggaaagagggaaggagggaggaggatcatcttaacaatattgacacttcaaatccatgaacatggtatatatttccatttaattaggtctttaatttctctcagctatgttgtatagttttcagtgtagagaggtcatgtatatttctcattaaattgtccctacatatttgatgttttctaatgttattgtaaatagtatttttaaaattgtatcttctaattgttcatttctagtttacagaaaaatgaaaaactatgtttttatgtattctatatgcttttgaaaagtaagaggtgcaaagtgctctattcttacactatattgtgtgagaatataagtcgaaaccactctgcataagttcaggcttccattctcttcagtttgtaggttgagagaacccatccagaaacagtaaacattggtgtctgcccaagtctggtcctgggtggttcattcattcatttacataacaaatatttattaactgtctgctatatgcaaggcactgacctatggactaaggatgcagcaatgaacaaggcatatatgattcctgagttaatgggccctattctaatacatgatattttacaggtctgataaaagccaacaaggagaaatacaaaagcactaagagaaagcttatagtagggaagcttcgcctaatctgaaggtcaaggaaggctttctttttttcggaaagtgatatttagagagatgaatagattaataggatgagtagaagttatctaggtaacaaggaaagtaaaaaagaaattgtcaggcagaggaaatagcatgtgtaaagatctttttaaaaaataaaaggtgtgactcaagcaatttaaaagggctagggaggctagaaacagaaaataaatagatgaaactaataaggcagggagagccttgtaaatcacacttaaaattctggattttgttctaaatacccttgtacttaggagctattaaaatattttaaacaaggcagtgacaagatatttgaattattaagcttactctggctgctatatggagaattgatttatgagggttataaatagaaataggaagataagataggagactatggcaatattcctggtaagaaatggaagaagagctggcttggattaaaggggaggcagtggatgtagaaataaatggatgaattatagatatatttaggaaatgggttcaataagacttaataatggaataggtggaatataaatttcatgagggcagggggtgttttgtttattattatattcctaggtgtctgaaaatattgttgtgttgcctggcaagtggtagatcttcagtgaaatattattaactgaataaatacaatggataaatggggagcagggattaagagtgattcctgggtttccacattaaggaactggatggacaaagctaccatttgatgagaatggaagactaaagaatgatagatttaagagaaatcgagttgagttccagccatgttcatttgaaggatctgagaaacagtgcagatattcagtgtgtgattagacatatggtcatcattcttttttttttttgagatggagtctcgctctgtcacccaggctggagtgcagtggccctatctctgctcactgcaatctctgcctcccaggttcaagtgattcttctgcctcagcctcctgagtagctgggactacaggcgtgcaccaccacgcctggctaatttttgtatttttagtacaagacagcatttcaccatattggccaggctggtctcgaactctgatctgcccgcctcggcctcccaaagtgtggggattacaggcgtgagccaccgcgcccagccggttaccattcttttactctgagttcttccattgtgatcatctagtcagatgggtagatccttataaggctgagcataataagcttcctgatagctctacactggtatgttttggggttcatggctgagctacttttgtgttttatttatcttcctgatctctttttcactgtaagaaacatccagcacccagggaaatttgctgtctaattcatactccactcttcagactagtcctagtgttcagttttgttttgttttttttctgtgtctggaattctattaaaatgtgtcaggctgttttaatttttgttgtttaattttctttcacatgattatatgtgctccatggatttttttgtttgtttgttttttgtttttgtttttgtttaagcggggtcttgctcttgtcgcccaggctggagtgcaatggcttgatctcggctcactgcaacctccgcctcccgggttcaagtgattcttctgtctcagcctcccaagtagctgggactacaggcacatgccaccacacccggctaatttttgtatttttagtagagacgggtttcatcatattggtcaggctggtctcaaactcctgaccctggtgatctgcccacctcggcctcccaaagtgctgggattacaggcgtgagccaccgcacccggaggaaatttttaacctcagtttttcttcaccatctgtaaaactgcatagaaggaatgtttaggataaaagatgcataacaatcataacaaaattgttgggttttaatgttatgagtacacttggaggattctatgtccacacataccttaaacatcctatagagtccttagcattttaaagttgaaaccaacagtatgaatgatggtagaattttcccccccaggaagttagaactgttccatatcttgatagagggatgggttataaggatgtacacattttccaaaactcattgaacttaagagtcttgcatgtgactgtatataaattatactttaattgaaaataaatttaagaaaataaaattggctgggcgtggtggctcacgcctgtaatcccagtgctttgggaggccgaggtgggtgaatcatctgaggtcaggagttcgagaccagcctggccaacatggtgaaactctgtctccactaaaaatacaaaaattagctgggcatggtggcggacacctataatcccagctactcgggaggctgaggcatgagaatcgcttgaacccaggaggtggaggttgcagtgagccaagatcatgccattgctctccagcctgggcaacatgaacgaaatgccatcttaaaaaaaaaaaattaaaagaaaagaaaattagcctcccccaccctcactatacctcagactcacccctgaaagatcactactattcatccctggttatgtacacttacaaacattttctgtgtgtatgcgaatgtatgtgtggggttttctttgcacaacaggatcattttacagtatatatactgttgtgcaacttgctctttccacttaatatctcaaggaatcttttctttgaatctttatagccatgtacctcaatcttagtagttttctttattttatttttgaataggaaatacatttacatggttttaaaaatcaaaacaatatactatgtatatattgagaagtctgacttccatccctatcctactcctattccacccttgcttcctcctgtcccctgtaggtaaacattttataactttattaagcatcctgtcagcatttcttatgcaaatatgtacatatatttttatttccccattttttttacaaaaagataaaatactatacaccactttatatcttcctttcttcacattatatcctttaaaaatatttccatattggccgggcgcggtggctcacgcctgtaatcgcagcactttgggaggccgaggcgggaggatcacgaggtcaggagatcgagaccatcctggctaacacggtgaaaccccgtctgtactaaaaatacaaaaaaaaaaattagccaggcgtgatggcgggcgcctgtagtcccagctactctggaggctgaggcaggagaatggcgtgaacctgggaggcggagcttgcagtgagccgagatcgtgccactgcactccagcctgggcgacagagcaagactgcaactcaaaaaaacaaacaaacaaacaaaaaagaacttccatattaatatatagaaagctgttttttttaacagttgcttagcattcctttggattattaaccagtctcataaatgagcgctattgaatagccctgtacctacatcagtttttacatatgcagtatatctttgggatgaattcccagaaatggaattgaaattgctgggtcaaagaggaaataggtgtaattttcttaggtattttcacaagaagtgttaattctaactttctgttttgaaatgatttcaaattttcaaaggagttgcaagaattgtacaaagaactgtatctccttcacccggatgcaccgggtgaattatatgtattatataattgtatctgtaggccaggtgcagtggctcactcctgtaatcccagcactttgggaggctgaggcaggtggattacttgaggccaggagttcaagaccagcctggccaacatgataaaactccatctctactaaaaatacaaaaattagccaggcctggtaccccatgcctaagggtgaggcatgagaaatgcttgaacctgggaggcggaggttgcagtgagccgagatcgcaccactgcactccagcctgggcgacagagcaagactctgtctcaaaaaaaaaaaaaaaaaaagtaaaaaagttttttaaaaagatgtatctatatatacatatttacatacacacccaagtgtgtatgtatatatgtttgtgtgtatgtacacaaacacattatttttatatgatatgatttttttatgacatgattatttttatgacatttgagagtaagttgtagaaattatgtttctttattcctaaatacctcattgtgtatttcctaacaaggacattcttttatataattaaattttaataataaaaatcagaaaatttaacatcaatgcaatataattatttagcctatagtccatatttaaattctaccataccttatagtatattttactatacctcatagtaattttttttagtccaaaatatcacacattgcatttagttgccatgtctctttttttttttttttttttgagacagggtctcactctttcgcccaggctggaatgcagtggtatgatcttggctcactgcaacctccgcctcccaggttcaaatgattctcctgccttagcctcctgagtagctgggactacaggcatgtgccaccacactcccaccacacccagctaatttttgtatttttagtagagacaaggtttcactatgttggccaggctagtcttgaactcctgacctcaagtgatctgcccacctcagctaagtgctgggattacaggcgtgagccaccatgtgtggcctagttgccatgtctctttaatctactttaatctgaaacagttcctcagccttgtttgtttatatgaaactgacatttgtaaagactagaagccatttgtcttgtataatgcctttaatttatatttgttttatgtttcctcgtgattttatatatagagtttgtttgtttgtttgtctgtttgtttgttttgagatggagtctcattcttgtcacccaggctggaatgcagtggcgcagtctcggctcactgcaacttctgcctcccaggttcaagcaattctcctgcctcagcctcctgagtagctgggattacagatgcctgccaccatgcctggctaatttttgtacttttagtagaaacggggttttgccatgttgcccaggatggtctccaactcctgacctcaggtgatccgcccgccttggcctcccaaagtgccgggattacaggcatgagccaccgtgcccggacctcatgattgtatttatttatttatttaatattattattattatttttttttttttgagatggggtcttgctctgtcacccaggctggtgtgcagtggtgcgatatcggctcactgcaaccgctgcctcccagattcaagcaattctcctacctcagcctcccaagtagctgggattacaggcatgtgccaccacacccggctaatttttttgtattttttttagtagagacgaggtttcaccatattggccaggctggtctcgaactcctgaccttgtgatccacccaccttgacctcccaaagtgttgggattacaggcgtgagccaccacacccagccttatgattgtatttagactagacatttttttggtagtatattatttagccattgctgtgtaacaaattatcccaaaacttagtggcttaaaagaagcatttattatctcataaattttgtggatcaggactgggtatagctttgctgagtgcctctgcctcaaagtcttacaaggcagcaattaaagtgtcacctaaggctattgtcttatctgaagggtcaacagaggatggatccgcttctaatctctctcacatagttaatggcaaaattaagttccttgtggattgttagactaagggttccagttccttgctggttgttagcttgaggtctacctcagttccttgccatgtggacctccatagggcaaccagcttctgttagagcaagtaaaggagagtgccagagagggcaaatgtgatgaaagccacaatctttttataaacctaattttgaaagtgacatacaaggctaggcatggtggctcaaacctgtaattccagcactctgagaggccaaggagggtggactgcttgagcccaggagttcaagaccagcctgggtaacatgacaaaaccctgcctctactaaaaatacaaaaattagctggtctggtggtgcatgcctatagtcccagctactcaggaggctgaggccagagaattgcttgaacccaggaggcggaggttacagtgagccgagatcacaccactccactccagcctaggccacagaatgaaaccctgtcaagaaagaaaggaaggaacaagggagggagggaggaaggaagggaggtagggaggcagggaaagaccgagaaagtgacataccatcatttttgctgtagtttgttcattagaagcaaaatcacttggtccagcccacactctggggagatgattttctaactccatttgtaataacttattctacttttattagttggcattatacagtaagaaagagctttcttttctcttcttatttattcatatatggctcatgtgttttttccaatgagttatattctattactaacattttttattttgacctcaaattgttttagatgttaccaataagaacctcttcaagctggttcttgtgtccttttgccataactctctcattttcttgaaccctttcttactttctgatataagaaaatattagagactcatactttccttgttccagttctgagatgaaccatttatccaaaagccttgcttcattttagtagggaatagtatttagaaactaagatctgggtgtgaggtatgctcactgctaatgggctgtcactgtttctaggccttgtcagcagacggagctaggaaaaacacacataaacacacccatatttatatttgtacacacactccctcaaaatcgtgagttcatattgatacctccagttctggttcttcctagccttccccctttccatctttgtatttttattttccaacagtaagaaccctggctcccagtgctatgaatatatttactcatttgctccatccactgcactccagcctaggccacagaatgaaaccctgtcaagaaagaaaggaaggaatgagggagggagggagagaggaagagagagaaggaagaaggaagggagggagggaaaactgagaaagtaacataccatcatttttgctgtagtttgttcataagaagcaaaatcacttggtccagcccacactctggggagatgattttctaactccatttgtaataatttattccacttttattagttggcattatacagtaagaaagagctgctgaagatttgcttgcaattggttgtctttaaactgagggtatattgtcaaagtactgtgctgaaaagttacctgtagtatagttatgtgattcattaaaataaagtttgtttctattatgtgcagttttagagttttgccacactctggttgattagtatattttctgttgcttttttgttttgttttgttttgttttgtttttgagatagggtctcgctatgtcacccaggctggagtccagtggtacaatcacagctcactgcagcctcaacctcgtgcacttaagcgatcctcccacctcagcctcccaaatagctggggctgcaagtgcacaccaccatgactggctaattttttaattatttatttatttatttatttattttagagatggggtctcactatgtttccccaggctgaccctgaactcctggggtcaagtgatcctcctgccttagcctccaagtgctggtattacaggcataagccaccacacctagcctagtattcttttttgaatatgtaaaacattaacataaagtcaaaactattaaaaaaaggtgtactcagaaaattgtcattcctcccctataccttctgcctcattcacaccacactctgtagataatcgatttcattagtttgtggtttatcctcactgtgtttctttttgcaaaacgcaaaaacaaaacctatacatatttatattttcttatgtcctcttctttcttacacaaaaggtaacacactatgtaggtagtcctggctttgaacagtttcactataaaaatatttgttactacagcttaaataacataagtctcctaaaaataattcaaattttagttaccatggtatattaactttgagtagttccataaaggacaaacttggctgctagcccttcagtccacagagcactttgaaaataacagatgagcaaaataatgtggccaatcacatgacttctttcaaagtatgtcagtgatcagtcactgtgtgcctataatttagttcatgcacagacagcaaagcatgtagttgtgttgccttccagtgataaacccacataacattttagaaaaatgtattaagaattggccagcaaagataaaagtgcagcaaagaaacaaaagtgataatgttttcagtgaaatttgaattgaacataaatggagttatagaagaaatagctgaccatgggaatgttcacactgctactttcaagaatctctagaagggcagctaaaggagcttagtgaaggtgaatttattgacatgaatgagaaaagtaattgtgatgaaaaggatgaagatgtcccagagaaagtaatgccagcaaaaacttcacattaaaggaactctcagatatttcaaagcattgaaacctccaagaataaataaaatgttggaagttgatccaaacttagaaaggagtatggcaacttgtcaagatgaagaaaaggtgcttattcctttttatttatttatttagagacagagtttcactcttgttgcccaggctggagtgcaatggcatgatctcagctcaccgcaacctccacctcctggattcaggcagttctcctgcctcagcctcccaagtagctgagattacaggcatgtgccaccacgcccggctaattttgtatttttagtagagacagggtttctccatgttggtcaggctggtctcgaacccccaacctcaggtgatctgcccacctcggcctcccaaaacactgggattacaggcatgagccaccatgctccacctgcttattccatattatatgttataggatgaaaagaggccaaactaatcttgacatgttttttacaaggaaataatcctccatggttctaatttttttttttttttttttttttttttttgagacagagtcgcgctctgtcacccaggctggagtgcagtggcacgatcttggctcactgctagcaccgcctcccgggttcacgccattctcctgcctcagcctcccgagtagctgggactacaggcgccggccaccacgcctggctaattttttaaaaaatatttttagtagagacggggtttcaccgtgttagccaggatggtctcgatctcctgacctcgtgatccgcccgcctcggcctcccaaagtgctgggattacaggcttgagccactgcgcccggtgggtctaatgttttaaattacactgtgttaaataaatattagtttgttggttttttttttagtttttttatttctctacaaatttacaaccaataagagtttttaatgctttgacaaaaaatgttaaaggtcatagtacaatcgcatttcttcccattgattattaacatcactttacatagtttcatcttgcattagcaattttgtgtgtgtgtttgtggttttaaggagcggagagtttaataggcaagaaggaagggagaagacagaaggaaggagctcccccttacagagacagagggagcggggctccaaaagaggaggtccccatctaccgcggataccagccaggtatatatgcagaggctggtggaggtgatgtctgatttgcatagggctcaggggattggtttgaccaggcatatcattcacgtagcccgagaaaaagctggccctcccaccccagccttttaatatgcaaacgtagggcgccatggatgttctaaacacgtggagatatgtggggggcagccatgtggccaggaacttgtggggcaagggcaagaaggctgtgggaatcgccaagttgaatggacctagtttctaatggcctgcatttgcatatcaaaggttgctggcctggctcctagagccggggctttaaaagaaacttttccggagatgctttaaaaaatgaaaacttcccaaggaccccttttcctgtctatctgcataaaataatttcttttattatttatttatttatttatttatttatttatttatttatttatttatttattttgagacggagtctcgctctgtcgcccaggctggagtgcagtggcgcgatctcagctcactgcaagctccgcctctcgggttcatgccattctcctgcctcagcctcccgagtagctgggactacaggcgcccaccaccacgtccggctaattttttgtattttcagtagagacgggatttcaccgtgttagccaggatggtctccatctcctgacctcctgatccgcccgcctcggcctcctaaagtgctgggattacagaataatttcttaataactcctaccacattcctccctgtggcgatatcaaactaactgctgttaggaggctttgggcgaccattgcttctggctacttcctgctgaaaaggggcgtctaatggagaacagcagctagggctcctcctggggttgatctaagggtcctcggaagaatggcgtccatgtgtggttcagtttacagcaccgtttggagtttgattgcttctaggcgagaagaaacaattcaagttatagtattgagtatacagagtccaaatatcaatacaagacatataagcaagagagtgcttaataaaggggttaaccaattccataaagaagactggaagtaattaaagagggattgtagccactcggggctgaagcccacattttccctgagcctgtcaataattttgatttgatttttaagtccctgtagatttgcctcttctttactacaggtgttaatcccaaagaagcatgtttcatttaaaaatgcattactggccaggcgtggtggctcgcgcctgtaatcccagcactttgggaggctgaggcgggagcatcatgaggtcaggagtttgagaccagcctggcctacatggcaaaaccccatctctactaaaaatacaaaaaattagccatcgtggtagtgggcgcctgtaatcccagctaattgggaggctgaggcaggagaatcgcttgaacccgggaggcagaggttgcagtgagccgagatcgcaccactgcactccagcctgggcaacagagcaaaactccatctcaaaacaaaacaaacaaacaaacaaacaaaaactgcattactaaatccaataaaaagtcctagtagactcagtgatagtaaaactttcatgcttcctttttgccagtaactattatccctgctataaggatactaattaagcaaaatacgacagcaatggaaactctgtccaatatttcagttagaaggtgctaccatggataaccctattgcaaatagtagagtgaggaaagcagttcccacaaatgtggtgtggtaggtaatttccatctaaaattttacttgccaacatatagaattcccctctgtgggcctacgaagttccttggttttattttcccaaacaaagaaacctccgggttacaggtaccttacttactttcattacctggcacaatttgcaaaataattgcccagaactagcatattgattcacattttcacattacccatccctttttcccccccaccaagctgcagaagatcaccacttgattcacaggaataagcagggccagggttagtctaaaatgtaggcaaaaagcttaaaaacaattaatgagactagggtttaatgacaaatgtatgataagctttggagcaaaatttttctctccagtcctcatttttggtaaaaactaattatgaatgaactttaatcttatacttggcctgattatttgcatgaagtgcagcaagaatggttatttctacataggacttttggattggctttgatgaaacactgttccacaaggaatttcagattagacttttaaagctgagcccagacatgggtttgtatcctctaatacctgtgagttgggttatcctctcctcttgaggtcccaagataaactcagagcttccagacctgttagaaagtgacattcttcactgaccacaggttaggaaccctgtgtggggactgtgtagacaaggtgtgaggccagttctccccaaggggcttttattggctctgcatgtcaagcttgattccttaaagggaaacacaccctttcagttaaagccttggcaaaataaccggtttttccaattgtgttctgttgacaaagaaaaatggattcttgctgcactgatgcgaacaactatattgccgtaagttaagagtacttacagatagtctccaaattttagaggaaccaggcagagaaaaatgaacatgctccaaattttgttcacagtagtataccttacttgattattaaaggccataaatagtttaaaataagtttcctttcccagtccatgcaccaaaatgatacggctctgatgagtggaggaacaacagggttcctggtcctcatgctggtttagataaaatgacacagacacatgtggagtggttttaaggagtggagagtttaataagcaagaaggaagggagaagagagaaggaagacgctcccccttgcagagacggagcgggggttccaaagctgaaagaggaggtcccccacattaacaatttttaaaataccgtacaactgcagaaaatgaggactgcctgtacatactgtttgacactttgtttttttttttaacttatcaactttattttgtttgtttgttttggttttgggtttttgtttgtttgtttgttttggagacgagtctcactctgtcagccaggctggagtgcagtggcacaatcccagctcactgcaacctccacctctcgggttcaagcaattctactgcctcagcctcccgagtagctgggattacaggtattcgccaccacatccagctattggttttggtttttgagacagggtcttgctgtgtcacacaggctggagtgcagtggtgtgatctcagctcactgcaacctctgcctcccaggctcaagtgatcctcccacctcagccttccaagtagctgggactacaggcatgcacaccatgcgcagctaattttttctattttttgtggagacggggtctcactatgttgcttaggttggtcacaaattcacagcctcaagcagtcctcctgcctcaccctcccaaagtgctgggattacaggcatgagccaccacatccagccttaccagctatattgaagtataatttatataacataaaatttgccttttaaaattatacagtgcaatgcattttgacaattgtttacatctgtgtaaccaccatgcaatcaaaatatagaacatttctataaccttcaaaagttccctcatgcccctttgcaatcaattcactacttctccagctccaggcaacaactggtctgcttcctgtcactataaattagtgttgcctctttcagaatttcatctaaatggaatcctataacatatactattttgtatccatcttcttttactccaaagttcttgaaattcattcatgttcctgtgtgtatcagcagcgtgttccatttgattgttgagcagtattgcattgtgtggatatatcacaatgtgttcattcattcaactgttggtggacatttgagttgtgtccagtttagtgctattctgaattaaagtgatgtgaacaatcatgtacaagtatttttgtaggcatattttttttatttctcttggataaataccccaaaacagaattgttttgggggtcatatgaaatgggaagtatatgcttaactttataagaagctgccaaactatttttcaaaatggtaatatcactttacattttcatgagcaatgcataaagcgttccgcttgctacattttctcaccaatgcttcctattgtcaattttttaaattttagcaattctagtgggtgtgtgatactatctcattgaagtttcaactgtttttccctgttgactagagacactgagcaacttttcatgtgttgtctatttgtatatcttcttgaagcattcgttcatctttaactgagctgaacgccttcttaaaattgagctatgggagttttaaaatatatccttgtagctgggcgtgatggcaggtgcctgtaatcccagctactcaggaggctgagacaggagaatcgcttgaacccaggaggcggaggttgcagtgagccgagactgcaccactgcactccagcctgggcaacagagtgagacttcatctaaaaaataataattatacatgtaattatatatgatttttatatatgtaatatatatattcttgatgtgagctctttgtcacatacatattttgtggatattttatcccagactatgacttgtcttttcattttcttagttgtgtcttttgaagagcagaagatgtaattttgataaagcccaatttattttttcttttatagtttgtatttcttatgtcctattcaaaaactccttgcctactgaaaacttatgatgattttctcctatattttcttttagaagttttatagttttaccatttataatttggtctatgaatccttttgagttgatgtttatgtatggtgtatggtgtgaggtaacaatgaagattcatatttttttccaaaggaatatccaattgtctctttggaaaaatatgctgagaaggctatcttttccccaccaaataatcttagcaccttaatcaaaaatcatttggccatggacatatgtaggtgtgggttttttctgggctctctgtgttagatggatagatagacagatacagatatataactgtgtttacacatatgtaactgtaaacacagttatatatctatatatccaccaacagttgaatgagaataaactattgttataagcatatatacacattgtatatatatgtgtacatatacatattgcatatgtatgtatacatatatacacacaaagtatatatatgtatgtatacatatatacacacttaaagtaatggcctccagttcgatccaagttgctgcaaaggacattatttcatgccttttcgtggctgagtaatattccatggtgtatatatatatatgtgtgtgtgtatatatatgtattatgtatatatatatgtgtgtgtgtgtgtgtgtgtatatatatatatgtgtatatatatataccacattttctttatccactcattagtcgatggggacttaggttggtttcacatttttgcaattgtgaattgtgctgctataaacatatgtgtccaagtgtctttttcatataattacttattttcctttgggtagatacccaatagtgggattgctggattgaatggtagatctgttttttgctctttagagaatctccatactgttttccatagaggttgtactaatttatattcccagcagcaatgtgtaagtgttctcttttccccacatccacaccaacatctattgttttttgactttttaataatggccattcttgcaggaccaaggtggtagctcgttgtggttttaatttgcattttcctgatgattagcgatgttgagcattttttcatatgtttgtgggccatttgtataccttcttttgagaaatggctatttgtgtcctttgcctactttttaatgggattgtgttttatttttcttggtgatttgttagttccttgtagattctggatactagtcctttgtcagatgtgtactttgcaaagataatattttggatgttatatttccattataatttagttcaaagtattttctaatacaccttgcaatttcttctttgacccatggattattttaaagtttgttattttgtttgtttattttgagacagagtttcactttttttgcccaggctggagtgcagtggcacaatcccggctcccagattcaagcgattctcctgcctcagcctcccaagtagctgggattacaggtgcccaccaccacacccagctaatttttttttcttttttttttgagacagagttttgctcttgttgcccaggctggagtgcaatggcacgatctcggctcactgcaacctctgcctcctgggttccagcaattctcctgcctcaacctcctgagtagctgggattccaggcatatgccaccacgccaggctaattttgtatttttaatagagacggggtttcttcatgttggtcaggcgggtcttgaactcccgacctcaggtgatctgcccgccttggcctcccaaaatgctgggattacaggcatgagccactgcacccagtccaattttttgtatttttagtagagatggggtttcatcatgttggccaggctggtcttgaactcctgacctcaggtgatccgcctgcctcggcctcccaaagtgcagggattacaggtatgagccaccatgaccagcctaaagtgtattgtttagtcaccaaatatgtaagtattacccaaatatatttgtcactgatttctaatttaattgtattgtgatccaaaaatatacattgtatagtttctattcttttaaattcgttaacatttcttttatggcacagaatatggtctatcttggtgagtgttgcttacacacaactgtgtaactgaaaactgtgtattctgcttctcgtggttgttgtatcctataattgtcaactagatcaagttagtaagagtgttgttcagtgatcttttcttcttcagtgtttactgtatttgctaatcccatccagtgaagtttccatttcatatattgtatttttcacttttagaagttccatttgactctttcatttccatcctcaattatcttcatatttttctttaaatttttgagcacatttataatggaggttttaaagtccttgtctgctaattttgtcacctctgtaattcctatgatgattttcttcctggcttggggtcataatttgttgcttatttgcatgtctaataatgtttttattggacagcagacattgtaaatgttatatttttgagtgtttggattttgtctttctttaagaactattgcagtttgttttggaaggctattatgttttttgcagatcaggttgatcttttcaaggcttgtttttaagctttgttaggacaggtctgtagtaacttttgccttgggctaatttagacctaccacttaattctgacttttttgattaatctgagtgttcagcagggtctctttattatggctaaatgaaattcaaacattttccagccctatgtgaccatcaagaattcagctaatagctccctggcagttcttcgcccagctgcagaaaagtgtcagtgcactctatgtatgctcagattattatttagccaaagacttggggatccatattaatattcctggagttctttgtgtagctccattctctttagtactctatcccataaattctggctgcctcaatctcctaatctccccaaactctaatatctattcctcaactcagcaaaaccatggtgttattcttggatttcccctttcctgccccacagtctgaaagttgtctccaggcaaaaaaaatggagatcctagtttgcggatcctcatttccttctccttttttttttttttttttttttttttttgagatggagtctcgctctgtcacccaggctggagtgacgtggcgtgatctcggcttactagaaactccggctcccgggttcatgccattctcctgcctcagcctcccgagtagctgggactacaggtgcctgccaccatgcccggctaattttttgtattttgtttagtagagacggggtttcaccgtgttagccaggatggtctggatgacctcgtgatctgctcacctcggcctccaaaagtgctgggattacaggcatgagccaccgcgcccggcctgcttctcttctcttatgggttagaatcctgcactgtcttttgaacaaatgtctaaaagcttttatcacacattttgatccacttcccagttgttatagtggtatatctggtttcacatgactgaaaggaaaagttttcaccttgctttttgtactaataatatatcctggaaatcattctatataaatttatagaaatcttcatttttaaaatagcttcataaaactccattgtaaaaaccaggtgcagtggctcatgcttgtaatcccacactttgggaggccaaggcgggtggatcacctgaggtcaggagttcaaggccagcctggccaacatggtgaaactccgtctctactaaaaatacaaaaattagctgggtgtggtggtgggcgcctgtagtcccagctacttggaaggctgaggcaggagaattgcttgatttcaggaggcggagattgcagtgagctgagattgcgccactgcactccagcctgggctacagagcgagactccgtctaaaaaaaaaaaaaagcaaaaaaaaaaactccattgtatgtgcacatatcattatctgttcaacccatctatgacttgtcatttaggtagtttccatccaatatttttgcaatataaaaaatgctaatgaagaacctgagatatatatatatctatatatatagatatatatgtttgttgttgttgttgttatttttgaagtatgtacgtataataaattcctaatagtgtgattgctgcatcataaggtaaaggcatatgtagttttgttaaatatagctattccccatcttgcattcctacaaatagatgagaatgtccattgtcccatagtctcctttgcagagtatattgtcaagctttttaattgttgccaacctgatgggtaaaaagatatctccaaataattttaattaaaatttctcttattatgaatgaggttaaatagtttttcatatgtttaaaagccagtttatatctttttgtttttttagagacaggaatcttgttctgttgcccaggccaaattgcagtgatgcagtcatagctcactgtagcctcgcactcctgggctcaagcaatcctcctaccttagcctcccaagtagctaggactacagatggatgccaccatgtccagctaatttttttatttttttgtagagatgtgaggtctcactatgttgcccaggcttgtcttgaactactggcttcaagtgatcctcccacctcagcctcccaaagtgctaagattacagccatgaaccaccacaaatgaccctatatatttttttgaattgtctgttcatgtcttattttcatttttctagtagttttttttttaagtgttttagcctaaatttgtaaaaagtttaggggatatatgaagggactctaaatgtttatgaagaaatttaattaaaagataaaaataaaaatataagctttatttttcaacatgagctccatcaagttcaaggcacttttgtaagcaatgatactagccatttagttcacccctaaagaactgagagtcctgggaatttagccatgtcaatgcagtattttttatattggttactgaagaaaaaatgggtgccctttaaagttgtaagattaggaacaaaaacaagtcagaagaagccaaatcagcactgaaaggtgggcacttaatgattacccaagaaaactctcaccaaattgcccttgcttcatgagaggaatgagcgggagcattgtcgtggtcaggaaggattctggggaagttttcccaggcattttttctgctgaagctttggtaactttctcaaaacactctcataataatcagatcttatcactctttggccctccaggaagtcaaccagcaaaatgctttgaacatcccaaaaaagcgcttgccatgacatttgctcttgaccagtctgcttttgcattggtcaaatgccaccacttccacctcttgtgctttgttttcaggatcagactggtaaagtcatgtttcatctcttgttacagtttttttttttttaagaaacccttcaggatcttgatcacatttgtttaaaatttcaactgaggctgggcccagtggctcatgcctgtaatcccagcactttgggaggccgaggcgggcaaatcacgaggtcaggatttcgagtccatcctggctaacatggtgaaaccccatctctactaaaaatacaaaaaattagccgggcatggtggcaggcacctgtagtcccagctactcgggagggtgaggcaggagaacggcatgaacccaggagacggagcttgcagtgagctgatatcatgccactgcactccagcctgggcaacagagtgagactccagctcaaaaaaaaaatcaagtgaaaactctggtcttaaactgcagctgatctattttatttttattttttttcagacacagccttgctctgttacccaggctggagtgcagtggcaccatcatggctcaatgcagccttggcctcgtgagctcaagcaatcttcccacctcaggctcccaagtagctgggactacaggcacatgctaccatgcctggataatttttttgcagctaatctagatgtaatggttttggcacccatctaatggaaagtttgctcaactttaatttttcagtcagaattgtgtaagctgaaccgagatgtctatggtgttggctattgtttctgctgttaattgtaggtcttctttaattagagcacagacaagatcattttttttcctcccaaattgatgtagatggtcttttgctgtgggcttcatcttcaacattgtctcatcccttcttaaaacaagctagctacttgtaaactgccgttttctttggagcattgtctccataaacttttcacaaaacatcagtgatttcaccgttcttccactcaagcttcatcataaatttgatgtctgttcttgtttccattttagcagaattcatgttactctgataggggctcttttcaaactgttatcttattcttcttagtgcctcaaactagatcctattcagacatggtataacaagttagtatgggtttattttggtgcaagaaatattttgaaatccacacatttttttcataatatgcattttccatgaagtttttgaaaactccttgtattaggaatattagtcctttgtccagtaaacagactgcaaatattttctcacagctcatcatttaccttttggcatttttttgcaatgcaatttttttccctttgtttttgttttttgtgtaatgaatcaatgttttcttttttttttttttttagaccaagtctcactctgtcacacaggctggagtacaatggtgcaatctcagctcactgcaacctctgcctcccaggttcaagtgattctcatctctcagcctcccaagtagctgggattacaggcacatgccaccatgcctggctaatttttgtatttttagtagagatggggtttcaccatgttggccaggctggtctcgaactcttgacctcaagtgatccactcacctcggcctcccacagtgctgggattagagacgtaagccactgcccccggccaaatcaacgttttcttatattgcatttaggttttaagtcatagttagaaagcctttccccacacctaggttatagaaacattcattacttttttcttccagtgctagtacttgcatggtttttggtttccacatttagatccctgatctaattggagtttattcttttgtgtgctgagatatggatctgattatatcttttttcccaaatggctatccagttgtcccaatgccatttattaagcacttcatctttgtcccagtgatttgagatagcatctttatcatgtaccaaacttctatagtgccagaagatttttattttttttagacagggtctggctctgttgcccaggctggagtgtagtggcacaatcccagctcgctgcaacctccgcctcacatgctcaagtgcccgcacctcagcctctcaagtagctgggactacaggcacatgccaccacaccaggctgatttttatatttttttgtagaatgagatttcaccatgttgcccaggctggtctcaaactcctgagctcaagaaatccgcccacctcagcctcccaaaatgctaggattacaagcatgagccaccacacccggctgccagaaaattttaatgatcagaaaaccacaattctttcttcctctgttatatgttgaagtaaaatacttcatttagaaaactaagccgggcacagtggctcacacctgtaatcccagcactttgggaggttgaggcaggcagatcacctgaggttaggagtttgagaccagcctggccaacatggtgaaaccctgtctctgctaaaaatagaaaaatttgctgggcatggtggcgggtgcctgtaattccagctacttgggaggatgaggtaggagaattgcctgaacctgggaggcagaggttgtggtgagccgagaccacgccattgcaccccagcctgggcaacaagagcaacggtaaactccatctcaaaaaaaaaaaaaaaaaaagaaagaaaaaagaaataactcagccatacaaggctacccatttggtgagaactaataataagttagatagcaaggtaatagcaaaatgtgggtgcaaaattaaagcaagttatttctgaggagaatgtaggtctcatggaagattttcatgtggacaaatttagtaaattttttgcaggtagtttcctgacatatttaacatttgtgatatagtaaacaataagaaggtactaaaggctgggcgcggtggctcacgcctgtaatcccagcactttgggaggccgaggtgggcggatcacaaggtcaggagatcaagaccatcctggctaacacggtgaaaccccgtctctactaaaaatataaaaagttagctgggcgtggtggcgggtgcctgtagtcccagctactcgggaggctgaggcaggagaatggcgtgaacccgggaggcggaacttgcagtgagccaagatcaagccactgcactccagcctgggcaacagagcgagactccatctcaaaaataataataataataataaggtactaatatgatccagactagaagagaatagcactaaaatgggagatggggtaaacctgtggttttttttaccttaggcttttgacttccaaaattattgtttttgctgggtgcggtgggtcactcctgtaatcccagcactttgggaggccaaggtgggaggattgcttgagcctaggagtttgagaccattctaggcaacaaagcaagaacctgtctctaaaaaaatttaaaaattagccagaaatggtggcacatgtctgtagtcccagctacttgggaggctgaggcaagaggattgcttgagccttttgaagttgaggcttcagtgagccatgatcaccccactgcactccagcttgggcaacagagcaagaccccatctcaaaaaataaaacaaaatagactgggcacgatggctcacgcctgtaatcccaccactttgggaggctgaggtggatggatcatgaggtaaagagatcgagaccatcctggccaacatggtgaaaccccgtttctactaaaaatataaaacttagctgggcgtggtggtgcacacctgtagtctcagctactcgggaggctgaggcaggagaatcgcttgaacccgggaggtggaggttgcagtgagccaagattgtgccactgcactccagcctggcgacagagtgagactctgtctctaaataaataaataaataaaacaaaataagtaaaataaaataaatgtttgtagttccaaaatattttgatgacataatttcttcttgttctaataaaactacatatgcattggtcctatgacctagtaatcacactattaggaatttatcataaatacacacctcaaaaattacaaaaatacatatataccagcttatttattacagcgttatttgtaattgcaaaaacattgtagatagaatggaggtcacataaaacttattcttaagattcagaccgggtgcaatggctcacgcctgtaatctcggcactttgggaagccgaggcaggcagaccacccgaggtcaggagtttgagaccagcctggccagcatggtgaaaccccatctgtaccaaaaatacaaaaattagctggtcgtcgtggcacgcctgtaatcccagctactcgggatgctgaggcgcgagaactgtttgaaccccggaggcagagactgtagtgatctgagatcatgccactacattccagtctgagcaacagagcaagacttcgtctcaaaaaaaaagatcatagatcatcttatcaaatcaaagtatgcaaaatattcaagtaaacttcagataaatatgaaggctaaaccattcagcttcttcaccaaacccttgaatgtcccacctgtctaaatggagatacatgtttgtttgatttattggttaactgtttttattccatttttcctcaaatgatcccataatttgaccttaggaagctgttcaaatagacacattaggttgaatggaaagactactcgatgatatttaggattttaagaggattttatgtattttttccttgtgtgcaataatttaatagcatcttgaataggattttctgatattactaaccctctgggaataatattaggtaattagacagttagctaatattaaaatatgtatcaggtaatatttattgagagtttcctctgtgccaagcaggatcaacttcataggcaggcgacctgtgcggggacacagggcttcatgcttagataggcccccttgctttgaaggcccctaccctttggttagggctctgctgttaccatcttgaaattcttaataatttttattttatttttttgagtcagggtcttgctctgtcgccctggctggagtgcagtggactcactacagtcttgaattcctgggctcaagcaatcctcccacttcagccttctgagtagttaggacgacaaacacacgccaccatgctcagataagttttttgtttgtttgtttttttgtttttgtttttgttttttgtagagatgggactgtccctatgttgctcaggctggtctcaaattcctggcctcaagtgatcctcccacctcagcctcccaaagtgctgggactacaggcatgagccactgtgcctggtcaatcatttttattaacaagcccaagccctcttttttttttttttttttttgagacagggtctccctctgttgtccaggctagagtgcagtggtgcgatcttaccttcactgcaacctctgcctcctgggttcaagtgattctcctggctcagcctccctagtagctggaattacaggcacccacccccatgcctggcaatttttttgtatttttagtagagatggggtttcaccatgttggcaaggctggtctcaaactcctgacctcaagtgatccacccaactcggcctcccaaagtgctgggattacaggtatgatccactgcgcccggcctccaagccccctatttttattttgcactgaccctacaagttacgtagctaggcttagttatgtttttagcaaggaaagtgtataatctcatgtaccttttgaaagattactcaggtctctgcatgtgaaatggaatttagggaatgcaagagagggagtaaaaataacagcgaggaagctatgatagcatttaaggttgctttgactcaggggtagcagtagatagggtaagtaattgatagtttcaaaatatattttgggagtagtaagcattggtatggattagtaatatactggatgtggggatgcagaaaaaaatattaaaaattacttctgaaattctggctggaatagaagtgccacttaccaggtaaggaaggttggagacataacatatttgagggtgtggtcaaaagatgagtttgacattatgctatgtcatataaaagacatataaaagactacctattttataattcctttttaataaaatattcagaaaaagcaaaactgtggttgcctgaggctgaagctaggaagattgactacagacaagcatgagggaaattttgggggtgatgagagttttctaaaactggattgtggggttggttgcattactgtataaatttattaaaaatccctgcatcgtataggggcactatattgtatgtagaaagctgtgaaaagattttaaaaatgattgacatgtctgtggttatatcaatgagtactattattattcccattttatacataaagaaaataaaagagaagttaaaaataaaagtttcatggttacatagctactaggtgtaatatccagtattggaatttgaatctttttgacactaagaccttactctcgatcatataatacattcactttctattttaaagttatattatagccgggcgcagtggctcacacctgtaatcccagcactttgggaagccgaggcaggcagatcacgaggttgggagatcgagaccatcctggctaacacggtgaaaccccgtctccactaaaaatagaaaaaattagccaggcgtggtggcacgcacctgtatcccagctactagggaggctgaggcaggagaatcgcttgaacccagaaggcagagcttgcagtgagacgagatcgtgccactgcactccagcctgggtgacagagtgagacaccatctcaagaaaaaaaaaattatattataaatgctgcatctcattggtcagaagctctcttgaaattataaaacaaagaagaaaaaagataaagactgggaaattgtgttgaatcagtatataaatcctgtatactggtccttccatttcccctagaaataagtgatacaggccaggcgctgtggctcacacctgtaatcccagcactttgggaggcggaggctggcagatcacctgaggttgggagttcaagatcagcctgaccaacatggagaaacccccgtctctactaaaaatagaaaattagctgggcatggtggcacatgcctgtattcccagctactcgggaggctgaggcaggagaattgcttgaacccaagaggaggaggttgtggtgagccaagattatgccattgcactccagcctggggaacaagagtgaaactcaaaaaaaaaaaaaaaaagaaagaaaaagaaaaagaaagaaggaaggaaggaaggaaagaaagaaagaagtgatacaacaagttacagcatctttgtttattatccactgtgagttgtattaccacactttacttggctctttggcaaactatattatctcttcagatcactagggctaggaaggcccactggtaacttgaaggagtaaatgtatcttctaaaaaatgcttacttccagggagattggatccacacaagtgaatacatatatagtccttagtgtatgctatgattattttactatgtcagtagcataaagattgctatattaataagcattaagtgcctgctgtgctagacagtgaggatgcaagtggccaccaaaatagcatggtccctgccctcctggagcttctttttttcttcttcagtgggggaagcagatactttgcttatgcaaaaataattataaaatttaaagttgtgccaagttcaatggaaaaaatataaggtgttctgagagagcataacaaaggatcctggttttaactggggcctaatggaagacctctattaggaaataacatttaaactaagaccagacagacctgtagaaattagcaaagcaaagggagggaggaaaaagcagctttcctggcaaaggaacaatttgtgtgaaggccctgagacagggaagggctggggttctgaccaccctccaagtggtgcaatggaatatagtgagagagggagaagacatgagaacttggatactatgcaaaggatttggtattttaattcaagagcagtatgatgctactgaggagcagctggacaattgtgtgatccaattaaaattttaggaagatgaacctcgctattgtggagaatgcatacacaagggttctgttggttcatgaagaggtcttaagaaaactatgagctgggtgcagtagctcaggcctgtagtcccatctacttagaagtctgaggcgggaggatcccttgagcccaaggagctggaagttacagtgagctatgattattccactgtactccagcctggatgacagagcgagatcctgcctcagaaacaaaaaccaaaaaacaaacaacaacaaaaacaacaacaacgaaaatctcagaaaactacaggccttattatcaagaaaatgacaggccttattattgagaaaactacttacatttttaaaagctgattttcaaaaaccagattgtgaattaagtgatgctgaataggggaaaaaaagactgataaaccagtgtatctctgaataacccactagatcagtgcttgtcaaactttaatgtgttttcaaatcaccctgatgttttgttaaaatgtaagtcatgtctcagtaggtctagaggagggcatttctgcatttctaacaagctccccggtgatgcctagaccattggtcctcacactttgagtagcaagtgattgggctatactctttattctaaattctaaatgtattctatcttctaatgcctatcagccctcttgctggtctggctaattatcaaacttgagcatttaaaactgggggttttcagagattaattgaagtgttaaagacatggaaatataggtcacatatggcttttcatctcttccggaaatatcctatatatccttacttcttttctacctacctaacctatgtgcctaccccttcacttatgttcaaggttctattatacttcaaaaggactctatgcaatcaaagtgatgtccaagacaaatatacagaaatagtatgaggctctaacactttacatctaatggagtggtttgcatcattaattgaggcttactctgtgccaggcactttacctgccttcttcatttaataggataggagcaggaactcttagaggttcatttcttgttcaaggatatacatctcatctctggcttatatcacagtggactcttttattcactatcctaatcattataattttgtttggtgacaacaattctaaatgcagaaaagttaaggctctttattctgtgactaaaggctttgtattttctaaagatttgtggagctttgctgccattatttcaataattttataaagatcctaggtggtaaataggcctggctttttttctttttgaaatcttctccgtcttcttcttcattagcagtgcaacttcttgtggcatatggtacccaagatcttgggaaaaggattgatcaagtaaagggaaacgatagagagagtgtgctctacaactgagatcatgctccttgtgaaagacagggtagggaaatttcttattgctccctggttcttaagaaatgagagctaacaatgacatccagttttaaaagaaataaaatctgaattgtacttttaaattttataagccagagttaaaccaatagattgtaactcctgctaatttgatagtagctccagataatgaggaagtgacagggaatgctaatttcatttggtaagagataaaactgaaattattaatgtctccacggaaatgctaaatgcctccttacaagtagggtccggctaattgtctgtcttccaacaagccagatttgttggtgtttttccagacaatgttgtgtagttttcggtttggttcgatcccctttcttgtgatcaaagaaagtgattcaaatgtttaatgagtcttgatttggattggagacttgcagaacggctagcctcacagccccaaggctggctttccctaaggtaggtttcctatgcaccgatactggcaaggcgctttggctggaaactctggaaggaagccaaaggaaagtgaagttcctggcgctagcgcgtgtcctgctcagagagcccggcgctagctcattcttcgtgcagttattggctgggactctgtgtgccgctgtcggccaatgaagacgctggagatcgggcccctgcccgtcccctttctgcgccccgggatgaggcagagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattgcaaagtgttggtggaggttgtggatgtgaatgacaacgccccggagatcacagtcacctccgtgtacagcccagtacccgaggatgcccctctggggactgtcatcgctttgctcagtgtgactgacctggatgctggcgagaacgggctggtgacctgcgaagttccaccgggtctccctttcagccttacttcttccctcaagaattacttcactttgaaaaccagtgcagacctggatcgggagactgtgccagaatacaacctcagcatcaccgcccgagacgccggaaccccttccctctcagcccttacaatagtgcgtgttcaagtgtccgacatcaatgacaaccctccacaatcttctcaatcttcctacgacgtttacattgaagaaaacaacctccccggggctccaatactaaacctaagtgtctgggaccccgacgccccgcagaatgctcggctttctttctttctcttggagcaaggagctgaaaccgggctagtgggtcgctatttcacaataaatcgtgacaatggcatagtgtcatccttagtgcccctagactatgaggatcggcgggaatttgaattaacagctcatatcagcgatgggggcaccccggtcctagccaccaacatcagcgtgaacatatttgtcactgatcgcaatgacaatgccccccaggtcctatatcctcggccaggtgggagctcggtggagatgctgcctcgaggtacctcagctggccacctagtgtcacgggtggtaggctgggacgcggatgcagggcacaatgcctggctctcctacagtctcttgggatcccctaaccagagcctttttgccatagggctgcacactggtcaaatcagtactgcccgtccagtccaagacacagattcacccaggcagactctcacggtcttgatcaaagacaatggggagccttcgctctccaccactgctaccctcactgtgtcagtaaccgaggactctcctgaagcccgagccgagttcccctctggctctgccccccgggagcagaaaaaaaatctcaccttttatctacttctttctctaatcctggtttctgtggggtttgtggtcacagtgttcggagtaatcatattcaaagtttacaagtggaagcagtctagagacctataccgagccccggtgagctcactgtaccgaacaccagggccctccttgcacgcggacgccgtgcggggaggcctgatgtcgccgcacctttaccatcaggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacaggtaaggtttagcaagtcatgcttgaccctgttagtgcttttttattcctacatcatattgaggaaggaatggagctgtttttttagtgatgaagatgttttcctggtgatgcattcacactttcaactggcccttcctagatcaaagttagtgcctttgtgagatggtggcctgccagagtgtggtttgtggtcccatttcagggggaagatacttgactcatctgtggacctaattcacatcctcagcactcttttgctatcacaactaaccaatcttgctaagggatggttaagctaaaacacaagatctcagcgatcagagtttagcttggtatcatttacattaggaataagctgctggatacctctaaccagtggcagcttctaggaatacaaaaactacctcattcctccacctttcaagtgattgtgacatttgtattaaaactaatagctttttgataattttcctttgtttatacagatcgtgtacctcattctcagataattttttatgaatgaaatgaaattccaggcatcctttaaattttatttcaagcattctactggaaatgatgtgcaccctgcttacaaaatatttttaccttataacagtaatgcatgtttgctagaaaattcagaaaatacagaaaagtatttaaaaaattaaaactataatctccaaacccaaagataaccatttttaattataaaagtaataatttatttcaaaaataaatctaggcaacccaagaaaacataaagtagccagactcagtggtgtgcacctgtagttcttgctgctcagtgcctgaggtgggaggattgcttgagcccaggagttctgggctgtggtgcactatgctgatcaattgatcaatccactgtctgcactaagttcagcatgaatacagtgacctcttgggagggcaggaccatcaggttgcctaaagaggggtgaactggcccaggttggaagtggagaaggtcaaaactgctgtgctatccagtagtgggatgacatctgtgaatagccactgcactccagcctaggcaatatagggaaaccatgtctctttaacaataacaacaacaacaacaacaatcccagaaactacaaaaggagagtctttttggtgcctccagtgttagtccctgtccttccagccttatttttcttaagtatatgcacaatgtgaaaggtagataaattcatatccttagacaggtaaagcattcattaattcagggtggtatgcaaggatactatccaaggcatggtatccatgcaaggtgactgcaaggcctttgccctggagagaaccctatacatactctcaactgtaggagaaacactgttattttgttactcagtgcatcattgctatcaactcttggatttggcagttagtcaaatgaggttctaccatttaccaactaggagtctgtggccaagttactcaatctcctttctaagcctcttcctcatatgcaaaaagggaataataagtgttttataagattcatgcatgatataatgtatgcaaagtgtttagcatggtgcctggcatatcataactgttaaacaattattagccagctcctagcattttgggaggctgaggcaggcggattgcttgaggccagcagttcaagaccagcctgagcgacatagtgagatcctgtctctacaaaaaaaaaaaaaaatgtgttttcattagctgggtgtgttggcatgcacctgtggtaccagctacttgggaggctgaagtgggagaattgcttgagcctgggaggttgaagctacagtcagctgtgattgcaccactacacttcaaccatggcaatagagtgagaccctgtctcaaaaaaaaaaattatcagctattactataattatttttattagttcctcactcacctaaaatctcaaacacaccttagaaatacacatatgagaacaaccaaaaatgacaaagtagaagcacatatgaaaaggctaagaaagcatgaaagccagcaagaaataactgccgctcttctggtcagcctggaaagcaactggcattttccctagaacaatgttttcaaacttggttgcacattaaaatcacctagagaccttttaaaaattctgaaacccaggccacaccccgacaaatgaaagcacagtctctgggggtgggacataggcatcattttttgaaggtccccacttgatcctaatgtgcagacaaatttgaaaaccacagctttgggaggctgaggtgggtggatcataagatcaggagtttgagaccagcctggccaatatggtgaaaccccgtctctactaaaaatgcaaacattagctgggcatggtggcgcatacctgtagtcccagctactctagaggctgaggcggaagcatcagtgagggagaatcagtgaacccaggatgtggaagtttcagtgagcccagatcacaccactgcactccagcctgggcgacagagcgagactccacctcaaaaacaaaaagaaagaaagaaaaaagaaaagcagtactctggaacctaccaatccatcatttagcatatttgtgaagtaaagtgttattctggtatttgcagaaccagaatccagctttattgggccaggcccaatttttttaaaaaacatggtaaggtctcccagccttaaagtattacatagcatagctctaaaagatcactgtaggaagacataaaatggtatttcagtcatctaagggaaaaaccttcctaaagcactagcccctggacaactattatttaaacatctacagctgttcaatagatattgggttctttttggagggatgtgacaaaattcttgtataattagattgtgatgatgattgtatcagtttagtacatgtaaatacactgaaaaccattggattatacactttaaatatgtgatttgcatggtatgtgaattatgtctcagtaaaaatctagagatggggctgggctcagtggctcacgcctgtaatcccagtacttagggaggctgaggccagcggatcacctgaggccaggagttcaagaccggcctggccaacatggtgaaacttcatctctactaataatacaaaaatcaggccgggcctggtggctcacgcctgtaatcccagcactttgggaggcggaggcgggcggatcacgaggtcaggagtccaagaccagcctggccaacatggtgaaaccccgtctctactaaaaatacaaaaattcaccaggcgtggtggctgaggcaggagaatcgcttgatggtggaggttgcagtgagccgagatcgcgccactgcactccagcctgggtgaaagagcgaaactccatctcaaaaaaaaaaaaaaaaaaaaaatcagccagatgtggtggcaggtgcctgtagtcacagctacttgggaggttgaagcaggagaatcgctttatctcaggaagcagaggttgcagtgagccaagatcatgctgttgcattccagcctgggcaacaagaacaaaactcactccatctcaaaaaaaaaaaaaaaatatctagagatgggagaatcatatggctggcataaaaaggtcaagtcaaagatatgtaagattaaggctttacgatgctccagttctagtaaaacagaccaggtacttgttttggtgtgaaattgccaatataagtatagtactgtacatattagttgtttagcttaggtaagtcttttaatctctttaaactccagtttcctcatctataaaataaagagaatatctactttgcaaacttgttgtgagagtgaaaagtaatgcatataaagtccctgtatggagcaagtactcaataactatttgttgaactaaaaatgataatactgatattcaccatttattagcatccctatgtgccagacactgtaaacaattaaaagttatcattctggtacccagagtacagtatgagacagacatgcaaaaaaaaaaaaaaaaaaagataatggagatctgcatagcataagatgcagtgggaccaaacgggaaaaaacacctaaatgagcctggagaaaggaagaaatgatagaggtggtgatgcttgagctatgatctaaaggttgagtagtagcttgtcagacagtaaaggggaaaggacagggcagggaggggccattgcaagaaattccatgcagagggattatggtatttcattatcactgaaccttaaactgtgtgtgtggccgggtacggtggctcatgcctgtaatcctagcactttgggaggccaaggtgggcagatcacttgaggtcaggagtttgaaaccagcctggccaacatggtgaaacctcatctctattaaaaatacaaaaaattagccaggtgtggttgtgggtgcctgtaattccagctacttgagcagctacttgagaggtcgaggcaggagaattgcttgaacccgggaggcagaggttgcaatgagctggtgtcaggccactgcactccagcatgggcaacagagagagactccatctcaaaaaaaaagtgtgcgtgtaaaacagacagtctttgtaggagatgaggtgaagcaagtaggcaggagttagatcctgagttacctttgggccaagccaaggagtttttattttattccatatagatgacagtcactgcagaaatttgaactgatatgcatatatcatgaggtttttttgttttagaaatattattctgtcagtcataagtgaagggactggggacattgggactggaggcaaagagatcttatctctttgcaatagtttgaaagctattgcaatatttgaagagaagattgataaatgcttgaaccagcacagtggcagtacagatggagggagctgactacaataaaatcatcaggacttgttgattgacatgatataggaagtgagggacagggatgagtcaaggctgatccccctagatcctgactaaggaagctgggtggttgacagtgccattcacagagacagtgaattctggcataaacacctaataggtcaggctggtttacacctccatcattcccatgggagaaggtatagaggggtgtgtgtttgtgtgtgtgtgtgtgtgtgtaaaagaacacagaaagccagattcctctttttgacaccagaatattggttcccaccatagtcaaaaggatattcctgaggatcgaggcttggaaaaatattggggaaggataagaactccagttgttgctgctttttttggcagccagtgtaacctaggtaaggacttggttgaattaagaaatttcatgtccagatcaggatggatttttctatttctctgagctctggtgtgtttcccactcagattgcaggtcgtaggtacctacggtgtgaattgtgttgtgtttctgtgcttgtgcaagggagtagctaggttgctgggaggtctggatgagggtgggggtggggtgagatcaagtctccagctccaagaggtcccctggggctaagtgaaaagcttgctcttttgaaatggtcttcgttggtaattaacaaaagatcaagaataccttggtgtcagataaagggaatttgtaggcacaatgctgttggtagctgatctcaatcattcaaggaagctattaaatctatgaacattagcattctgccaggtaaagagatctggtccttagcacctcccagacacactgattctttactgttttgaaacatctccctctcctggcttcctccaccccgcttccatactgtccttgaaatcaatgaatggtaatttagtgtatctagtgtatcactagcaaatgtctgaataagaaaggtttggtttccgctgtgtctcctgttacaatgagaacatgtactgcataaatttaattggctacgttaatgtgtaagccttttctgcaaagagatggatccgtttctgaatattctgcagaagggcagagttttgagtatatggcagtggttctaattagcagttgctccaatacaatcagactgagacggaagctactcatttagaatactggttgatgacaacactggcttgaacaaagtgaccactctccaatggctactctccctctcagtgggccgcaggttgctagggctcaggctgtggctgttttccccgccgaaaaggggcggggtcagtcggtgtgttaggaaaaaaaatgtatatatatatatatgttgtctgcctccccacagagataacaacccgtggaaaaacatgccgttgagcgggaggaaggcgaaaagataggctgggttttttggggggtgggggagcgtggaggatagggtgggctttttcccctccaatgctgcgacgcattaaccctgctgctgttgggacgttctctgctcagcctattggctgagcccgggagccgctgtctgccaatcgggtggtgaaaggcagacaaatctaccccgccaccagcaaaaacggcgcgtaacccttgcggcgccggccgaaccgcgccagagctggcgcggggaaagggagataggtgtctccagctgctgtggctgtttggggcgggtcggcttcatccgcgtctcaggagcaagtagagaattagcgggcggcagcaatgctccgcaaggtgagaagctggacagaaatctggcggtgggctacccttttgttcctcttttaccacctgggttacgtttgtgggcagatccgctacccggtcccagaggagtcacaggaagggacttttgtagggaatgtcgctcaagatttcctgctggatacggacagtctgtcagctcgcaggctgcaggtcgctggagaggtgaaccaaagacacttccgtgtggatttggacagcggagccctgctcatcaagaacccaatcgaccgagaggcactgtgtgggctcagtgccagctgcatcgtgcccctggagtttgtcaccgaaggtcctttggaaatgtaccgagcagaggtagagatcgtagatgtgaatgatcacgccccccgttttccgcggcagcagctggacttggaaattggggaggcagctcctccaggacagcgtttcccgttggaaaaggctcaggatgcagatgtggggagcaattcgattagcagctataggctgagctccaatgaacactttgcactggatgtgaagaagcgcagcgacggcagcctggtcccagagctgctcctggagaagcctttggatcgagagaagcaatcggactaccgcctggtgctgactgctgtcgatggagggaacccgccgagatctggcaccgcagagctccgggtatccgtgctggacgtaaacgacaacgccccagccttccagcaatccagctacaggattagtgtgttggagagcgcaccagcgggcatggtgctcatccagctcaatgcctcagacccggacctgggtcccagtggtaacgtcaccttttatttcagtggtcatacccctgatcgtgtaagaaacctctttagcctgcaccccactactggaaagcttactcttttggggcccctagactttgagagtgagaattactatgaatttgatgtgcgggctcgcgatgggggttctccagccatggagcaacattgcagccttcgagtggatctgctggacgtaaatgacaatgccccttacatcacagtgacctcagagcttggaaccctccccgagagtgcagaacctggcactgtggtggcacttatcagtgtgcaggatccagactcagggtcaaacggagatgtgagcctccgcattcctgaccacttgccatttgccctcaagtctgccttcaggaaccagttctccctggtgactgctggacccttggatcgagaggccaaatctagctatgacatcatggtcactgcttctgatgctgggaaccctcctctcagtacccacagaactattttcctcaatatttcagatgtgaatgataatccaccctctttctttcagaggtcacatgaggtgtttgttcctgagaacaatcgcccaggggacctgctttgctcccttgcagcctctgacccagactctggcttgaatgcgcttatctcctactcactcctggagcccaggaatcgagatgtatcagcttcctctttcatctctctgaacccccagacaggagctgttcatgctactcgatcctttgactatgagcaaacccagacactgcagtttgaggtgcaggcccgggatcggggcaacccaccccttagcagcactgtaacagttcgtctatttgtgctggacctcaatgacaatgctccagctgtgctccgtcctcgggcccggcctggttccttatgtccccaagcactgcctccatcagttggtgctggccacctaatcacaaaggtgactgctgtggacttggattcaggttacaatgcttgggtttcctatcagctcctggaggccccagatcccagcctgtttgcagtctctcgatatgctggggaggtgcggacggctgttcctatcccagctgacctcccaccacagaagctggtcattgtggtaaaggatagtggtagtccaccactctctacctctgttactctcttagtgtccttagaggaagacactcatccagttgtcccagatcttcgagaatcttcagctccaagggaaggagaatctcgtctaaccctctacttggctgtgtccctagtggcaatttgctttgtctcctttggctcattcgtggcactactctctaagtgtcttcgtggggcagcctgtggagtcacatgctttcctgctggcacctgtgcctgtctcaccagatctcgaaggagggaggggcttcccccttccaatgggatcctccgaatccagctagggtcagatgaccctatcaagtttgttgatgtgggaggccactctcatggctgtacacccttggcttctgcacccactcggagtgatagcttcatgatggtgaagtcacccagtgcacctatggcaggggagcctgttcgcccaagctgcccaccctctgatcttctctatgggctagaggtgagacctttgcaggctcaacaaatgcttgagggttattctgatccaggcatatggctaggccatgtcctagagagtactggcctctcagtaagtgcccatagtgatgtcaccatttttgtaagaggtaactatgtggtagacgctgtgctttgtaactgtttcgtgaattaaccagagttgtcacagtttagcattgggggcgggtcatgcctatatctgagtaagaaatgaaagtaattggtgatcaagagccaggctgttgtggaagcatgatgatggaatgtgggagcacaggaggctacagtgcacagggtacagtgcaccaggcagtcacttggacaaaggtggctgttttctctactcttcctgaaagaggggatcagattctgaagtaccttaactctaggttaccatttcccaagggattgaggggaaataaaatctttgtctcccagtatctagtacactgtgaagggacctctctatttgaaacatagagacagcagaaagaggagagaactaaaggaatagagaggcacgcatcagagtggtggcatagatcttttggtctgggtcttaggactcatatcaagtccctactggggatttgaactagatgcggtaaattggaaggttggggcgggttggtcatcacctttggaaaaaacagtaagtgaaatcacttatgtcagaaaactggtttacagttggctgattcatagaaacagccaccctgtgcatctttaagttgagttctcctgaatttggtgaaaccatgaaacctagaagccaagccatccatgcttggcctctgaccaccctcctgggtgacctgattcagccccagaaatgttcccctacccaaaaactgtaacactcattccacatttggggtctggggtgtcagaaaagctaagtcccatgtcagctgacattgagatttccgcaaagcattgctggagagtcagggcaagactttacaaggttcttactaatcttttctctcaccttagcagcattcagcaggatgggggagggtgggggaatacatgggctttgcctctcccagaaggacaagattttgctggttcaagcaaagtggtggaagcttctgaagtcatgcaggaagttgctgggacagaacgctgaggagttttgtatcactttgtcttccctgttgagtaccatctgagctgtcaaactttgctgccaagggggctgaatcaacctgcagcacgaagtgagtggggaggtaggaagcttctgtgacacagatttgcagcctgtgttcccaaggtttccaggattgaggaaactccataattggttgagagcacacagactttttggccaatcagactcagagctgaggtgggagatctgctcttccagcccgcctctcctcctccagctccccagctccactcaaattcagctcccctcccccctgcccacccccgccactcggtgactaagaactgctgcaagcaggcaaacctccgagcagtttttaagaggctggaaggagacataagagacttcagctgctgcattccaagccctgggtctaccttggagacaggacagcacagacttactctccacaaagggacttctgggtcatggggcccaagacactcccacagctcgctgggaaatggcaagtgctgtgcatgttgtccttgtgctgctggggctgggtgtctgggcagcttcgttactcagtggtggaggagtctgagccggggacgctggtggggaatgttgctcaggatctgggcttaaagatgacagatctgttgagccggcggctgcaattgggctctgaggagaatgggcgctatttttccctgagcttgatgagtggtgccctggcagtgaatcaaaagattgaccgagaaagcctatgtggagccagcaccagctgcctgctgccagtgcaggtggtgactgaacaccccctggagctaatccgtgtagaggtagagatcctggatctcaatgacaactctcctagctttgccacccctgagcgagagatgcgcatctcagaatcagcagcatctggggcacgattcccactggacagtgcccaggatccggatgtgggcaccaatactgtgagcttttacactctaagccccaacagccacttctctctgaatgtgaagaccctaaaagatgggaagccattcccagagctggtgctagagcagcagctggatcgtgaagcccaggcaagacatcagctggtgcttactgctgtggatggggggaccccagcccgctcagggaccacccttatctctgtcatcgtgctggacatcaatgataatgctccaaccttccaatcctcagttctacgtgtgggaatcccagagaatgcacccattggtactctgctgctccgcctcaatgccactgatccagacgagggcaccaacggccaactagactattcttttggagaccacacatctgaggcagtgcggaacctctttggcctagaccctagcagtggggcaatccatgtgttgggtcccatagactttgaggagtcacgtttctatgaaattcatgcaagagcccgtgaccagggacagcctgccatggagggccactgtgtgattcaagtggatgtgggggatgtcaatgacaatgccccagaggtgctattggcctctttggccaaccctgtcctagagagcacaccagtgggcacagtagtggggttgtttaatgtgcgagaccgggactcaggtagaaatggtgaagtgagccttgatatctctccggacctgccatttcagattaagccttctgagaaccactactcgctgctaaccagccagcctttggaccgggaggccacatcccactatatcatcgagctgctggccagcgatgctggttcaccttccctacacaaacatctcaccatcaggctcaacatttcagatgtcaatgacaatgcaccccgcttcaaccagcagctttacactgcttacatcctagaaaaccggcctccgggctcccttctttgcactgtggctgcctcagatccagacactggggataatgcccgcctcacctactccattgtaggaaatcaggttcagggagccccagcctcctcctttgtgtatgtcaacccagaggatggacggatctttgcccagcgtacctttgactatgaattgctgcagatgctgcagattgtggtgggggttcgagactccggctctcccccattgcatgccaacacatctctgcatgtgtttgtcctagacgagaatgataatgccccagctgtgctgcacccacggccagactgggaacactcagccccccagcgtctccctcgctctgctcctcctggctccttggtcaccaaggtgacagccgtggatgctgatgcaggccacaatgcgtggctctcctactcactgttgccacagtccacagccccaggactgttcctcgtgtctacacacactggtgaggtgcgcacagcccgggccttactggaggatgactctgacacccagcaggtggtggtcctggtgagggacaatggtgacccttcactctcctccacagccacagtgctgctggttctggaggatgaggaccctgaggaaatgcccaaatccagtgacttcctcatacaccctcctgagcgttcagaccttaccctttacctcattgtggctctagcgaccgtcagtctcttatccctagtcaccttcacctttctgtcagctaagtgccttcagggaaacgcagacggggacgggggtggagggcagtgctgcaggcgccaggactcaccctccccggacttctataagcagtccagccccaacctgcaggtgagctcggacggcacgctcaagtacatggaggtgacgctgcggcccacagactcgcagagccactgctacaggacgtgcttttcaccggcctcggacggcagtgacttcacttttctaagacccctcagcgttcagcagcccacagctctggcgctggagcctgacgccatccggtcccgctctaatacgctgcgggagcggagccaggtgaggggctcggcgccgccccgggcgacccctgggggcggcactggagaagccgcccgtcctcataagggattgaacttgcatccactcctctccggccggcttggtcgctggctgcgctccacccgattctcgggatcattggaccgtttgcgcgaaaccagagtggccgattaagggatggggctccgagcaccgggggtggtggcgactgtgggcgaggggaggtgggaccgacccccacccctacactcaaaaaaggccggggcctccttcgagcttccggtgaatttcgggcgatttccgcgggtgtcgggggtcccgggaggaggcagtcacagatccacccctgcagccagcctcctaggcgccggctccggcacgcttcgccggtctgtagatttcctcttcgatttctccccagctcccagcatctgtgacttcactgttaccctccctatccccgcatcacccaaccgcacctgtctgcgggacttaggtgtgcgcgcggggctcatgcgtgtcctccctgctggccacccccacggcccacacaagttgcacgggctcgccacgccccgccaacacgtgcgcggacgcacgcacgcactcctcgcacgtgggcttacgcgaataccagctttcactgccactcgctcgcggccagattcacaggcctgttccggtccactcgcagctcccctctgccgctccctccgccgggctcaggagtactcgtagctgattgtgcgcgcctgagggtcccagatcgcggccgcccaggaccaggcgaggactccggagcctcctctcacctctcccacctgcgccccgggctgggccgggtcgcctggggggcggcctgagcgaggcgcggggccaggagcgctggagcgactgccgctctaagtgccgggcgggcaggactctacgatccttgggccagaggtccggatggtcccgggactccgtctcaagggtcggcgacccctcaacccagaagcctcgagcaggcggacaggcagagctgcccagtggccgaggcgcggcagggctccgcgttgggcgagtgagtgagcctctataggacagcaggactgggactccagtggcaccagcggccccttcctcccgcaggaagtgaaagcctcgagcgccctggctctcaacccccagagatacaggcttttggcgccgtcgtgatcacaatgtgcccagcgatctagggtcagagatttggaggtgaccaaactatctgacactctaacaagtcctgtctcctctggcagatggaaagctataggctctgccagatgccagggtgcccttatgtgtgaggaaactacaatagtaaaaaacacaagtttctccaactccaggagcttttattcaaaatatatcaatgcctaactctgctcctaggactgtattttgaaacacccccaggtgattttgatagctgattgagagaaacttactatataactcctttgagaacctcatctcatttgctcttcccaccattgctgttggctaggtactaacatgcctctcttataacagcttcacagaggtcaagtgacttgctcaagttcacagagcaagtaagagagattctaacccctgtctaactccagaatgtgtgcttttaatttcttggcacttggaactttaaaagcttgaggacaggagaggggagttgcctctgctgggattttgcttctgctgggatggggcaagggtggggttccttcccttttaggaccttacatgtggggaaagtcttctgtggctcctcatttctgagcagtccccgcagcgcaaacttggccagttatccttttggagattgagttcccccagctccgtttcctcctatcacaatcactgcatttccatgtagattctgctgtgtctaagaatacagtggctgagggctggccatccctgtgcccttctccatggcagccccagaatggtgctggtgactcccgatacacctggaatgctaggtttctgggttctgctcatatcactgccacctgtgagccttgagtgagccactggcagttccggagcttccttctccctggagtaatctgagatactcacactctctgcttctgggagcaagtatgagtattaattaccagcccaccccagaaccagtgaggaggtggctctaggagtgctccatgagagtgtgtgatgggataacacaccccctggaaagaccagaagggactcaggaatgaagtggctggccagagccccacaccttcagctaggtgggagatggctacacatcagccccttgggagccctggagacttagttggccctgcttggaggctgtgggagctggatccctccccgctgcatcccttccatttttctccgtctcagacagagcagccttgttctcttctccttagtcacagaccattgtctggcacggagttctaggggtgagaagtgtcccgggacttggatgccccgcaaaggcccaatctggcatgactcctaaattaataatgtatttagctgtgggaagagattcttgcaagccaagggcccagagaagatgtccctgtgaatgtgtcactgcacaacctggcaccaaaagggttaccaagaacagcagccatcttgctgcagaggatgctttgttcccagctgaggagttgaataaattcattctagggctggtagaattctcattgaaaagcctcctttgccactttagggggctttgtctgcacctcttcccccagttccacagaagatgccttcagtccttgaattttggctcaggagttctgactctgggggcagggaggaaggggccatttctttaggaaaggagtctcagcttgctcactgtggtcagatgaaatgtgatttatctcttggtttctggtacctcagacctctgagacctgaggtgtattttgtctttggagatgagtccacccctgccccctcttagtccgttttcttctctgtgcccactcccctccttctctcccggcccatccctaggggctcgggtgacattctaacttctcacgggtactcagcccctttccctctgttttctccacagcaagccccgcccaacacggactggcgtttctctcaggcccagagacccggcaccagcgggtaggtgactgattctccagcccaccctcttctctgcggcattttctcagggatgacgtgggaggagatgggggagggcccagcatttgctacagatggcttctccctcagtttgagatcccagggaggtcttggtgtgcggggggctggcacacagaccccggaaggaagaggcgactgccctgactgttcaggaagctcaattcacatgcttgccccttccctcctcgccacgaccggcaccttttcctatcccctgagggcactgtggaaccaaaggatggtcttaagctggtctctgggtgaaagcgaggctttctatgcccatgtactgcctaaccccctcccctgagttgagctgggctccattatgacctggggctcaggcagaaaagcatttgaccggaggaggcggtccgcactcagcgcctcctccagagcctccagagccgaggctgactgcagcctggggagagtggaggcagcacagctggaggtggaactgaggaaggactgggcggggcatggagcaggcccccttctccggcccctcctcccactgtcctctgcccctacttgtcctgctctctgtctgtggggtctccgtgtctctgcccctttttcttgagtttccgtctttgccactttctcttacctctcagtccttccctcagtctctatctcgctttgcaatctctgcctctccctctcttctccatctctgtcttagcttccgtcttgattgctgcacctcagcctcagtccctttcatttgtctacttgcattgatctgtgccgcccactgtgcctgccatggcataagtgctcaataaatgtggagtgagtaactacacgggacccttagtctctttctccttctctatctctgcctccctgtccttgtcctggacctcttttctgtttctcctttcaccgtttcctagcgccttgtgttcttctatccccagcctctatgtttctctgtctctcactatttctgctttcctctctgttctttgtctctctttgtctctgtctctgtatatctttctttgtctctgtctctggtctctgtgcctgttgtctttttctgcctctttctctgttactctttctttatctctctttttcttttatcttgtcttttttctctgagcctctgtctctgtctctcatttttttgtgcttgtgggcaagccagcacacacaaccccccacccaccacccaccaacaccccgctctcttccttccctgcccctcacacactgagcctttgatcgcagctctccaccagacaccctcccatccaagcagccccagctgctcatttcaatctggtatgaattcctgctgagacaggaaccccctgcgggctgaaggggagggaaacttcagcagaaagaccttcagttggtctgagcagagtgggataggctctgcgccaggcctcccagttagaagtcaggagcctggaggagtctcagagcccagggagagaagcaggagcttgggccaccttaccctacctcctcaatggttgagtacttgctgtccacatttgccaagttgctacagatgctgagcttccaagagttatctttcccccatcctgcaaccaaccaaacccttgttgccacaaggacccaggagcccttggtgtatggcagagattccagcttctgggcatgcacagtcctgtcacccattttaggaacgcaaagcgcttcttagaaggcccctaaaaagcagcagatcaaaaggcttgggctgcccttgcccttcctttgaccccagctgttgtccttctccctgctggccttgccaaccttctcataagttatccattaagtcattaatgtattcattcgttcatttattcaacaaatatttatcgagcatctactatgagcagggccctgtgctaaacattgggctataggagtgaacaagtagatgtgatcccagaactcataggcttccagaccagcagaggagactgaaaatttgcaacaagtaacacttaaaaaaaaaaaaaaaggctgggcactgtggttcacgcctgtaatcccagcactttgggaggccaaggtgggtagatcacttgaggtcaggggtttgagaccagcctggcagccaacatggtgaaaccccatctcgattaaaaatacaaaaattagccaggcgtggtggcaggcacctgtaatcccagcgacttaggaggctgaggcagaactgcttgaacccggaaggcagaggttgcagtgagctgagatcacgaaaaaaaaataatctagccacaaatcacagtaagttctgagaggcagagaacaatgtgagtgtaatgggggggggaagatcagagaaggcttctaggaggaggtgacattgagaagttctaggccatttatgttccctctacctaccaccaccccaggccatacactggctttgaagcagaattcaccattgaacctggaagccccaccaactgcctctcatgtgtcctctggggtgagcaccttacccctgcctcaactcccattccatcaaatgagaggcttagtggcctggaatacatgtgggagctcttggagatatggaggagaaggtgcggaacctctctctctctcctctctctgcttccttagttaacttgtggaggatgcaacaaaccttttttttttttttttttagacagagtcttgctctgttgcccaagctggagtgcagtggtgcgatcttggctcactgcaacctctgcctgccaggttcaagcgattctcctgcctcagcctcccgagtagctgggacagcaggtgtgcaccaccacacccagctcatttttgtatttttagtagagatgggtttcgccacgttggccaggctggtttcaaactccccgacctcaactgatccacctgcttcagcttcccaaagtgctagaattacaggtgtgatcgcccccggccacaacaaacatttttgattcagcggctccaaagtgaaataagcgttaggatctagtccagtaacttcaacttctctccttcattcattcaacaaatggtcagtgagcactttctgttggccaggcagtgttctcgatgtgggaggcccctgccctcaaggagtttacagtgcactgaaggagacaaatattgaccaaataattacaaaaataaatgtgagactgaaactgtcataagtgctaggtagaattgtatctggtggtgtgggcgtataatagggatttgatttagggagcaggaggacatcctggaaatgaagttgtgctgagatctgaaagacaaatacaaattaaccagctaaagaaaagaaggaagagcattccagatggtcaggcataccagcttcaaagcagggctggtgttgagttcttcagtaaacttggttcaagatcaagccagctctgggtcacactgcctacacagaaggaagagcattccaaatgggaaaagcctatgcaaaagccttgtggtgaggcctcctgggatcaagggaatggcagggagttttctctttgctggcactggagtgaggggatgaagaggagaggttccttttatccagtctaaccctggttccagccttctgttgatgccctgcctcactccctccccaccatcttgcccactgccctccagcctggtctggtcagacacaccagcttcaaagcagggctagtattgagttcttcagtaaacttggttcaagttcaagtcagcactgggtcacactgcctagacagaaggaagaagacctggccaggtgtggtggctcacgcctgtaatcccagcactttgggaggctgaggtgggtggatcacctgaggtcaggagtttgagaccagcctggccaacatgatgaaaccccatctctagtaaaaatacaaaatattagccaggtgtggtggtgcacacctgtagtcccagctactcaggaggctgaggcaggggaatcgcttgaacccaggaggcggaggttgcagtgagctgagatcacaccactgcactccagtctgggtgacagagcgagactccatcaggaaagaaagaaagaaaaagagagagagggagggagggagggaaggaaggaaggaaggaaggaaggaaggaaggaaggaaggaaggaaggaagaaaagaaagaaaaagggagaaaaaatgaagaagacttacattctgaagttcctgcttggcacatgcttctcctccccaccactatcccttctcaggtcatcctttgggtgtctgatcccaatagctgttgtctcaagctctgagcccagcaaaccatttcccccttcttaggctgtaacccaggccctgccctgcagctgtccccagcctctgcacaaagagtctccatttggtccctagactgttctctgatggctccacactaccatccctcctctgagagacagtatccctgctctctctcagtttgggcagtcattcaacaaacaaatagcaacttaatttttttccacttataaaatagtacatgctcattatagaaacatgaaaaatagaaaaaaaattaaaaggaaaaccacccatcattttacaatctagggagaaccaccaccaactacagtttaatatgaaacatttcaaatatgtacaaaagtagagagaatggtgtcatgaacctgtatgataccactatccagcttcaactaatgccttatcttgtttcacctatatccctacccttatcctgtccttggattcttttgaagcaaatctcagacatcatataatttcatcttggtctccaccatctttaacagatgacttttttttttttttttttttttggagacagagtctcactctcttgcccaggctgtggcacaatctcagctcactgcagccttcgcctcccgggttcaagcaattctcatgcttcagcctcctaagtagctaggattacaggtgtgcaccaccacacacagctaatattttgtattttcagtacaaacagggtttcgccatgttggccaggctggtcttgaactcctggcctcaagtgatccaccctcctcggcctcccaaaatgttgggattacaggtgtgagccaccttgcccggccagatgattctttcataaggtccacattttatatttgagtgagtgtctcttaagtatcttaatgctcttttaatgtaaaagacttcccctccatcttccatttttgcaatttatttgttgaatccctgccttttcatatatatctttctaaacttttctttgtgtaatcaaagaacatgcatgagcttcatttttatttttatttatttatttatttatttatttatttatttatttattgatacgtagccttgctctgtcacccaggctggactgcagtggcgcaatctcggctcactgcaagctccgcctcccaggttcacgccatgctcctgcctcagcctccagaatagctgggactacaggcgcccactaccacgcccggctaattattttgtatttttagtagagacggggtttcaccgtgttagccaggatggtctcgatctcctgacctcgtgatccgcccgcctcggcctcccaaagtgctgggattacaggcgtgagccaccgcgcctggccgagcttcattttaaaaaaatctcattcacctaaataagttgttcacaaacttgtcacactttcatgtgacactttattcacatattaagaactgttattcccagtcatacggtacatttcctactagttttttaaaaatagcaactgaggccatactgtccaacagaattatagcttttttcttctttgcagtgtatcatgagaatttccccatgtctttcaaaattcttcccaagtcatttgcagagtaactcctcttatgaatatacatattattttacagaataagtcctcatatgaatatacatattatttttctaatgctaatgggcttttgctacattagaaaacatacacattcatttacaattttttttttttgagacagtctcgctctgtctccaggctggggtgcagtggcgccatctcggctcactgcaagctccacctcctgggttcaagcaattctcctgcctcagcctcctgagtagctgggactacaggcacgcgccaccacgcccagctaatttttgtatttttagtagagacggggtttcaccatgttgaccaggatggtctcaatctcttgacctcgtgatccgcctgcctcagcctccctaagtgctgggattacaggtgggagccaccatccccagcctcatttacattttaacacaattaaattcagggtgttgtcagggtgacttcctagatttctcagttttttgagcatgatgtagggagtattttattatagtccagtctatgggatattcccttatacacacacacacacacacacacacacacacacacacacacaccccaaactcaatagggcaagaaccatattcatcatctcttaaatcctaggtcctgtcacaggccactgcttggaaaatagttgactaaatgtagtccatttcttccatttttacttttcactattccccaaatcctggaagagtccctcatatctgctgctggggctccaaggcctccaagctgaagcccagtacgttgttgtgcataagatcataggccctggaatcatattaggctggctttcaggttgcaactctaccagttccagctgtgtgactctggtatagtctctcaacctctctgagccctgttttcatctgttggaaaatatagataatcacaacacttatctgcagggtgattccgaggataaaaaagacaaatatattacccagtcagcttagaataggaagctctcagtaaatggttaaaaaagaggtctctctccctctgctcatctcttacccagcttcacataattggcagcccacccacctgtttggccctcaaccttcaaccatttcccaggacgcctccttacactcctgatcatcatggttccaaccccactgttccactcagctttgttccctcaacaccactgctccctgtgacaggtcatcctcctaacctctggcatctggtcccgttgtctccctgacaacccgcatgctctcctccctgcaacccccgccgcttgcctgctctccctactttattcccattagcccccttcacctggggctgagaacacctggccttgaccctgcaccctcagccaggcccacagagctcagtcgggccggaagtaaggaccccagatattcagttgaggaatttaacattaatacaataatatagaatccaccagcagattttcataaatgttctgtgtgttcttttatccttttttttaatccaggattttatcaaggagcatagattgcatttggttgtcacgtctttcctctcctttaatctggagccagctcccagtctttttatttttttaatgacatggatatttttaaagagtccaggccagttgtactttaaaatgtccccgaacctggatttgctggctattctctgatggttagattcagattacacaccttggtaggaatacttcccgcagcatcacactgggactcatctaacgtcggcctgtcccactatcagtgatgccgagtttgttcgtgtggtaaaaacagtgtcccagatctctccattataaaaatatatttttataaagatattttaaaatatttgtgaaaatataagtaatctgtggatgatactttgagataggcagcaacccttcatgcaattttagtattccctgatgatccttgcctgtatctgtttttacatcagtgattacaaagcggtgatgttctgtcattccttctacatgtatttgctggtattcttctgaaaattacctggatgatttcttcagatttaaattcactgtcttttccttggggaagcctggactggctgagctgcctaaccctgactctctgtcttttttttttttttgacagggagtctagctctgttgccaggctggagtgcagtggcaaccttcacctcctgggttcaagcgattctcctgcctcagcctcccaagtagctgggattacaggcgtgtgccaccatgcccggttaattttttttttttaatatctattttagttgagacagggtttcaccatgttggtcagaatggtctcgatctcctgacctcgtggtctgcccgcccctgcctctcttcataccctctggtagcccctgacacagcccatggcaagtatcacaattgcaattactctattgtgtaattatttaaaatcagcctctcagtgcccaccatgagcaccgtaaagatggacagtttctatcatactcacagccacaaccccagcacctggctctgtgtctggtacatagaaattgctcaagaaagaattgttggaggggcgcggtggctcacgcctgtaattccagcactttgggaagcggaggcaggtggatcatgaggtcaggagttcgaaaccaacctggccaatatggtgaaaccccatctctactaaaaatacaaaaattcgctgggcatggtggcatgtgtgcacttgtcgtcccagctgctcaagaggctgaggcaggagaatcacttgaacctgggaggcagaggttgcagtgagccgagatcgcgccactgtactccagcctgggtgacagagcgagactccagctcaaaaaaaaaaaaaaaagaaaaaagaaaagaaataattattgaatcaatggaaacagaattacaactcttcccacttttgggaaggagaattgagattcctgctttccccttcaaccctagctttatgtttgttgtgatggtatagaggtcacacatggcagccttgtgtctgttcttaggctgagttcatctacttagggacggggaatcccagattgggcaaaaccaaaagcagggacagaccttggaaaaattgtaaagcagttcttggttgtgctcacccaccatgacaaaatatgcacacacacaacgcaacacacacacagacattttcatgccttcaaggcctaccctacagcctttcccatggtgccaaacccttcttcttaccttacagtcacttaactgtctctgctggtctcttcccactcatttaggcaacaaatatttattgaaaaacttctctgagccagatggtgccaaacagttacctaaagggcagactgtgtgtgtgccagggctgtttcccgccaacactcccctgcaaattgaaataatttcatccttggaaattcaaaaaaatcatgaaaattgtcactgtgggaaaattccaagtagagctgaaccttctaagaagcagagagttcttcttatggtttagtatttttttaaattatgaatcatttcatgttttttcaacactcggagtttctaaaagtctcacttaggtccaagtgctaggctttgtgctaggtgcttcagtaggaagcaggtggagtcgctgcctcacagaagccagtgtggtggaggaacagacaggcactacaacagctgcagtgtgactagtgccatgtggggcagccgctgggatgggagtacagtggaggcacctgcccagtctgagtggatctcctctgatatattttattcgtgtcatcatggcaaatgttgggggactggcattctagggaacaccatctgcccaggattcacagcaagagggaacttgagggataggaaagtgcaccttggaaaaggtttgatgatagagtgtttgagggcggggggtgggggttcttgtaaaataggaggggcaggttcttctatggccgtggattttactctgagggcttaggaagccattgaattttagaaatttcttctccctgctccagggtctcttggggcctcctacatctccccctaggtacctcctaggtccccactttttctctagctctggaacattctcttccatttcccaccttcacagtcctctggagaaggtctgatctccctcactatgacaggaagccaggctctctcatggtgggtgggggaatgcactatgttcaatgcattggaccagcctggccaacatggtgaaaccccgtctgtactaaaaatacaaaaattagcctggcacagtggcaggtgcctgtcatcccagctacttgggagactgaggcaggagaatcgcttgaacccaggaggtggatgttgcaatgagccaagatcgcgccactgcactccagcctggatgacagagtaagaccctgtctaaaacaaaaagaaaaaagcatcggaggcagcaaagagctggtttgagggactgacttgtgggattctggcttctgaaggattgtagaagtgcctcctaccttgctgagagaaacaggtcttgggcatggggtagggttagggtactaggtttgggagccctgggagaggacaggaggggcatgagctgtgccggcctgggagtctgtgctcaccatcctactctctccccagctcccaaaatggcgatgacaccggcacctggcccaacaaccagtttgacacagagatgctgcaagccatgatcttggcgtccgccagtggtaagtggtgtcagtgtgtgtatggaagagtgggagacctggggttctggggtgcatctcacagccaccatgcccacggactggatgtcaaacctgtgtagtttctccagatctttcggcaggtctgaaaggacccacaattccaaacataaagcctggaattgtggctaaggaacagcagaggggttgggggtcctgggatgcctggaggagagcgaacaaggaaaagactcatggagggaatagtggttacaagtctagctctggaatgggacagtgtagctcaggtcctagctctgctactatccttgggacttggatcgacttgctcaatctctctaaacctcagtttcctcagcctagaaagtggggacagggaccccaaagggttgttgtagagattaaatgagatgataccacaaagcatagagttctgggcctggcgcttggaagccctcaagcaatgaaagtgggtgtagaaatccccagccgagagaacacctcctctttatgcgaggctcctcttttgctgcccctaactccagagtaggattctggttttcccataaggttgactaagggcttcctttgtaatagagattcggctagtggtggttgtccctgaagagtcactagggcccagagcaggagaagaagaatatcatttgtccttaagagcacagcctaagctgggcgtggtggctcacgcctgtaatcccagcactttgggaagctgaggcaggaggatcatgaggtcaggagttcgaaaccggcctggccaacatagtgaaaccctgtctctactaaaaatacaaaaattagctgggcatggtggtgcgtgcctgtagtcccagctacttgggaggctgaggcaggagaatcgcttgaacctgggaggtggctgtggtgagcagaaaatcgcaccactgcactccagcctgggcaacagtctcgctctgtctcaaaaaaaaaaaaaaaaaaaaagagcacaggctttagaggcaggccaatctggattcaaatcctggcacctggcaccaccacttagcaatgagtccttaggtaagttattaaaccccctcggtttcacttactattaatgggcacagtattaacggatctcattgtggtgttaccagggccaaatgcaagtccctcagcacaggattggcagagagtaagggcacaatatattattatctttgctgacccaaacccgttttttactgggtagaaagcagaattagaataatgcctattaataaagactagcttctggagcagcaaatcctgggcttataaggaggctggcagaggatcaaggcattgccctatatcatgaactgatagccctgccctccagcatgtctggaggactggtgggtagagaaccaggtgaaatcacaagaagcactgtcatcacacctgggcacatactaaacaaactttaggggcctcctgtcaatgaatcctctcaatagctctgcaaggcaggtctgatttctcacactcgacagatgagagaaccgagaaggcacttgccccagggtcctcagttttgagctgccaagctgaggttctaacctggctcaactcctaagtttatgctctttctactatagggaccatggctgcctttggatccagcctcggcttctctattacctgagcaggatgagaggctgtcctcttcctcgagctctgctttattcttccagatcagggttgccagataaaatacaggatgcccagttacagttgaatgtcagataaacagcaagtactatttcagcataagtcagtctcaaatgttgcatgagacataatgtactaaaaaaaaaaatgctcattgtttacctgaaattcaaatttaactgggagccctgtacttttatttactaaatctggcaactctaccccagatgtctgtgaggttaagtggggccaggcctacagctgacggaaggacagagagagaggtggcagggactgctggcctcctgaggcagagctgtcccaggtctggtggggctatgattccagagaggccagagactgagtatgaaagtggcaggcggctgggtctgaggagatgccaagttggcctcttgagggaaataaacaggtatatttagctgttgtggccttgcgccctgaggccaggaagcagctttttagcctaaatccagatgttaaaaacagaaatgaaatcagtatttatggccccaaaccctccaagcaagtcatgcagctcgttcccctgtcaaggcctcccacctttggcccacacagggcctgaccctcgtctaagcctgcgccctggggaacggaccctgggggtggaggtggtgggtcaggccctgctctcactttcacacccgcttcctagccctgaaaccagagaggttcctgaagtccagcccagccaggcctgtggggctgctgagaggggttaagtaagagggagagtaaaaaccgacacttgggaggaggcttttaaaataaacatctgcggggagggatgctctcaaggaggctgcggtttgcagctcagccagctgtgttccagctaatcagcctccttgggctactctggagttgctgccttggccctgggatggggtaggttaagaggacagagggaggtcagggagctgggggctgagtttccctgagtagaggctggcacaggagagaaggcatcacccccacctcgtccaggccagaagatgtccagcttcttgaggctctcctaagtctgcctctcctgggaccaagagaaaatcccggtccttgaccaaggtgggccttggggggagtggggtgtagagggaggggcactggagaactgactctacagaaagtcaaagctggcaatccaacttcttcccctcagatttatagatgggaaaacaggcttgagccacgcagagacttgaccaagctcacacagttccttagtggcagagcagagcaaatattctctttcttttacattctggatttccatatcttctctccctcctggtccagcccaacctcagggcaccccccacgaggtgggcgggggatggctttgtcacttgcacccactcggggtgctactcagagatcttgggtgcacataggacgtgggtgggccgagcttctagctactccgtcaggcccttcctgtcattctgtctctgcctcccttctccctgcttctccgtgttcctcctcattcttttctgtgtgcagggagactacaccccccaccccgctctttctctggcgcctctgaggtcccccctctagcccctaaatcactctggaatcctggctctttgaagccagatctgggcccccctcccctaccccttccattcccaggctgggaaaggctgaagaggctgacggctggaggggagggggcggggcggtggcggatctggcttccttttggagttaattagggaaaacagagaaatgtcagcggaatgaaagggctgggggtgggggccagctggggtaggagaggaggaagtgggcagctgctccctcccactcaacccctctcccccgcccccagaaagctctcagctccggggatttgcgacatgaaatgggggctgtagaaacctgagcgctggtgcgtgaagagaaaaaccgaggcgcatcccggctctcccctcccgtgtgccctcctcctcttatgccggcttgaaaatatttcctgtctctctatttctcaatccctggttgatgtcccaggattactcagcctctccggctttagtcactctcgctacccgctcccagggtccagggtggaggcagagggaggctgggagagaagctctactgccagctgggcctgggctggcctgggcatccctgaggttttaactgtctcctaaccacagaggatctcagggcctccagcagcgagccccaatgagtcaaactcttgtttcctcctctcccacccccgacccagtcagggcaggtgaggggtagaggtgatggcatgctggatgtgacggtgttgatgatgtattgcacaggatgaagcaccatctcatttagtcctcacagcagccttcacagtgcgtacaaatcagctggcaattccgagaggctgcattctaaacaagttcctgggtgatgctgagccagggccagagtgtggacttctctgggccccagtttcttcttctgtacagtgggacgttggactggaggtgctgtctgatgtcacctagctgtggcactctgagcctgtgcctaaagtgtccctgagatgtctagtccccgagatcatcatctcctcagcttcatagagccgagctcttctccatcttctctctacctcccattcactcagaacagggataaggtccaagctgctggtggtgatggtgactgactgtcccttccagcatgcgcttaggtacacttgggcctgaatgcccctctaacaaatgctaccgggtatggccttggtccttctaacacttggttccctcatctgtaaaatgagggtcataccacatagctggctgggctgttatgtagaggttaaaagtgattgtgcatgtgaagcatccagcagagtgcctggcacacagtaggtgctcaaatgctgttttgaaatacaaaaattagctgggctagtggtgtgcacctgtaatctcagctactcaggaggttgaggcaggagaatcacttgagcccaggaggcagaggttgcagtgagccgggatcgcgccactgcactccaggctgggcgacagagcaggactccatcttaaaaaaaaaaaaaaaaaaatgctgttttgaaatggaggcttggaagagcactcttcacccccaccccacacacttactaacggaactaccgaatctctactcgtgccaggccttgcttggcaaaggctaggggcatgtaaagccatggtttcatggctgctgccctccaggagcccatggtctagtgtgggagtcagaggctcccttgagaaagccagggcaaggaactgagagcccgtgtcacagccctgagagaaataccagcgaatgtgttttgagcacttacatctaccaggcactattttacgtacctgacatacattttcttatttagcattcactaaaaccagaagaggtggttaccattatcatccccattttgcagatgagaaaactgaagtggcataaggaggttaggtagacttgcccaggatcacagtgagtaaggaaaggagctaggaatcaaacctagactttctcactccagagcctcttaacctctaccctcaactcttgtgaagagagactaccttggtgacccctatattcccagtgctcagcgtggtcaaggcccagggtgctgtataggcattcattaactgctggggatataagacagtgactgttgaggaccctaagtttagctcccacctgatcttcctctgtctctgcagaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctgaacgtttctgtataagcgatggaagctcctggcatgtgtgcatgaagtgatgagctgaggtgggtgctggaagaagggcggaatcgggaggccactctgtgtcattgcgcgtctagatgtttccgaattgcgtgtgtgtgtgtgactgtgcaatatggttgtgtatgcttgcaatgccgttgtgcctatgagac

SEQ ID NO: 14859 - DNA, 150833 bp, Human
ctccaagcctggacctggggttctccccaattacagtgagggtacattgccctattcctacaacctgtgtgttgcctcacaatcagccaagacagagttcaattttctgaacataaccccggaattggttcccgcgcaagatctcgtctgtgacaatgcctcttgggaacaaaatacaaatcatggagccgctggggtcccttttgcctcagatactattttgaaggtgagctttaattaatttattttcacttctggttttattgtttcacctaatttgggtaggaagttccactgcgtatttctttgtctgtgagttagatttggccaatgttgtgccttaattgtcttaatcttatctaactgaattttaagtgttttctctctgaagtgtgagatttatttacccatgattgcaaacctttatcacatgagatattgcactgtatttctttttcttcctcatctttacattacttctctctgcagatttgttgctattgagactttaggcaattagtttcaccttcaggctctttgttattcaaattttagttttacttcctcttagaatcataatacttcagagtaaagagagtcttcattttagtaggctttggaaattgggaaacaaagaagaaagacttttgcataatggcatggcttgttaatcacagggcatgggtaggacattgtcccattgacttgaagaccaacactcagtaagctaaatgtcttggaatcacaaatgtatttctaaaggacaggcaatgtttgaggtctgaggtgtctgctagaaagagtgcatttaacaaatgtgagaaatcattctctaacatgcattttaacaaattgctcttaagaaaaactacacattgagaaaaatcttacaacctatgttcacatcattttctacaaaatattacttaaaactttgcttttgaatttcctaattatatagaatttttattttcttagttttctatgaaagtgttattaaataaaatgactttctgaaatgtccatttttttcaatcaagaggtttttctatttctgttgtcatataaagatgatagcagtaaatatctgtctcaacatagaaaggtcactcagtacttctcgacaagtatctgctcatgctttcctgcatggatgatgaaataaaaccccatcctccacagttactatactggttgtcactggaactacaaatatttgaacatggtaatagaaaaacataaaaatgcatagttaacccaactcaaacgctgtctgagatagtggagagactttctcaaagtcctcacaagtaacaaagatctttatttcttctgcatatgacagctaatataacttacataaatcagtaggcctgtttggaaaggtgcatggagaactgggtttgtttccttggtattcttatatgcaaataagcacgttttcctaaatttatcctaataaggagatgaaatcttgaatcctacaaaggtaagaatttgaatgtcctaatttaatggactaaatatagataagaggtaaataaaggacataggctcccccgatgacgcattaaataaaatttttgtaaggtattgagatctaataatcatattgatctcagggattgtggaagtcttgctattcagaattaaagctgaattaacggtcataaacaacgctacacagttaaacattaaggatatggcaacattattagaaataaaattataactaaacttaggagaaataaaaatggaatttgatgcagtcactggttaggactctgagtgtcgctgttgaccaaagtgggaaagaagctgccgcagaggcgacccgactctgctccctccatactaaacacacagaccagacaagctcctacgaaaagccaacgctccacgcccattttcgtcagggaatatgtacccatcggctttagataaataaggaaacagcaggctgaaccagaactaagagaaaattgggcagagagaaggcaatggcgagtccacctaggggctggggctgcggagagctgctgctgcccttcatgctcctggggacgctgtgcgagccaggatccgggcagatccgctactcgatgccggaggagctggacaaaggctccttcgtcggcaacatagccaaggaccttgggctggagccccaggagctggcggagcgcggagtccgcatcgtctccagaggtaggacgcagctttttgccctgaacccgcgaagcggcagcttggtcaccgcgggcaggatagaccgggaggagctctgcgctcagagcccactgtgtgtggtgaactttaacatcttggttgagaacaaaatgaaaatttatggagtagaagtagaaataatcgatattaatgataacttcccgcgtttccgggatgaagagttaaaagtaaaagttaatgaaaatgcggctgcagggacacggttagtgcttcccttcgcgcgggatgcggatgtgggtgtgaactctctccggagttaccagctcagctccaatctgcacttctctctggatgtggtaagcggaactgatggacaaaagtatccggagctggtgttggaacagcccctagaccgcgagaaagagactgttcacgacctcctcctcacagctttagatggcggagacccggtactctccggcaccacgcacatccgtgttacggtcctcgacgcaaacgacaatgcgcccctgttcaccccatccgagtacagcgtgagtgttccagagaacatacctgtgggcactcggctgctcatgctaaccgccacggatccagatgagggaataaacgggaaattgacctactcttttcgcaatgaagaagaaaaaatttcggagactttccaacttgattccaacctgggggaaatctcaactctacaatcactggactatgaagaatccagattctacctcatggaagtggtagctcaggatggaggcgctcttgttgccagcgctaaggtggtggtcacagtacaggacgtgaatgacaatgcccccgaagtgatcctcacctctctgaccagttcgatctctgaagactgtcttcccggaactgtaatcgcgctgtttagcgtacatgatggtgattctggagaaaatggtgagattgcatgctctattcctaggaatttgccttttaaattggagaagtcagttgataattactatcacctattaacaactagggacctggacagagaagagacttcagattataatatcactttaaccgtcatggaccatggaaccccgcccctctctacagaaagccacatccccttgaaagtagcagacgttaatgacaacccacccaatttccctcaagcctcctactccacctctgtcacagaaaacaatcccagaggtgtctctatcttctctgtgacagcccatgaccccgacagcggcgacaacgctcgagtcacctactccctggctgaagacacatttcagggggcgcccttgtcctcctatgtatccattaactctgacaccggtgtcctgtatgctctgagatccttcgactatgagcagttgagagacctacagttgtgggtgacagccagcgacagtgggaaccctccacttagcagcaacgtgtcgctgagcctgtttgtgctggaccagaacgacaatacgcctgagatcctgtaccccgccctccccacagacggttccacgggcgtggagctggcgcctcgctccgcagaacctggctacctggtgaccaaggtggtagcggtggacaaagattcaggccagaacgcctggctgtcctaccgcctgcttaaggccagcgagccaggactctttgcggttgggctgcacacgggcgaggtgcgcacagcgcgagccctgctggacagagacgcgctcaagcagagcctcgtggtggccgtcgaagaccatggccagccccctctgtcagccaccttcacggtcaccgttgccgtggccgacaggatccctgacatcctggctgacctaggcagtatcaagacccccattgaccctgaggatctggacctcacactctatcttgtggtggcagtggctgcagtctcctgcgtcttcctggccttcgtcatcgtgctgctggtgctcagactgaggcgctggcacaagtcacgcctgcttcaggctgaaggcagcaggttggcgggtgtgcccgcctcgcactttgtgggcgtggatggggttcgggctttcctgcagacctattcccacgaggtctccctcaccgcggactcgaggaagagtcacctgatctttccccagcccaactacgcagacacgctccttagtgaagagagctgtgagaaaagcgagcctcttctgatgtctgataaggtagatgcaaacaaagaagaacggcgagttcaggttagttttctctttcggtaaggatgaccagaacattttcatttgtttcctttttcatgtttctgtcatattcagaatcagctagttatgtaaatagtggaacattatttgctgtattggagattaattttttttatataattcatgctttctccatttgttttcaaattctgttttgggaagtctagctgatatctgtagacttaagtgaaacaaataccttaaaggaaagtggttaaatataatcattttacccaaatattttgttatattggaactgcagttctattaatagaaaagatgttttatttattcaaattgttagatatattgttctcttttgagtgtctgcctagacaccattagtgaatgtgttttggaaaggataatgtataggactgatattttagtctacctgaaatttgtttaaggaaataatttacagtatttacataaatcagtggaaaggtacagagaacttctgggtcataaatatcagaaaagaggccgggtgcggtggctgacgcctgtaatcccagcactttgggaggctgaggtgggcggatcacgaggtcaggagatcgagaccatcctggctaacacggtgaaaccctgttctactaaaaatacaaaaaattagccgggcgtggtggcaggcgcctgtagtcccagctactcggaaggctgaggcaggagaatggggtgaacccgggaggaggagcttgcagtaagccgagatcgcgccactgcactccagcctgggagacagaacgagactccgtctcaaaataaataaataaataaataaataaataaataaatatcagaaaagtagataaaatttatattaatgataacatgtagcattctaaagtctggaaagtttgtgttaagccatgtagttattggatatgtgggcttgttgagagaagaaatcagtgtaaaggaaccttaaggttgggcttcgttctgtgatgtaaagcctccagagagttacatactgctgcactcaataaatgtaaatatgtcacacacctggcatcttctgttatagataaaccctttacttattagaatcaatacctactgcaatgttagcgtttctttaagtgtaggtgcaattcttctttattacttgagtttaaggttgtatttgaaaaaaaaagaactcaacttaaagatggttcaaaattttaaatttcatatctaacgtatgtgctcatcttaaattaatagatttgtcttaatgaaatactggcctatgtgcctcaaattccaggaggatgtgttatgtaatgaaagaactactatatttcccttctgcatctgatttgctgaagatgattttcagatgtttcttattaaaatattcttaatccttcaaattttgtacttttaaaaccttgagcatcagcttcaaataatgactaaataaggggaaaaggtaataaaatattacaaatgggatagtaagctacattactcaaccacatgaaaggttaattgacacattaaagaacctaagaccacttgatttttattttttaaacactgttaaagagcattcaagtatatctatatctatatacatatacacacacatatatatacacacatatatatacacacatacacacacacaaacacacatacatacacacatggacattctgaccaaaatgtaaaatgtacaaactcaccgaatagtgaatgcatccaaagagtaacaagagaatctatacagtaggtgtcgacattattcactcctatgtgaaaacttgcttttccattttttttaaaagaaaatgttatatgcttcttagggtaaggtgtttgggaaaaaagtaaaggttatagatttgggtacatttcttctgagttaaatgttttgtgcaatggaaaaatatctttaaaccctctataaactactaacagactataaaatgcttgatccatacattttgaatgtatgtactgtatataccatatacttttaaatatctgaatctttagttttatatgtgttctgaagaataatttttcatactaattgaagtgttcatacaatgaacacttggcattgtgttggaaggcacttgctttggaatgttttggagcaaagtcttgagtcagttatatttttgatgtttgtataaaggtgacaatgagtgtctgtctagaattctggttactgtgagtagtttaagatgctataatgcttttccactataaggtgaattcggtgtggaactcattgcttattgctgcacacttgcctagttttagagtaacaatacattatgtaggctaaagataatttctttaggaagattttctggtttgaaaatggaattaaaactgtaagacacctgtcagaaacatggaaaatggcatgttattgaccagggaaaagtgtaaataacaaaaagttaggattatcagatggtaaactggggaccaaggaaaagtggacaggaagattacttatataattaaataatataattataaggacttacaattcactccccaatcctaataacgcatcattgttaggctacttgagaagaaacagtacatttcaggacaattgtgatgtagtatgaaaaaacatcctttgtaaaagtttttcatttgggccagggtggttcatgactataatcccagcaatttgggacgctgaggtgggaggattgcttaaagccaggtgttctagcccagcctgggcaacatagtgaaaccccacctctatagaaaaaaaaagttttcaatcatacttatttaattaaaagtagacacttggaaacaaaggaaaagagaccctcttgctttttactatacttctattttataaggtcaatcatttcctcattacctttaacttcttttggggggagataataaagataaaagagaagaaagtgaaacatagaataaaactaaaagctatgacattataacttttagaagttagaagtaaaggaaatagaatgcaataagaatacacgtgaagctgatatttcaagcctctttatactacgtcttctgccatcaccaaaaatagcttccatttgtatgattttctatgtattattttatttggccctcatttctactagagtaagcagagaagatattattatgaccattttatgaaaatggaaactaaaaacgtgacgggattgagcaagattatctctgccctttgacaagtaaaaggtacttgatttggatggataaagctcaaattaaaagaaataacagactaaagatatagtaagtatatttaatgttttttaaaagtccttttaaaatgggaagaaagtatcactatcagtacactgccgatttttctcctaactagctccttatttggagctgatttagtcaccattactgcagttctgcagcagaggcgccgggtgccgctcttggctagtgctgtgcaaaatattggctcctcccgctgcagccagctcggaagaaaagtgcactctctatcaggcttcctgcagcggagacacccattagagaacccaagcacaaagacaaagcaaatagttggtcctgctcggagaactcttgggattatttaaagatctcctctcctcggatttagaaaggcaaaggcgcagagagcgggatgggaaatagctccggatggaggggcccagcagggcagaggcgaatgctatttctcttcctgctctctttgttagaccaggctctctccgaaccgatccgctacgctattcccgaggagctggacaggggctcgctggtagggaacctcgccaaggacctggggtttggcgtgggggatttacctactaggaacctgcgggttattgcagagaagaaattctttaccgtgagccccgaaaatgggaacttacttgtgagcgaccgtatagaccgagaggagatttgtggcaagaagtcgacgtgtgttctggaatttgaaatggttgctgaaaagcctttaaacttttttcatgtaactgtgctgatccaggatattaacgacaacccaccgacctttagccaaaatatcactgagctggaaatcagcgaactggctctcactggagccacatttgccctggaatctgcgcaagatcctgatgtaggtgtcaattcgctgcagcagtactacctcagccctgatccgcacttctctttgattcagaaggagaacctggatggcagtaggtacccagagctagtactgaaagcacccctggacagggaagagcagccacatcaccacctggtcctcacagctgtggatgggggcgagccctccagaagctgtaccacccagatcagggtaattgtcgcagatgcaaatgataaccccccagtatttactcaggacatgtacagggtcaatgttgcagagaacctgcccgctggctcctccgtattaaaagtgatggccattgacatggatgagggcatcaatgccgaaatcatctatgccttcatcaatattggcaaggaagtgagacaactgttcaagctggacagtaaaacgggggaactcaccactattggagaactggactttgaagagagagatagctacacaattggggtggaagcaaaggatggtggacatcacactgcatattgtaaagtacagatagatatttcagatgaaaatgacaatgccccggagataaccctggcttctgaatcccaacatatacaagaagatgctgagctggggactgccgttgccctgatcaaaacacatgatctagattctggatttaatggagaaatcctatgccaactaaaaggaaacttcccctttaaaatcgttcaagataccaaaaacacatacaggttggtgacagatggagccctggaccgggagcagatcccagaatacaatgtgacgatcacagctaccgacaaaggcaatccaccgctctcctccagcaagaccatcactctgcacatccttgatgtcaacgacaacgttcccgttttccaccaggcctcctacaccgtgcatgtagctgagaacaatccgcctggagcctccattgcgcatgtcagagcctcggatcccgacttgggacctaatggccttgtctcctactacatcgtggccagtgacctggagccgcgggagctgtcgtcctacgtgtccgtgagcgcgcggagcggggtggtgttcgcgcagcgagccttcgaccacgagcagctgcgtgccttcgagctcactctgcaggcccgcgaccagggctcgcctacgctcagcgccaacgtgagcctgcgcgtgttggtggacgaccgcaacgacaatgcaccgctggtgctgtacccagctctggggcccgaaggctctgcgctcttcgatatggtgccgcgctctgcagagcctggctacctggtgaccaaggtggtggcggtggacgcagactcgggatacaacgcctggctgtcctaccacattgtgcaggccagcgagcccgggctgttcagcctgggcctgcgcacgggtgaggtgcgcacggcgcgtaccttgggcgacagggaggccgcccgccagcgcctgctggtcactgtgcgtgatggaggacagcagcctctttcagccaccgtcatgctgcacctaatcttcgcagatagcttgcaagagatacaacctgaccttagcgaccgccccactccctctgaccctcaggcggagctacagtttcacctagtagtggcgttggccttgatctcagtgctcttcctcctcgcggtgattctggcaatctccctgcgcctgcgatgctcctccagacccgccactgagggctactttcagcctggtgtctgcttcaagactgtacctggagttctccccacctacagcgaaaggactttgccttattcctacaatccgtgtgctgcctcacattcctcaaacaccgagtttaaatttctcaatataaaggctgaaaatgctgcaccacaagatcttctatgtgatgaagcctcttggtttgaaagtaatgacaatccagaaatgccttctaattcaggcaatttgcaaaaggtgagtttcttcaaacctttccttccataaatataattgggtttcaattcattgatttagagataaaaagaatacagattaaatattccctgattacattattttattgattttctggtgtagagtagggtgtctaggaaattctttgtagaatttcctgtagaatatctgtgttgcagttgttctttcatagaaagcctccttttgatagtcttgaaacttttcttaatcctaatacactataatctgaaacatttttaatacagtattatctcacactgtcattttcagacatatctatccagaattagacccaaatcctcacaattaagtggtttacttagttttaatgcagtcaatcctaaaatatatgaaacattatgtatatcttaacacatttttaatgtaacctgtatataatatttttacttccctttgcatgtttttaaaagtatacacagatgttgcctatgtcagggcagtttttaacttctatgctaatcaaaagaaataatggcatctaaaatggcaactcttgtaatgggcactgtaatgaattggttcaaaatgtgtttgtgtagcatatgcctgtagtcccagctactcgggaggctgaggtgggaggatcccttgatcccaggaggtagcagctgcaatgagctataattgtgcccctgcactctagcctgggagacagagcgagactttgtctccaaaaaagtgtttgtggttgttggtacccttactgaaaatgggactagcataaatggtggtgaaatgtgatgataattcaaaatttacagaagattgtaatattatttctgttccccaaggtcctaagagatattttcataaaaatgaatggtaaacttcagagaacatttaaaattattcaaaataatctcttacactcttctaaatgcttcattatcttggggagggaaatattatgagtgtcatctctgcagatttagcagaaataaaatcctctgtgtgatagtttcacaaaacgatgcagtattaagttaggactctaagcgtcgctgttgaccaacctgggcaagaaaatcaacggaaactcaagttacatcctccaacaacaaagcaaattagacgggaaagcaggaaagctgtgcagaaattctgacctgaaacgcttcgcatccggtctctgcttgttgaaggaccttcaccgctatttctgagaagagcaaaagtgatgcagatctgttcttcctcttcttaatcccagagaagttcctaataagccagtaatggcgcctccgcagaggcatccgcagcgcagcgagcaggtcctgctcctcacgctcctggggacgctgtggggggccgcggcagcgcagatccgctactctattcccgaggagctggagaaaggctccttcgtaggcaacatcgtcaaggatctgggactggagccccaggagttggcggagcacggagtccgcatcgtctccagaggtaggatgcagcttttctctctgaatccgcgaaacggcagcttggtcaccgcgggtaggatagaccgcgaggagctctgtgctcagagcccgcggtgtctggtgagttttaacatccttgtcgaggataaactgaatctttatcccgtggaagtggaaatagtggacattaatgacaatacaccccgattcttaaaggaagaattggaagtgaaaattctcgaaaacgcagctccatcctctcgttttccactaatggaggtctatgaccctgatgtgggaatgaactcccttcagggatttaagctcagtggtaatagtcacttctcagtggacgtgcaaagcgaagcccatgggcccaagtacccggagctggtgctggagggcacactggaccgggaaggagaagccgtttaccgcctggtccttactgccatggatggcggcgaccctgtccgctcaagcgtcgcccaaattctggtaacagttctagatgtgaatgacaacactccaatgtttactcagcctgtctaccgtgtaagtgttcctgaaaacctgccagtaggcacaccagtgttggcagtgactgccaccgaccaggatgaaggagtccacggggaagtaacttattcctttgtgaagattacagaaaagatctcacaaattttctgtttgaatgttttgactggagaaatttcaacttctgcaaatctagactatgaggactcgagtttttatgagctgggtgttgaagcccgggatgggccaggtcttcgagacagagcgaaagtcttaataactatcttggatgtcaatgataatgtaccagaagtggttgttacatctggaagcagaacaattgctgaaagtgcacctccaggaacagtaatcgccctttttcaagtgttcgatcgagactctggcctgaatggcctggtaacctgttccatcccgagaagtctcccatttgaattggaaaaatcagttggcaattattatcgattagtgacaaatgcagctctagaccgggaagaggtattcttgtacaacatcactgtgacagccacggacaaaggaacaccacctctgtctacagaaacaatcatctctctaaatgtggcagacaccaacgacaacccgcccaccttcccccattcatcctactcagtctatgtccttgaaaacaaccccaggggtgcctccatcttctctgtgaatgcactggaccctgacgtggaccagaacgcccaagtctcctactcactggcagaagacaccctccagggggcgcccctgtcctcctacgtgtccatcaactccgacactgggattctgtacgccctgcgctccttcgactatgagcagttgagagacctacagctgtgggtgacagccagcgacagcggggacccgcctcttagcagcaacgtgtcactgagcctgtttgtgctggaccagaatgacaatgcgcccgagatcctgtaccccgccctccccacagacggttccactggcgtggagctggcgccccgctccgcagagcccggctacctggtgaccaaggtggtggcggtggacagagactcgggccagaacgcctggctgtcctaccgcctgctcaaggccagcgagccaggacttttctcagtgggcctgcacacgggcgaggtgcgcacggcgcgcgccctgctggacagagacgcgctcaagcagagcctagtggtggccgtccaggaccacggccagccccctctctccgccactgtcacgctcaccgtggccgtggccgacaggatccccgacatcctggccgacctgggcagcctcgagccctccgccaaacccaacgattcggacctcactctgtacctggtggtggcggtggccgcggtctcctgcgtcttcctggccttcgtcatcgtgctgctggcgctcagactgcagcgctggcacaagtcacgcctgctgcaggcttcgggaggtggcttagcgagcatgcccggctcgcactttgtgggcgtggaaggggttcgggctttcctgcagacctattcccacgaggtctcactcactgcagactcgcgtaagagtcatctgattttcccccagcccaactatgccgacacgcttatcaaccaggagagctatgagaaaagcgagcctcttctgataactcaggatttacttgaaacgaaaggagaacccaggcaacttcaggtgagtttctttccgcctaagcgggaagagtaatctgatcttcccgcaacccaactaatcagacaggctcatcagctagatcggctgttatagaagcgaacctcttttggtacaggaagattcgtgattttgtaaagtggaagactcccttgttcaggtgagggtatcgtttttttttttttttttttttgagacggagtctcgctctgtcgcccaggccggactgcggactgcagtggcgcaatctcggctcactgcaagctccgcttcccgggttcacgccattctcctgcctcagcctccctagtagctgggactacaggcgcccgccaccgcgcccggctaatttttttgtatttttagtagagacggggtttcaccttgttagccaggatggtctcgatctcctgacctcatgatccacccgcctcggcctcccaaagtgctgggattacaggcgtgagccaccgcgcccggccgagggtatcgtttttattggttgacaggaaaattcaagattgtctttgattagtgcttagttttcttagccctttgcagagagtcacataattctaatgtttttcttttatatcaaaagaatgttctgaagtcttaattttgtgggggaaaataatgcatgtcctagtttttctttacctttctcttcttggcaaactatttgtgtcttggattgagtacatctcgtttcttaggttttttcctactatgtgacatttgtaaggttctttctttttctaatgtgggaaaaaaaataaccttaatttaggtcagtgttaaagatcaagatcttggttttagctagcatggtggttcacgcctgtaatcccacctcttcaggaggctgaggcaggaggatcccttgagaccaggagtttgagaccagcctgggtgactctgtctctaccaaaaagaaaaaaaagtagccagatgtgtggcgtacacctgtagtcccagctactcgagaagctctgataggaggattgcttaagtccaggggtatgaggctgcagtgagatataattgtgtcactgcaccctagcctgggagacagaatgagactttttctctctctctctcaaaaaaaaaaaaagattttgttttttctcagtgttacttgataactataaacgacagacgttcatacaagagatctttcacctttactacttaggaatcaaaaattatttttgaaaagataagaatcattggtaactgcagcaggggacaccagatctttggtgttaaaagacctgaataacattcctgtaactatctgttatttacttgggccagttacaatcgccattatcttccaattaaaattaagatttaaaagacttctcttatcagagataggatccccctctgttgcccagtctggagtaaaaatccacctgtaactgctgcttatagagtgtgtatccagggcaacttgaatctatgttcctgggttgcaatcctaaagcttggctcaaataagctctacttatattattttttaaaacaagactttccttatctatctgactcaaattctaagaaaataattttataactttttttcaaactctaaagcagcatagtgaacacgtatttgttgacatcaccattattataattattgggttgttaacaataactaagcaccgatgctgtgtgcctactacagtgtcttttgcatactgtgtgcctgatagtatttaagagtgaaaatggccgggtgcggtggctcatgcctgtaatcccaacactttgggaggccaaggcaggcatctcacgaagtcaggagttcgagaccagcctgaccaacatggtgaaaccccgtctctactaaaaatacaaaaattagccaggtggggtggcatgggcctgtaatcgcagctactcgggaggctgaggcaggagaatcgcttgaacccatgaggcagaggttgcagtgagccaagatcgtgccactgcactccagtctgggtgacagagcgagactctgtctcaaaaaataataatgataattaataaataaagagtgaacatgaattttaaaacatgctcggtagtgtctgcttacaggacatatctctaaaaatagatgactgactggtgaatgggagaacaaatgttaatgaggttcaaataaaaatttaaatattttagcattttaacccagacaataaggctttcatcatataggaactctttattgaaatatttcaagaaaaaagggattatcatttagaagactgattagtcttatttattatgactgaaatgtgcaaacagaatcattgtttcatgaacagaaaacagcagagtttttgactgtcaatgatgttcgaatagaaaatggatcactaaggagataggagattctgttatcgacagtcttcaaaagtaagttgatggccctggaatgaatggagtacaggggattctctaatttgatgacttgttgaactacattatagtcaagatttttctccagtcatgagttggaagattctacaatctggtggtattatagaatggattggccacttgtgcatctgaatttgttatgaatgtgtaagaaaaaagcaattgagaagataccttgaaaataaatgagaacctcctttgtaacctgactttgtcagtcttcttaaagataacattgagttgatgtgtttttaaataagctgctaagagtaatatgtgtttttctgaaccaatattgtggtatttacatttaaggaattgttatagatttatttatttcaagtttccaaaggtatatacctaaacaagagatctaatcatacacatcttcaagctcattttcttgtatctttgtgatataatttgataaaataacattttaaacaacttgaatcttggatattagtctcatgagttagatgggctgttatacatatgattatttcataaactctgaaagtgtgaatgttattttactatactaccaatttgggatgttaaactacatcttgagcatttgttgttatagggaaagctcactaactacttttcatggagatcaggctggtttattttattctcttattacctgtgaccatttcatttaaacaaataaaatatttctctgatggaaaaactaccaacttctactctcacaaaagtcattcactcatgtggactgaccaactgttaaacatcctggcagtcatggaatttgctaagttatggctaaatgaggttctttaatccacctgcaatacagatcattaataataagataggctatctgaggttttgagagttcagtatagaattttgaagcatcaggaaaaaaaactaccaaattattgtcttattcttattttatggtctgtgaaagcctcttttttttttttttttttttttttttttttgtcagagtcttgctctgtctcccaggctggaatgcagtggtgtgatctctgctcactgcaacttcctcctcctgggttcaagcgattctcctgcctcagcctcccaagtagctgggattacaggtgcatgccaccatgcctagctaattttcatacttttagtagagatggggttttaccatgatggccaggctggtctcaaactcctgaccttaagtgatccacccgcctcagcctctcaaagggctgggattacaggcatgagccactgagcccggcctgaaaggcattcatttctgatcaggcttctgttgaggtggcaattgtcaaaggggaaggagtaaaatctcagaggagaaacattggaagatacctatatctttgcttgagaatgaaaatctaaatggaacttcaaagaactgttttgttgtttgttttttagaaaaaaaagtcccaaaaaagaaaagagagaagataatcaattcgatgcccaggaagccaaatagactttacatagaattctttttaatgcaaccaaacaaatggtcaggattcttcccaatatctcagtcaacaataatatacactctttaaactatgaaatgatttcaatttgatacaatgagcttatgttagattttattaaacatatcttggcggtctagtaaagatctttaatatttaattttatgatgttcgataacttagaaaatgtgaatgctagagacaatgaagccatttactccatagggtatgtatgctttgtgttcggagtagtctataatttaatttaactagctcttatttccttttctccaaagaaggtaccaagacactataaattaattgagacttttttaaaacagtagaataagaaacaaatgtgagatgaaactatgaattttgaggcatcaggtaaaaatggatcaagacattgagagctataacctccaaacatgaaagtttgtttgaaaatatctacaagtgcttacattgtttaataatcatacactttgcttgcctcaacaagaagttcaaaagtactattaaacaaatagaatttaactccagtttacagaattcatctataatacctctattagttcctttaaacaaaatttatctactttgtgaatgcaaagataactatggattattttgatagatcaaaacagaatgtccttcaaagtgttccctgtattctggagcaatgccaccagaaagcagaaataggttacttaggagcctcccacaaaacgaagttaagctttcttagtgttagttctggattctcctcctggttccaccaactactctccaggacctagaagaatttacaaaccaagactgtttcttgccaggtctttattccagagcaggtcattctcttttattctgcaactatgtgaaaggagctttcttttctttctgctagcagagggtagcctcggatccatcaataatttagttttactctatcaacatcagtggagagacgagtacctctaaggatcctgtcaggacagtcctgcattttgctcaaatgctgtctagagatccctgttttctcaattacactagaatagagtaggatgaagatttgaattgcatactaggatgaagacttgaattgaattgcataatgaaaagaatcagccaatccattatccagtttcttatgaattcacagcccagtaggatctctgcagatttctgccttctgtagaaaatgggttgcttctatagctgattgctgcagccaagacaaacaacgatttctttctttttttctcacaagactgggagtgagaatatttggattccgacattgttctactactatataatcaataatcaggaacaaggcaaggcaattccctctttctttctttctttctttcttcttcttttttttttttttttttttttggcagagttttgctcttgttgtccaggctggagtgcaatggtgtgatctcggctcaccacaacctccacctcccgggttcaagcgattttcctgcctcagcctcctgagtagctgggattacaggcgcgcgccaccacgcccggataattttgtatttttagtagagacggggtttctccatgttggtcaggctggtctcaagctcccgacctcaggtgatccgcccgcctcggcctcacaaagtgtgggattacaggcgtgagcaacagcacctggccccccctctcattttttaaacggttaaaatgaaggtgttagaccgtctctaaggttctatacaatcaaaaatttattaaaataggtctatatattttacaacaattttgactttctgaatcttgcatcatggtgtctagaacatatgtgttcaattaatactgaattaattaaaatttatatacactgatgtaaatattttctaagtaaaatctttcatatgtatttaaataaaatttacctttttgccttcaataactgattttcccatgtgcaataacgtgtgagtcagtgcccaaaagagtcacttgaaagttgcaaggcaaagcagttttttaaaaattatctaagattatcaaacaccggtccatgaacactgttgcattaattcagtgtcttaaaatggatttttaattatcagggatatctagagcaaagaaatctaacagggaaattttgaaagatgaaacaattttctatgaaatcagtgtattgtgtgcatcaatgtggtgcagtaacttagtaaggactcacagcgccgctgttcaccaaccagggaaaaatggtgcgagagatcccacagaaaccaccgagttttacagcacagagaaacgacagattgcgataagccctcttccaggctgcactaaactcaagcctctatcctgctggattctgagctccccttcctaagacagaggggtccacccggatacacccgcattctgaagcacttcccgagatcggcgcctaagcaagagaagcaggacgactatggcggctcagccgaggggcggggactacagaggattcttcctgctctccatcctcctggggaccccctgggaagcctgggcaggacgtattctctactccgtgtcggaggagacggacaaagggtcctttgtgggagacatcgccaaggacctggggctggagccccgggagctggcggagcgcggagtccgcatcatctccagaggtaggacgcagcttttcgccctgaaccagcgcagcggcagcttggtcactgcgggcaggatagaccgggaagagatctgcgctcagagtgcgcggtgtctggtaaactttaacatcctgatggaagataaaatgaatctttaccctatagacgtggaaataatagatattaatgacaacgttccaagattcttgacggaagaaataaatgtaaaaataatggagaatacagctcctggggttcggtttccgttaagcgaggctggggatccagatgtgggcacgaactccctccagagttaccagctcagccccaatcgccacttctccctggctgtgcaaagtggagacgatgaaactaagtacccggaactggtgctggagcgggtgctggaccgggaggaagagcgggttcaccacctggtcctcacagcctctgatggcggcgacccgccccgatccagcaccgcccacatccaggtgacagtggtggatgtgaatgaccacacgcctgtcttctctctgcctcagtaccaagtaactgtccccgagaatgtgccagtgggtacaagactgctcacggtacatgctatcgacctggacgagggagtcaatggggaagtgacatattcttttcggaaaataactcctaaacttccaaagatgtttcatctgaactcgcttacaggagaaatatcaactttagaaggattagattatgaagaaactgccttctatgaaatggaggttcaggctcaagatggtcctggtagtctgacaaaggcaaaagtactgatcacagttttagatgtaaatgataatgctccagaagtgactatgacgtctttaagtagctcaatccctgaagacacacctcttgggacagtcattgctcttttctacctacaagacagagattctggaaagaatggtgaggtgacctgcaccattccagaaaacctaccttttaaattagaaaaatcaatagataattattatagattggtcacaaccaaaaacttggaccgggaaacactctctttgtataacatcacactgaaagccacagatggtggaactcctcccttgtccagggaaactcacatattcatgcaggtggcagacaccaacgataacccacccaccttcccccactcatcctactcagtctacatcgctgagaacaaccccagaggggcctccattttcttagtgactgcacaggaccacgacagtgaggataatgcccagatcacttattccttggccgaagacaccatccagggggctccagtgtcctcctatgtctccataaactctgacactggagtcctgtacgcgctgcaatcctttgattatgagcagttgagagaactacaactaagagtgactgcacatgacagcggggacccgcctctcagcagcaacatgtcactgagcctgttcgtgctggaccagaatgacaacccgcccgagatcctgtacccggccctccccacagatggttctactggcatggagctggcaccccgctccgcagagcccggctacctggtgaccaaggtggtggcggtggacaaagattcaggccagaacgcctggctgtcatacctcctgcttaaggccagcgagccaggactctttgcggttgggctgtacacgggcgaggtgcgcacggctcgggccctgctggacagagatgccctcaagcagagcctcgtggtggccgtccaggaccacggtcagcctcctctgtcagccaccgtcacactcaccgtggctgtggctgacagcatccccgaagtcttggccgacctgggcagccttgagccctccgacggtccttacaactatgacctcacgttgtacctggtggtggcggtggccacagtctcctgcgtcttcctagccttcgtcctcgtactgctggcgctcaggctgcggcgctggcacaagtcacgcctgctgcaggcttcagaaggtggcttggcgaacgtgcccacctcgcactttgtgggcatggacggggtgcaggctttcctgcagacctattcccatgaggtctccctcaccgcggactctcggaagagtcacctgatcttcccccagcccaactatgtagacatgctcatcagccaggagagctgtgagaaaaatgattctttgctaacatccgtagattttcaggaatgtaaagaaaacctgccaagtattcaggtgagcccagcccttcctttatttccatgaggaatttatttgcatgatatttctctattattttgcaaaacaaatgttttgaaaatagggatttaaaaaactttatagaggtaaaaatgagtttaccagtttccttcagtggtgacactttaatatagaacacataggatatagtatttctttagtgaaagcctatggacaagattatgaatatgtggactatcacattttataatttccacctactttccaatctatgttccaacctactttcttaactcatatattttatacattggaatgaatcgagtctttcatattgcacaaggttagcaggaataaaacacacctcagctgtcttctcaggattctctttagcattcaaatatgtaaaaggttctgaaagatttcttccatgtgaagatttttttctgtggctgattctgcctccatgtacctcagcttggtggtcctaaaaaatcttgattgcttcttgacctatttacagtataatcatttattaatggggtggtagtagaaggttggatttatgcctaaagaatgaaatgtgtgtgtatcacacttcactaagatctatatcaaagacagacatcaagtctaatgccacactaaaggccatcggacaaaaccaataaaatatgtcaaataaaatgtcattttaagtgttgtaattggcatttgtgacataggcaattacatgttttaacagagaattccagtatgttgttttagtggtacagccagatgaagtgtgtctgtgggctatcaaagtgggagattggggatactggctttgtttcaactgtctcacgtactcaaaccttagaccatcttatgtacacagatcctagaccagtagttgattttatttattaggtctactgaaaaattcagttggaaataacccaatctgggattaactacttccatattcttttgtataacattttagtaaagctcagtatatcaagtgattgtcatccagaaggggtggatgacaaggtaatcttgattccagagacctttgagtattaattaaaaacacacttttagccaggtatggtgttgcaagctgtagcccacctgcatgggaggctgaggcaagaggacagcttgaacccaagaattggaggcccacctagataatataacaagactctgtctcttcaaaaaaagacttctttttagactagtgttgtatttggtagtattttgcacatgatagactctgtacaatagtgtgggggatacattttttttttttgacatggagtctcgctctgtcacccaggctggatacattttacaagttctgcagtgttcacatttcagatgtacaatcacttggggtagaagacaatgttgctgacaccaacaatgttactgagggaagatcctatggcagaactacggttataaggtattttgtaaaagaaaatctcctgaccaaaatttattagatgcataaaattgtttttaagcaatggagagacataatcactaaactcagtgagctattgcaatcaaactttccagggattgtttccttcaattcagaggtcaccaaggaatgtaaaataagtgcagaggtaggaagcagtgcttcagtgcagcagatctcagtgactttgtgttttgaggctatgtattatccccctgataactttgaagatgaatgttgtatttcataaccagtaaaataattgtgtaatgaggagaggagtaggctactgcctgtgatcatcgaaatgagaatcacataatattcctgtaatgaaatcactgaaactattgggaagggggtgtatttgaagataagtataaattgcaccttctaaaaggcaattttggtattactgatactctccggaaaaagttgaaataaatcaacttggaggtacttagaaaagtggagaaaatgttaggaacaatgaaagaaagataaaatgtatccagtatatttctaatgagtaagtatggaaaattactgtactctgagacggtttaggccaagtctgtgttatggctatctttatatagatagtgcatgtttgaagattggggaaagcttatgtcaataaatgtttatgtacttaatctacatgatttgcctaaaaatcctcaaagttgggatgaaggcattcctaagagtacatttttagacgtcattaaatatacagacgtatccacgtagtttttgttctttcagttaggcacacaattataattattgcactggttaacttgaagcagcagaggctgtagtttcctagtgctgactctgggcgccgctgttggccaaagtggagagcttggcgctccagatctcctcgcgcagccgcagcgcgctttccagggcagccccagctcagactccccagcgccagcctttacaccgcttcctcctcggaaaaagaagaattttttcttgaactggaactgcaactaaagtccgttcggagatccaaaaatctgcaatacagaggttatttgtaacccggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacacgatttatattaggatctgcccatgatgcggatattggtagcaacacactgcagaattaccaactcagtcccagtgatcatttctcactgataaataaagagaaatcagatggcagtaaataccctgagatggtattgaagacacctttggacagagaaaagcagaaatcctaccacttgactttgactgccttggactttggagctccacccctaagcagcactgcacagatacacgttctagtgactgatgccaatgataatgctccagtgttcagtcaagacgtatacagggtgagcctttcagaaaacgtgtacccggggaccacggtgctacaggtgactgccacggaccaggatgagggtgtcaatgccgagattactttctctttcagtgaagctagccagatcacccaatttgacctgaactctaacaccggggaaattactgttttaaatacattagattttgaagaagtcaaagaatattccatagttttggaagcaagggacggtggaggaatgattgcgcaatgcacagtggaggtagaagtcatagatgaaaatgacaacgccccagaagtgatattccagtctctacccaacctaattatggaggacgccgagctgggaacacatattgctttgctcaaagtccgtgacaaggattccagacacaatggagaagtgacttgtaaattggaaggtgatgttccatttaaaatattaacttcttcaagaaacacgtataaattagtgacagatgctgttctagaccgcgagcagaatccagagtacaatataaccgttacggcaacagatcggggcaagcctcccctctcctccagttccagcatcaccctgcacattggtgatgtaaatgacaacgctccggttttctcacagtcttcctatatagtccacgtggccgagaacaacccgcctggagcctctatttcacaagtcagggcttctgatccggacttggggcccaacggccaagtctcttactgcatcatggccagtgacctggagcagcgggagctgtcatcctacgtgtccataagcgcggagagcggggtggtgttcgcgcagcgcgccttcgaccacgagcagctgcgcgccttcgaactcacactgcaggcccgcgaccagggctcgccagcgctcagcgcgaacgtgagcctgcgcgtgttagtggacgaccgcaacgacaatgcgccacgggtgctgtaccccgcgctgggtcccgacggctctgcgctcttcgatatggtgccgcacgctgcagagcctggctacttggtgaccaaggtagtggcggtggacgcagactcaggacacaacgcctggctgtcctaccacgtgctgcaggctagcgagcccgggctcttcagcctggggctgcgcacgggcgaagtgcgcacagcgcgtgccttaggcgacagggacgccgtccgccagcgccttctggtcgccgtgcgtgacggtggacagccaccactctcggccactgccacgttgcacctggtcttcgccgacagcttgcaggaggtgctgccggatatcactgaccgccccgacccctctgacctccaggctgagctgcagttttacctagtggtggccttggccttgatctcagtgctcttcctcgtggccatgattctggccattgccttgcgcctgcgacgctcctccagccccgcctcctggagctgcttccagcctggtctctgtgttaaatccgaatccgtggttccccccaactacagcgaggggactttgccttattcctacaatctatgtgttgcacatacaggaaagacggagtttaatttcctaaaatgtagtgagcagttgagttcaggacaagacatactttgcggtgattcatctggggccttatttccactttgtaattccagtgaattgacttcccatcaggtgagtttcctttaagtataatttaatgctcattgcctacccatttctccatattcacaagaaaatatacatatttgcaggaaaatatataatttttagatgtcatggatcattttaggaaagttgtagtcagttaaaaagctgtcatatcattctacaaaggaggagtaaagtaggagcaattgtgtggcccaacatttgtttgttttttagccaagcttagatttataaagcaatgagggtgtggttttaaccacaaagtgaaagtgttagacagttgttggctctctcctaaaaagtgaatgagatttttcctatacattttccttcttgttgactaatatatgatgaatacttttttcagcttggatataccataaatataaaaataataaagccaaagaatttaagctaaaattcaacacttttcttaactaatttaactggtatggtctccatagtagtccactgttttgtttcctgtgttaacttcccttttgtttcaaaagctcttagaataaggagtcaactggatttttatgtccatggaccccttgtgattatatgcagtgtacgctgtgtgtgcgtgtgtgtgtgtgtgtgtgtgagagagatccttttacttagaaaaaggtctactatgctcattagaagatcaaaagcagattctccttacttgtaacataggagtttcaggattaatctgtattcaagctcattctatatccttcatcaaagaaaagacaatgttttgtgtctgttgtccctctcacacacagccctaatatataatgtgtaactgccttatctgcagccctaaactaatatagctagaggtcttctaatcattctcctacctctaggaaagaaatatagtcttgaaaactgccaatctggtgtgcatacaaaatatatacaaaataccaaggaacattatatgagccttttgctaggtatatctaagcaactgcttcagttaatggccactttacaaattgctgaaagaaggaaacgtctttcgattcttttttttttctttttttttttttgagacagagtctctgtctgttactcaggctgtagtgcagtggcacaatgatagctccctccagcctcaaactcctgggctcaagcattccttctgcatcagcctcctgactagctggaactcaggctcatgccaccagacctggctaatttttctgttttcagtagagaaaatattttctttcactaatttaactggtatggtttccattgtctacccagttttccatatgcataagaaaatatattcacaggaaaatataaagttttcagatttcatgagtggttttaagaaagttttagtcagtgaaaaaactatcataccagtcttcaaaggaagggtgaaataagttcatctgctacgttgcccaggctggtcttgaagggaaacagacttttttgtagtcatacttatcctttggcttcttagtaagtattatatagtcattactttttgcagttttttagatcaaagtgttaatgtaggtaaagttaattttagaatatatgtaaaagtcaagtctgctttaaatttaatcatctctttggtgaaagggatgggatggagctttgctttttatcatatattcatctgtacctttcaagtattcaaatagaaaaatataaacaatgtaaataaaatagcaaaacaatgtaatatctcataaaactgcaatggtaaaagcatttatcctattgaaattccacaatttttatttgaaaatattatcgacatgtaattcaagtggcatttagaagaataatttaaaagcaacaactctatagaaagcttgtaaaatgattaagtagtttaaaccaaataaaacaatttctgagtcagtcatctccagtaggtctattttagtctcaagataaattcatttctggtgacaactgaagttcttagttatttgttagtatatattggagacatttacaataaagcttagagcacaatgggaaatgaaagtatcatgttttttttaagaccaaatgtattgcagaaatgtgagtaatttaatccgatgctacaatctgatcattctgatctaatctgatcatttaataacactaaataaaaccttcatctcacattctttggctgtttcttttaaaatatgggtttacggataaatcaaataaattcaaaacaaagtaataagcaaatgatttttttttctcagtaatctagtagagtattacatttagaagtaatctgtatctcagtgcagtaactatttaggactgtaagcgccgctgttcacctactggaagacaaatgcaaccgaaaacactcagatctcacacctcacgaagacccgcagatgccacaaactaactgctggactgcagcgaaacccgacccctgtttggaggcactccaggtttccggaggattgtcatctccatagctgcggcaagaaactaaataagacccatttatgcacagtgaagattctgagaggattctgcagcaaaacaacaatggccgctccacagagtcgccccagacgcggcgagctgatcctgctgtgcgcgctgctgggaacgctgtgggaaatcgggaggggacagattcgctactctgtgccagaagagacggacaaaggctccttcgtgggtaatatctccaaggacctggggctggacccccggaagctggcgaagcacggagtccgtatcgtctccagaggtaggacgcagctctttgctctgaacccgcgcagcggcagcttgatcaccgcgggcaggatagatcgggaggagctctgcgctcagagcccgcggtgtctgataaatattaacaccctggttgaggataaaggaaaactctttggggtagaaatagaaataattgatattaacgataataacccaaaattccaggtcgaagatctagaagtaaaaattaacgaaatcgcggttcctggagcacgttatccactcccagaagctgttgacccggatgtgggcgtgaactccctccagagctaccagctcagccccaatcaccacttctccctggacgtgcagactggagacaatggagccataaacccagagctggtgctggagcgcgccctggacagggaggaagaggctgctcaccacctggtcctcacggcctcggatggcggcaagccgcctcgctctagcacagtgcgcatccacgtgacagtgttggatacaaatgacaatgccccggtttttcctcacccgatttaccgagtgaaagtccttgagaacatgcccccaggcacgcggctgcttactgtaacagccagcgacccggatgagggaatcaacggaaaagtggcatacaaattccggaaaattaatgaaaaacaaactccgttattccagcttaatgaaaatactggggaaatatcaatagcaaaaagtctagattatgaagaatgttcattttatgaaatggaaatacaagccgaagatgtgggggcacttctggggaggaccaaattgctcatttcggtggaagatgtaaatgacaatagaccagaagtgatcattacgtctttgtttagcccagtgttagaaaattctcttcccgggacagtaattgccttcttgagtgtgcatgaccaagactctggaaagaatggtcaagttgtctgttacacacgtgataatttaccttttaaattagaaaagtcaataggtaattattatagattagtgacaaggaaatatttggaccgagaaaatgtctctatctacaatatcacagtgatggcctcagatctaggaacaccacctctgtccactgaaactcaaatcgctctgcacgtggcagacattaacgacaaccctcctactttccctcatgcctcctactcagcgtatatcctagagaacaacctgagaggagcctccatcttttccttgactgcacacgaccccgacagccaggagaatgcccaggtcacttactctgtgaccgaggacacgctgcagggggcgcccctgtcctcgtatatctccatcaactctgacaccggtgtcctgtatgcgctgcaatctttcgactatgagcagatccgagacctgcagctactggtaacagccagcgacagcggggacccgcccctcagcagcaacatgtcactgagcctgttcgtgctggaccagaatgacaacgcgcccgagatcctgtaccccgccctccccacagacggttccactggcgtggagctggcgccccgctccgcagagcgtggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagatgcgctcaagcagagcctcgtggtggccgtccaggaccatggccagccccctctctccgccactgtcacgctcaccgtagccgtggctgacagcatccccgaagtcctgaccgagttgggcagtctgaagccttcggtcgacccgaacgattcgagccttacactctatctcgtggtggcagtggctgccatctcctgtgtcttcctcgcctttgtcgctgtgcttctggggctcaggctgaggcgctggcacaagtcacgcctgctccaggattccggtggcagattggtaggcgtgcctgcctcacattttgtgggtgttgaggaggtacaggctttcctgcagacctattcccaggaagtctccctcaccgccgactcgcggaagagtcacctgatctttccccagcccaactacgcagacatgctcatcagtcaggagggctgtgagaaaaatgattctttgttaacatccgtagattttcatgaatataagaatgaagctgatcatggtcaggtgagtttagttctttgcttgcttttaatttccagatgaattttatttggcataaattatgttttgaaaaacattgtgaagatagttgaaaataatttttaaggtgtatcacagagttttgggtttattttggtggtgttactataaaattgaactctaatagtcataggttattgtttcatttgcttttaaacgacttggaaaagattgttcaaccattttaagccttccagtattttattcctattatcactcattcacttaagaagtagctacccgtccatactggtaattttgctattgtttgtttgtgtgtgtgtgtgtgtgtgtgtgtgtgtgtgtgtgtgtgtgtatcccaaactagaacttcagaaaattatcaagaagtctaaagccttgttattagcttagcaaaagtaaaatatatctcagaatttttagggttatgtttagcatttgaacctgtaactaggctcttgtagatttcttcactttaaacctcttttctgagccctgtttctgtaccagtgcccttcaaaactttaatacttcttaccatccttcaaaacatgaacaaactttaaagatggatcttggtgggagatgagactggttactaaatattaagtatgtgagtcagtggtcacctgggctccatgcccatggagacatgaaatctaaagcctagaatgtccattgctcccccaaacaaaaaacaaaagcaaaaacattagatctgaattaaaatgtaattttaaactgttgaaagtgacttttgtaaaatatgtaagaacatatttcaatacaattccaattagctgtttcggttgtgcattgatgtgaagtggtgagaatgttgatattaagaaccaatgtttcaggtacacaagttctaaataagctgatcaattcaattaaagttattcagtcttggctggacacagtgcctcatgtctgaaatcccagcactttgggaggctggggcaggaggaccgcttgagccccgggggtttgaaactgcagtgagctatgatcatgccactgcactccagcctaggtggcagaactagaccctgtctctaaaaaaactattattaggccgggtgcggtggctcacgcctgtaatcccagcactttgggagactgaggtgggtggatcacctgaggtcaggagttcaagatcagcctggcaaacatggtgaaaccccgtctctactaaaaactacaaaaattagccaggcatggtggcatgcgcctgtggtcccagctactcgggaggctgaggcagaagaatcacttgaacccgggaggtggaggttgcagtgagcctcgatcctgtcactgcactccagcctgggcaacagggtgagactccgtctcaaaaaaaaaaaaaactaatattaatagtaaaaactcggtataggctatccattattgtattcctgcataccttcttgtagcatttgaataaagctaatacctgaattgattgttgtaaggtagaagtagatgacccaataaatgtttgttattaatgaaaaggacatttcctaaggattgtgtagtgttctactgtatggtgcatattcagtggagtgggagttaacttcatagtttgtgtaccatttggatgcacatttgagaggacaacatattattggcactttgcaattttaaaaactcggatgaaagttgccctggtaggaaagaaaatccttactctccctaaaaatgttggctagttgtttttattaatctgacaaatggactaaagaaggttgaccaatgtccacaaatttatgtaaatgaacttatgagcttcatttatccaattccaaagtcatttcagataggataataatgcaatccactagaatatccctttgtaccttgtattgcagaatagataagcatttccccaataactcttaagaatgaatttatgtactgtaaaagatatgacataagagaagtattttgagatatgaagaagagcaacgtagtagggtatatcatttcttagctacatcatatgggcagtatacttgaatgaatatttcctgaagtagaagagtaaagaaaaattatttttataaagaatgttaatatagtcaggaagaggagatgtttggggattggtataaaattgccacaactttacaaaatagttttaaatagtatagatttccctaatatgtgtaatataaaacactagaaatattggggagttggaaatcatagaaatgaacagaagaatgataaaattgtttccatagctaataaaaaatgaatttttgaaatcagtatagtatgaaggctctgagagcaagaactgtatcatattaattattatattgccagtgacaagggcaatacttagttctagctaagagttcaaggtatgtttgcagaatggtgaaagaatggaccaatgtatgcaggtttgtataaaaacccaacgtgatatttctaacaatttggaaaacagagaaagataccttaaagaagttgttataattttttattaagtatatggacgtaaaaacttggcttgttaagttaggcacacaaaaacaattactgcactggttaacttgaagccgcagaggctgtagtttcctagtgctgactctgggcgccgctgttggccaaagtgcagagcttggcgctccagatctcctcgcgcagccgcagcgcgctttccagggcagccccagctcagactccccagcgccggcctttacaccgcttcctcctcggaaaaagaatcgtttcctaaactggaactggaactaaagcccgttcggagatccaaaaatctacaatacagaggttatttgtaacctggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacaagatttatactagaagtagcagaagatgcagatattggcttaaactctctgcagaagtataaactctctcttaacccaagtttctcattaataattaaggagaaacaggatggtagtaaatacccggaactggcactggagaaaaccttagaccgggaacaacagagttaccatcgtttagtcctgactgccttggacggtggacatccacccctaagcggcaccactgagctccggatccaggtaaccgacgccaatgataatcccccggtattcaaccgagacgtgtacagagtcagccttcgggaaaacgtgccaccaggcaccactgtgttgcaagtgtcagccactgaccaagacgagggcatcaactcagaaattacttattccttctacagaaccgggcaaatctttagtctgaattcaaagagcggagaaattaccactcaaaagaaactggattttgaagagaccaaggaatattcaatggttgtagaagggagggatggtggtggactggttgcacaatgtacagttgaaattaatattcaagatgaaaatgacaatagcccagaagttacattccattctctacttgaaatgattctggaaaacgcggtgcctggaacactaattgctttgatcaaaatacatgaccaagattctggggaaaatggggaggttaattgtcaattacaaggcgaagtcccttttaagattatctcttcatccaaaaattcgtataagttggtaacagatggaaccctagaccgagagcaaaccccggagtacaatgtcaccatcacagccacagacaggggcaagccgcccctctcctccagcataagcgtcatcctacatatcagagacgtcaacgataacgctccggttttccaccaggcgtcctacttagtcagtgtacccgaaaacaaccctcctggggcctccatcgcgcaagtctgcgcctcggacctggacttggggttgaacggccaagtctcctactctatcatggccagcgacctagagcctctggcactggcctcttacgtgtccatgagcgcgcaaagtggggtggtgttcgcgcagcgcgcctttgactacgagcagctgcgcaccttcgaactcacactacaggcccgcgaccagggctcgcctgcgctcagcgcaaacgtgagcctgcgcgtgttggtgggcgaccgaaacgacaacgcaccgcgggtgctgtaccccgcgctgggtcccgacggctctgcgctcttcgatatggtgccgcgcgctgcagagcccggctacctggtgaccaaggtagtggccgtggacgcagactcaggacacaacgcctggctgtcctaccacgtgctgcaggctagcgagcccgggctcttcagcctggggctgcgcacaggagaggtgcgcacagcgcgtgccttgggcgacagggacgcggcccgccagcgcctgctggttgctgtgcgtgatggtggacagccgccactctccgccaccgccacgctgcacttggtctttgctgacagcttgcaggaggtgctgccggatatcactgaccgccctgtaccctctgacccccaggctgagctgcagttttacctagtggtggccttggccttgatctcagtgctcttcctcctggccgtgattctggccgttgccttgcgcctgcgacgctcctccagccctgccgcctggagctgcttccaacctggtctctgtgtcaagtctggacctgtggttccccccaactacagtcaggggactttgccttattcctacaacctatgtgttgcacatacaggaaagacggagtttaatttcctaaaatgtagtgagcaattgagttcaggacaagacatactttgtggtgattcatctggggccttatttccactttgtaattccagcgagtcgacttcccatcctgagttggtgagtttcatttatgtctattctttttcattacccacccaattttctgtatttacatgaaactatcgtacattttcaagtccaatgagttgtcttagggaagtcagagctgctcagaaagctgtcctaccattctttaagaggagcagtaaattgtgagtttttatgtcgcataaaagaagtagccttatagatttacaaagtagtgagagtttgctcttagcttcctctctagcaaaaacatttggtgcgtttttttgtcctctttctcaaagctaatgaattttacctattcgttgtctcattctttaacatgtttatattttattgtatgtagataaaccattaaatttaatgtatgtaatcatttaattcatcttttaaagcaaagaaactgctagtagatgtctttcttcactgatttcactggtagttttcatctctttcttatgttcctcatatatgctttcttattcctacctaatggatttatgattttttgaatctcctaaaattttattaaaaatactatatgttggctgggtgcagtggctcatgcctgtaatcccagcactttgggaggccgaggcggttggatcacatggtcaggagttcaagaccagcctgggcaatatggtgaaaacccgtctctactaaaaatacaaaaattagctgggtgtggtggcgggcgcctgtaatcccagctactcaggaggctaagacaggagaattgcttgaacctggcaggtggaggttgcggtgagccgagatcactccattgcattccagcctgggcaacaagagcaaaactccatctcaaaaaaaaggaaggagaaggagaggaagaagaagaaaaatactacatgttatgtgtatgagagagaaagagagagactgattcactgaacttagaaggtccaaatcatccaaataattttctaagtttatccaggttttcttggatgcaaaatccttttccacctctatataattaccagaagaaacttacaaaaaaaaggaaatgctattgcctgaatttctcttgctcggaatcctgacatattcttgaagaaggggaaaaagacaccggatttgtcttatcgtttggagctttaaatataaatgactggatgttttctcaacatccttgtaggatggaaggtgaatacaggattattccatttttaagacaaaaactactagtcttgtgtacatacaaagctcccattacatggtataagtcttttgcttggtttcccttagtatgtgattcagtaaatgggttccttacaaagtgctgagatttcttataataccacttacttttaacctttcagtagttttctttgttgtatattttgtgttctttttcccaaattattatataagtttaagtgatgcttagaataatgtttaagaccactttaaaattgcataatttattgatgaaggattaaaatagaaacttgcttttcagtgtatatgcatttgaatcattgaaacacagtctgtgcatgcattacatattcacattaaaaaactaagcatttttgaaatagcagaaaagtttaagcaattacaaaaatgtgaaaatttccaactttaatcctgttaatatttagcaatattaggcgagaacatctgtaactattgctgaattaatattacttttataatacaaaaatttaaaataaacgtttttccaggaattttatcatcaaaataaaccccagaaaataatttcaaagtggataatctatccttatatatgtattaatacaattatatattttacatttacaaatatataggtataaaaattaaaaatgaatgtacttccaaacaagattgcacataaaaattacttcagaaaattgttaagatacacagaaaaaattgaagcatcataaaaaggaaattataatagtttacatatctagaaatagagtgcaaagttctaccaagaataagaataaattaatattaagcaatggtttgtgattttataatacacttacagaaattttattccactttatttacaactcagatatctaaaaaatagattgcttttgaaatacaaatgcaagaaacaattggagaaatctaaaatcataattagaagagagtagtgttttctttatcagccatctgatataatgttacacatcagtgggtgtagtaacggcttaggactctgagcgccgctgttgatcaactctaagcgaaaatcaggactccatccggatttccagttctgcggctacacaaaacccggcagataccacaaacctgctcccaggctgcagcaaaactcagcctctttcttctaaggaaaagatcaccatactttgcagggtggaagaaagaacctgatgaagcagcgcgcacagagatccttttgagaaaattccaaagcgaggcagcaatggcagctccaaccaaatgccagctccgcggaagattagtcctgctatgctcgctcctggggatgctatgggaggccagggccagtcagattcgctactcagtgcctgaagagacagaaaagggctatattgtgggcaacatctccaaggacctggctctggagccccgggagctggcggagcgccgagtccgcatcgtctctagaggtaggacgcagcttttctctctgaacccgcgcagcggcaccttggtcaccgcgggtaggatagaccgggaggagctctgtgctcagagcccgcggtgtctggtgaactttaaagtcctggttgaagacagagtgaaactgtacggaatagaaatagaagtaactgatattaacgacagcgccccaaagttccaggccgaaagtctggaagtaaaaattaacgaaatcgcggttcctggagcacgttatccacttccagaagctattgatccggatgttggcgtgaactccctccagagctaccagctcagccccaatcaccacttctccctgaacgtgcagactggagacaatggagccataaacccagagctggtgctggagcgcgccctggacagggaggaggcaactgcccaccacctggtcctcacggcctcggatggcggcgagccgcgtcgctccagcacagtgcgcatccatgtgacagtgttggatacaaatgataatgccccggtttttgctcaacggatttaccgagttaaagtccttgagaacgtgcccccaggcacctggctgcttactgcaacagccagcgacctggatgagggaatcaacggaaaagtggcatacaaattctggaaaattaatgaaaaacaatctctgctattccagcttaatgaaaatactggggaaatatcaacagcaaaaagtctagattatgaagaatgttcattttatgaaatggaaatacaagctgaagatggtgggggattgaaagggtggacaaaagtgctcatttcggtggaagatgtaaatgacaatagacctgaagtgaccattacatctctgtttagcccagtgagagaagacgcacctcagggaacagtaattcttcttttcaatgctcatgaccgagactccgggaagaatggtcaagttgtctgttctatccaggagaatctatcttttacattagaaaattcagaagaagattattacagattgttgacggcccaaattcttgaccgagaaaaagcctcagaatataatatcacggtgactgcaacagacagaggaactccgcccctgtccacagaaattcacatcaccctgcaagtgactgacatcaatgataatccacctgctttctctcaagcctcctactcagtctacctcccggaaaacaacgccagaggtacttccatcttctccgtgattgcctatgaccctgatagcaatgagaattctagagttatttactccttggcagaggataccatccaagggtctcctctctccacctatgtctctattaactcagacactggtgtgctgtatgctctgtgctcctttgactatgagcagtttagagatttgcaaatgcaggtgacggcaagtgacagtggaagcccaccacttagcagcaatgtgtcattgagactgtttgttttggaccagaatgacaatgccccagaaatcctgtaccctgccctccccactgatggttctactggtgtggagctggcaccccgctctgcagagcctggctacctggtgaccaaggtggtggcagtggacagagactcaggccagaatgcttggctctcctaccgcctattcaaggccagtgagccagggctcttctcggtggggctgcacacaggtgaagtgcgcacagctcgggccctgctagatagagatgcgctcaaacagagccttgtggtggctgtacaggaccatggccagccccctctctcggccactgtcacgctcacagtagccatagctgacagcatcccagacatcctggctgacctgggcagtcttcagatccctgcagacctggaggcctcagaccttaccctctacctcgttgtggctgtggcagtcgtctcctgtgtcttcctcaccttcgttatcacgctgctggccctcaggctgaggcactggcactcctcgcatctgctgcgggctaccagtgatgggttggctggtgtgcccacctcacactttgtgggtgtagatggggttcgagctttcctacagacctattctcaggagttctccctcaccgctgactcaaggaagagtcacctgatcttcccccagcccaactatgcagacacactcatcagccagcagagctgtgagaaaaatgagcctttgtgcgtctctgttgattccaagtttcctatagaagacacccctttggttccggtgagttcattttttttctttctttcttttctttttttgttttttgttttgttttgtttttgagacagagtcttactctgttacccaggctggaatgcagtggtgtgatctcggctcattgcaacctccgcctcccaaattcaagcgattctcctgcctcagcctcccaagtagagtagctgggactagagtagagtagctgggactacaggcctcccaagtagaataactgggactacaggcacgtgccaccacgcccggctaattttttgtgtgtttttagtagagacggggtgtcaccatgttggccaggctggtcttgaattcctaacctcaagtgatccacccacctcagcctcccaaagcactgggattacaggcgtgagccactgcgcctggcccttaactttctattatagttagctttctctttaactgtctgtacttaaggtagtataagttgatatcagtgtgtttctcatcacttttcactgggcctaattgttgctccaacactgaaaggaggcatttattagttatatttgctgatataactttcatgttctcataataattaacctgctgtcaacgtaaaccatacttcatggggtagctctcagcctgcattgatgtgggctttttgggtagggttgcttcattggttgcagtggactcatatcataaaattcttactcctttttttttttttttaagagatgggggtgtcattctgttgtccagggtggaatgcagtggtgtgggtaaagcttactgcagtctcaatctcctgggcttatgcaatcctcccacctcagccttcacagtagctaggactgaggtgggagggctagcaagctatgttgcccagactggtctcaaacgatcttcctgcttcagtttcccaaagcactgggtgaggtgtgaaccacctcacccagcaaattcttactcctacgatcatttattcaggtcatactatgtttgtaagggtaaactgataaaaaggtaaatgtattcttcttagagaaacagctgaaagcccagatttattgcttctattcttccatttctatgacaggaaaacacctctttgaggttatatttttcagatcacaagtgtgtaaagtctgtttgtgtttacagatattttctgacgaagattcaaacttcagttatccacttccaaaccctagtaaaccaattttttccctttaatggtgaaagttgtcacatcttttattctcatatcttcaaaggtcttaatttcctaatgctttaatgttaaattatggagaatagtaggacattcttcttttctatagtatatgcttgctcaagagaagtttctaagactggacactgtgaaatgacaaaacaaggaattaaaaatatttctctcacttatatattatttctggctcaattctccaacttttgagtctagaaatgaacttgcatatcagatataatttaagaaaatattctcaggaactgctgggaagattctaaaactattttactgtttttagctataaggaagagaataatgtattatttaatgttattttaaacatagtgttgtttcaaatagtaaataacatttcacaagacatttgaaaataagctttgaagttgactcaaaattctatgctaaacatgtgatccatagatacactgatgactgctggcatttctgtggaaatgaagaattgttttatttgtttgtaattatttgggtttcagttgctttatttttaagaaaaaaaagctgaagtgtctgggaatcctttatgacatacagacattttaattatttcaaacacgttttcccccttaagtgggtagcaaaaaaaataaagcatacttcaggctcatatttttaaccatgcaacaagaaaattgttacaatttctgttctgaggagtagccttcatacttagtatttataaatattgaaatgtatgttaatttggggaaaacataacagatatccatgaaggcttgtatgtcatggtaggtagttactattcgataccacaaaaatgtctcttgcccttaaaaccagaacacgaggctcaccagacagatgactgaatggagtatggaaaatctttatttctgtttttcttaggctatgtaggacttaacttattgtgcattggtaacagattgtagaacataagctgaaagataaaattcttgaccttaatgtctcatcttaaaaagaagcattggttgacattctatatctcgtattacttaaaaataatgggggagcgcagtatatattaaacaaagattggctttgtggtgatcattgttgaaggtggggtgatggctatgtgaaggttcactatatatactccctactgttgtataagtttgaaattgtgcataatagatttatttaaaacacaaagcatagaaatatctactataatattatggtgagagcaaaatttgagggggatgtacacctgcattttcgaagaatatatacatttcggagaccgaattcaaaatgaaaaaccgggctgctgtcccgcacggagcctctgggcgccgctgtcggccagtgcagagcaagcgctgacgccggggatccgtcagcctctggcctgggattccctgcgcagccaacaacagaaagaagaaaaccagctcccacacagagcctcccggctgcgcagacctttcccagcacagcggattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtgctatttcctttgctgctgcctttgttctaccccaccctgagtgagccgatccgctactcgattccggaggagctggccaagggctcggtggtggggaacctcgctaaggatctagggctcagtgtcctggatgtgtcggctcgcaagctgcgagtgagcgcggagaagctgcacttcagcgtagacgcggagagcggggacttacttgtgaagaaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaatttgataaaaaggaaatacatttagaaattttcgaatctgcatccgctggtacacgactatcgcttgaccctgccacggatcctgatataaacataaactcaattaaagattataagataaactctaatccttatttttcattaatggttagagttaattccgatggtggcaaatacccagagttatctctggagaaactcctagaccgggaagaacagagatctcatagcttgatattgactgccttggacggaggggacccaccaagaagtgccaccgctcacatagaaatttctgtcaaggataccaatgataaccccccggttttcagcagagacgaatatagaattagtcttagtgaaaatctgccccctgggtcccctgtgttgcaagtgacagccactgaccaggatgagggggtcaatgctgagataaactactacttccgaagcactgcccagagcacaaaacatatgttctcattggatgagaaaacaggtatgattaagaataaccagtcatttgattttgaagatgtagaaaggtacaccatggaagtggaagcgaaggacggaggtggtctctctacccagtgtaaagtaatcatagaaatccttgatgaaaacgacaacagcccagaaataatcatcacttctctctctgatcagattttggagaattcacctccaggaatggttgttgccctcttcaaaacacgggatctggatttcggaggaaatggagaagtcaggtgtaatatagaaacagacattccattcaagatttattcttcttccaataactactacaaactggtgacagatggagccctggaccgagagcagacaccagaatacaatgtcaccatcgtagccactgacaggggcaagccgcctctttcttccagtagaagcatcaccttgtatgtcgctgacatcaacgacaacgccccagttttcgaccagacgtcctacgtggtccacgtggccgagaacaacccgccaggagcctccattgcgcaagtgagcgcctctgacccggatttggggctcaatggccacatctcctactctatagtggcgagtgacctagagcccctggcggtgtcgtcatacgtgtcagtgagcgcgcagagcggggtggtgttcgcgcagcgcgcctttgatcacgagcagctgcgcgccttcgcgctcacgctgcaggcccgcgaccacggctcgcccacgctcagcgccaacgtgagcctgcgcgtgttggtgggagaccgcaatgacaacgcaccgcgggtgctgtacccagctctgggtcctgacggctccgcgttcttcgatatggtacctcgctctgcagagcccggctacctagtgactaaggtggtagcggtggacgccgactcgggacacaacgcctggctgtcctaccacgtgctgcaggccagtgagcccggactcttcagcctggggctgcgcactggggaggtgcgcacggctcgagccttaggcgacagggacgcagcccgccagcgcctgctggtcgctgtgcgtgacggtggacagccgccactctctgccaccgccacgcttcatctggtcttcgcagacaacttgcaagagatactgccagacctcagcgaccgccctgtactctctgacccccaggctgaactgcagttttacctggtggtggccttggccttaatctcagtgctcttcctcctcgccgtgattctggccattgccttgcgcctgcgacgctctctcagccctgctacttgggactgcttccatcctggtctctgtgtcaagtctggacctgtagttccccccaactacagtgaggggactttgccttattcttataatctgtgcattgcacatacgggtacaaaagagtttaatttcctaaaatgcagtgtgcccctacattccaatgaagacatggtttgcagtgtttctcctggagccttaattccacctcatggtggggaggatttgacttcacatcctgagactctgacttcggtgagtttctcttttttgtgtgtgatttatctaatagtctactagtttctcatattttaggcatactactttattttcatatctagaatcatatgtttaaaatccatagctttttacaatattttctcaatgttttttcaattatagttttcactatgtatttggttcataagttgctctatctttttgtaaaataatgtcaccagactgaagatattttgtctttgtcttttttttttttttttttttttgagatggagtctcgcactgttgcctaggctggagtgcagtggcgtgatctctgctcactgcaacctccgccttctgggttcaagcgattctcctgcctcagcctcccaagtagctgggattactggtgcccctcaccacagctaaattttttgtatttttagtagacatggggtttcactatgtcgaccaggctgttcagaaactcctgtcctcgtgatcctcccaccttggcctctcaaagtgctgggattacaggcgtgagccacaatattttgtcaagttctgactatcgaacagaagcagtggtcttggcatctaagaaaacaaacaagtaacctatctattcaaatttgcgaagacttagtgaatttacgatatcttatttatatatttttaaagcctaaaaatattcagaagacaggcccagtggctcacacctataatcacagcactttgataggctgaatcggaaagtatcacttgagcccaagaattgagaccagcctgggcaatatagggagaccccccatctctactaaaacaacaacaacaaaaaaaaacattagcagagtgtggtagcattcccctgtggtcccagctacttgggaggctgagctgggtggattgcttggtcctgggaggtcaaggttgcagtgagccctgatcttgccactgcactccagcctgggcgacagagtgcgaccctgtctctaaaataaataaataaatatgcaggcagggccaagtgtgctgtaatcccagcactttgggaggtggaggtggagaatctcttgagcgcaggaatttgagaccagcctgggcaacacagggagactccatcgctacagaacatttaaaaattagcagggtgtggtggcacatgcctgtggtctcagctactctggtggctgtggtgggagaatcgcttgagcccaggaagtctaggctgcagtgagctgtctaggtgacagagtgagaccctgtctcaaaaaaaaaagacatttctaagaaataaatgaaatactattgcctttgcactcagtctctgtctctgattctctgatagaagatttttgaagaaaaaagataaaatctttgaagagttctatacttggaaggcatagtgacataaacacttctgaacatcctgttctctgtgtgaaagaagtgaacttctataccctttgcatttgagggaacaattgctactgggttgatgggcacacacagttgaagatatgtgaaccactggactttggcctctgatacaaactgcctaagagaagagattatttatactggtattaatgctctgatgaaaacaggtcatttgacataaacacttacttgttaaaaacctatatcactacatctaactttgttttctaaaacttttagtacttcaaattctacgtatttcttttctcattacaatgcaaacagtttaatttgcaactgtaatatatgttcattttagtttgtgattacctgcttaatcatttaaataggtccatttaacttgtatccctgtaagataaagtatgttttacacaaaaaggttaattaaggctcagtaaaactattctagaagagtactttaaaaacctcttacacaatcctaagctaaataagtttaatgaattaagtagttacaattataaagcttcagagtgaattatctcatgagtttatttaatataatctttgtatgaatgtatactaaataaaattggcctattcaaatcacaattttaaattataagacttttctgaatttacctagacactaatatgacctaaaataagtattatttaccttttattaaagtgtgtacatttctgttgggaaaacgtgttgcaaatatatatttaaccaaacattatcttgaaatatttacaatattttcactccactttatcacacctcccctaagaaacctacatatagtaaattatttaaagataggagtggagaaaccaaagaatctatgtaaaatataataatccaacagaatagtttactttccattgcatgtatcacttgggtgcagtaacttcttaggactctgagcgccgctgttcacctactaggagagaaaacgcagccagagctcaatccggattctcagggcttcaactacacaagccccacaaaccggctgctgggctgcagggaagctcactccagaatttaaagtgcccaggctacagagacaccctgaagccacagaaagacaaaggaaccggttgaaacacacaacgtgtccagtgaggactttgcagaattctgtaaccagactacaatggccgctcaaaggaatcgctcaaaggaatcaaaggattgcagcgggctggtcctgctctgccttttcttcgggattccatgggaggctggagcccggcagatctcctactcaattcctgaggaattagagaaaggctctttcgtgggcaacatctccaaggacttgggtctggcgccccgggagctggcggagcgcggagtccgcatagtctccagaggtaggacgcagcttttctctctgaacccgcgcagcggcagcttgatcaccgcgggcaggatagaccgggaggagctctgcgctcagagcgcgcggtgcgtggtgagttttaatatccttgtggaagacagggtgaaactttttgggatagaaatagaagtaactgatatcaatgacaatgctccaaaattccaagcagaaaatctagacgtaaaaattaatgaaaatgtcgctgcgggaatgcgttttcctctcccggaagctattgatccggatgtgggcgtgaactccctgcagagctatcagctcagccccaataagcacttctccctaagagttcagagccgtgccaatggcgtcaagtacccggagctggtactggagcactccctagatcgcgaggaagaggccattcaccacctggtcctcaccgcctccgacgggggtgaccctctccgatctggcactgtccttgtcagtgtgactgtcttcgatgcaaatgacaacgcgccggtcttcaccttgccagaataccgagtgagtgttcctgagaatttgcctgtgggcactcagctgctgacagtcacagccaccgacagggacgaaggtgccaatggagaagtgacatattcattccgaaaattacctgacacgcaattgttgaagttccaactaaacaaatatactggagaaataaaaatatcagaaaatctagattatgaagaaaccggtttctatgaaatagaaatacaagcagaagatggaggagcatatcttgcaactgcaaaagtgttgattacagtagaagatgtaaatgacaacagtccagagctgaccatcacgtctctatttagtccagtgactgaagattcacctctgggaacagtcgtagcccttttaaatgtgcatgatttagactctgagcagaatggacaggtaacctgttccattttggcgtatctaccatttaaattagaaaagtccattgacagttattacagattggtgatacacagagcccttgacagggaacaggtatcctcttacaatatcacagtgacagccacagatgggggaagtcctcctctatcaacggaagctcactttatgctacaagtggcagatatcaatgacaacccacctaccttctctcaagtctcctactttacctatatcccagagaacaacgccaggggtgcctccatcttctcagtgacagcgctggacccggacagcaaagagaatgcccagattatttactccctggctgaagacaccatccagggggtacctctgtcctcatacatatccatcaactcagacactggcgtcctgtatgcactcagatccttcgactatgagcagtttcatgagctacagatgcaggtgacagccagcgacagcggggatcctccactcagcagcaacgtgtcgttgagcctgtttgtgctggaccagaacgacaatgcgcccgagatcctgtaccccgccctccccacagacggttccacaggcgtggagctggcgccccgctccgcagagcccggctacctggtgaccaaggtggtggcggtggacagagactccggccagaacgcctggctgtcctaccgtctgctcaaggccagcgagccgggactcttcgcggtgggggagcacacgggcgaggtgcgcacggcgcgagccctgctggacagagacgcgctcaagcaaagcctcgtagtggccgtccaggaccacggccagccccctctctccgccactgtcacgctcaccgtggccgtggccgacagcatcccccaagtcctggcggacctcggcagcttcgagtctccagctaactctgaaacctcagacctcactctgtacctggtggtagcggtggccgcggtctcctgcgtcttcctggccttcgtcatcgtgctgctggcgcacaggctgcggcgctggcacaagtcacgcctgctgcaggcttcaggaggcggcttgacaggtgtgtccggctcgcactttgtgggcgtggacggggttcgggctttcctgcagacctattcccacgaggtctctctcaccgcggactcgcgaaagagtcacctgatcttcccccagcccaattatgcggacacgctcatcagccaggagagctgtgagaaaaacgatcctttgtctttgttagatgattcgaagtttcctatagaggataccccattggttccagtgagttttattttcatttttacttttgttaaaaaaaaaaagattggtttttactttgaagtttgcggcatgatggtggaaagtgtaaatgctaaaacactgatgagtagaatttgatgtttattaaggttttttttttttttttttttttttttttttttactttctggtaaaattcacctagtctcaatcaaggcctatatatcataaggctttgttatgattagctttgcagaaccttgtagtttatagtgttgttgagtacaatattgacaattcctaagacagacttccatacagaagtgcctgtcaatttatatttcctcctgggtggtcacatattgaaactccagccccttaagcaaccctcttgttctgaaggcaggtctggtaagaataggtaagtatcagaaagaaatcacctctggaaacacaacccaaatccaagaatactcaatgcagttcttcccaaggagaagggcaataggcctttttcaaactacattttatatatttttcaatctatactttgtggtgatagttgcagttgaatatactaagtttttcattaatattgaattaacaatttatttataacaatgtatgcttagatttttccagccctatttataactgataacactgcagtatcctttttgcatacaattctctaatttcacactgctatgtggaagatatagcattttaatttaactttcattgctcaatagggatcctgaggaggctatagagggtgaaattaagaatatttgggattctgcttttgtcttttttgttaaattttctagtgactaaggctgaaagtaaatatgggttgggaagacagataaatttgtacatgttcccgagaacaggagcaagagatatatgacaaagctatttcagtggctctttaatgtataaggaggcaaacacctgaaactctgaaaactctgaaattgagaggcaaaataaacttagagtcaagaaagaaatgccatttctgcagatcagaatataaacaccaaccacagctgtaaaaaagaaaagaatatatgcaacgaagggaaattatataaacaaaggatcattggaggtactgatgagttcatttagttcaatgaaaatagtgacgtattaggtagatctcttaattttattactagtattctactaaatgtggtagtataaagtcaaaaagcattccgaagtttctcaagacccttataattccatgatttttttcaggtcagtcaacatttgttgaatgataggtctgtggaaggaaagcacactctttagggtcatagttattaactattaaaccattgaaactattattttatatttgtgttaatgagagtcaaaattattgtgcattcatctcaaataattctattattttgaaaaatacaggttttttttttaaaaaaaactgctcttgacattgtagctattgtgagaaaatattttgattataattatttaaaagcaatacaggacaccctggatgatggtaatgactagggcaatggttgcattccagtacttaagtatgaaataaggaattattactttctgggtgaatataggctagaattgaagacaaaaaaatttgttgcttatcttcagtacttccagcttcatagataattactcttaaaaggaacaagaatgactgcctctggatggaggaattggatagcaatgggccgtgggataggagacctataaaccttcatgctatattattttgtgcctttttaaattttgaagaaaaaatattcatttattcaagatatatgtaaattcagtaaataaaaagatatgatagttatgaccaagtggaaatatatttcctgatgtaaaaggaatcactgaggaaaaagattaaaatattttggctgtcaactcgtagtttaaaaaaaattccttgaaagaggtagagaaaagtcaagttgcagtcccacacagagcctctgggcgccgccgtcggccagtgcagagcaagcgctgacgccggggatccctcagcctctagcctgggattccctgcgcagccaacaacagaaaagaaaaccagctcccacacagaggctcccggctgcgcagaccttgcccagcacaccagattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtactatttcctttgctgctgcctttgttctaccccacgctgtgtgagccgatccgctactcgattccggaggagctggccaagggctcggtggtggggaacctcgctaaggatctagggcttagtgtcctggatgtgtcggctcgcgagctgcgagtgagcgcggagaagctgcacttcagcgtagacgcgcagagcggggacttacttgtgaaggaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaattccggaaagatgaaataaacttagaaatcagtgaatccgtcagcctggggatgggaacaattcttgagtctgcagaagatcctgatattagtatgaattcgctgagcaaataccaactaagtcctaacgagtatttctcattggtggagaaagacaatcctgatggtggcaaatatccagaattagtattgcagaagactctggaccgagaaacgcagagcgctcaccacttggtactgaccgccttagatggtggggaccctccccgaagcggtactgctcagataagaatcctggtaatagatgccaatgacaaccccccagtgttcagccaggacgtgtacagggttagccttcgggaagacgtgcctccaggcacctccatcctgagagtgaaggccactgaccaggacgagggcatcaactcagagatcacttattccttctttggtgtggctgacaaagctcagcacgtgttctctctggattacactacaggaaacattctaactcagcagcctttggattttgaagaagtagaaagatatacgataaacatagaagcaaaagaccgaggatctctctcaacacggtgtaaagtaattgtagaagttgtagacgaaaacgacaacagcccagaaataatcatcacgtcactctctgatcagattatggaggattcccctccaggagtggttgttgccctcttcaaaacacgggaccaagactcaggggaaaatggggaagtcaggtgtagcttaagtagaggtgttccatttaagattcattcttcttctaataattactacaagctagtaacagatgaggccctggatcgggagcagaccccagagtacaacgtcaccatcgcagccacagacaggggcaagcctccgttatcctccagcaaaaccataaccctgcacattactgacgtcaatgacaacgcgccggttttcggacagtcagcctacctggtccacgtgccagaaaacaaccagccgggtgcctccatagcgcaagtcagtgcctctgacccagacttcgggctcaacggccgtgtctcctactctctcattgccagcgacctggagtcacgaacgctgtcgtcctacgtgtccgtgagcgcgcagagcggggtggtgttcgcgcagcgcgccttcgaccacgagcagctgcgcaccttcgagctcacgctgcaggcccgcgaccagggctcgcccgcgctcagcgccaatgtgagcctgcgcgtgttggtgggcgaccgtaacgacaacgcaccgcgggtgctgtaccctgcgctgggtcccgacggctccgcgctcttcgacacagtgccgcgggccgcgcagccaggctacctggtgaccaaggtggtggccgtggacgcggactcggggcacaatgcctggctgtcctaccacgtggtgcaggccagtgagcccgggctcttcagcctggggctgcgaacaggcgaggtgcgcatggtgcgtgctttgggtgacaaggactcggtccgccagcgcctgctagtcgctgtaagagatggaggacagccacccctttcagccactgccacgctgcacctggtgttcgcagatagcttgcaagaggtactgccggatttcagcgaccatcccacaccctctgactcccaggctgagatgcagttttacctggtggtggccttggccttgatttctgtgctctttctcctcgcggtgattctagctattgctctacgcctgcgacagtctttcagccctactgcaggagactgctttgagtcagttctctgctccaagtccggacctgtgggtccccccaactacagtgagggaacgttgccctatgcctataatttttgtgtgcctggggatcaaatgaatccagaatttaattttttcacatctgttgatcattgtccagccacacaagataacctcaacaaagatagcatgctactggctagcattttaactcccagcgttgaagcagataagaagattcttaaacaggtaagtatttaaaaatgtatttaatcctttttatattacaatatgccaatatattccaatatagtggtattattttaagattctagataacttcttcatagagttcgcaaaatataggtcaaatttatggttatcattattaaaacaaaagtttaaattaaatgcctcagtcttcctactattcaaagacattttaaagcaaactacatgggtaatctccggtgacatttttatgaagtaaaatacctttcggttaaaaatataaaatacaggtatatttttacggcatggtattttaattgaaaccctgatgctactcaatttttctcaagtatttcatcttcatttactcaataaaggaaccttgtaagaattatagttaggcatcctacctgatgattttatcgggaccgtattatttccacttccagaaatgtcgttcctttcagtcggttaaaatcaattggaaccaactacaacctacaagttttcagctccagtaatattttgaaaactttttaaaaattaagcaagcccttttaataattactcctttcgcaggtgttcttggtaaagttttaacgtcacataatgtaagtattgtgtatcatcgtttttaagctctacaaatacgtgtgattcacaaaggtgagcgtaatcatttcttctggaatttcttagtcgttgcaataataagaatgggctctaggcgccgctgctcaccaatcagggaatgggaagctgcgcgccattgagtccctccctcccccgcctctaccacacaaagcggaatgagatggatactcacagatcctgacactggagacttagaagtattttccttcgctttctgatatattttggatgtagtcggcctaggacttcatagatacataagccgattcacaaccaaccagctcgagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccccgggagctggcgaagcgcggagtccgcatcgtctccagagggaagacacagcttttcgctgtgaatccgcgaagcggcagcttgatcacggcaggcaggatagaccgggaggagctctgtgagacggtgtcctcctgttttttaaatatggaacttctcgtggaagacaccttgaagatttacggagtggaggtggaaataatagatattaatgataacgcccccagcttccaggaggacgaagtggagataaaagtcagtgagcacgcaattcctggggcgcgatttgctcttcctaatgctagggatccagatgtgggcgtgaactccctccagagctaccagctcagccctaataattacttttccttgcaactgcggggcagaacggatggggccaagaatccagagctagtactggagggaagcctggaccgagagaaagaggctgctcacctgctcctcctcacagctttagatggaggcgatcccatccgaaagggcgcagttcccattcgtgtggtggtcctcgatgtaaatgatcacatcccaatgtttacacagtccgtatatcgcgtgagtgttccagaaaacatcagctccggaactcgggtgctgatggttaatgcaacggatccagacgagggaatcaacggggaagtaatgtattcatttcggaacatggaaagcaaggcttctgaaatattccaattggattcacaaactggagaagttcaagtacgggggtctctggattttgaaaaatatagattctatgagatggaaattcaaggccaagatggtggaggtctctttaccaccacgacgatgttgatcactgttgtggatgtgaatgataacgctccagaaataactatcacctcttctattaattcaattctggaaaactctcctccaggtacagtgattgctcttctaaatgtgcaagatcaagattctggagaaaatggtcaagtctcctgttttattcctaaccacctgccttttaaattagaaaagacttatggaaattattacaaattgataacaagcagagtgctggacagggagttggtccagagctacaatataacgttgacagccacagaccagggaagcccgcctttgtctgcagaaactcatgtctggctgaatgtggcagatgacaacgataaccctcccgtttttcctcactcctcttactctgcctacattcccgaaaacaaccccaggggtgcctccatcttctcagtgaccgccctcgacccggacagcaaacagaatgccctggtcacttactctctgacggatgacactgtccagggggtgcctctgtcctcctatgtctctattaactccaacactggtgttctctatgccctacaatccttcgactatgagcagtttcgagacttagaactgagagtgatagcacgtgacagcggggacccgcccctcagcagcaacgtgtcgctgagcctgttcgtgctggaccagaacgacaatgcgcccgagatcctgtaccctgccctccccacagacggctccactggcgtggagctggcgccccgctctgcggaacctggctacctggtgaccaaggtggttgcggtggacaaagattcaggccagaacgcctggctgtcctatcgcctgcttaaggccagcgagccgggactcttcgcggtgggggagcacacgggcgaggtgcgtacagcgcgggcactgctggacagagacgcgctcaagcagagcctcgtggtggccgtccaggaccacggccagccccctctctcggccaccgtcacgctcaccgtggctgtggccgacagcatccccgaagtcctggcggacctcggcagcctcgagtctctggctaactctgaaacctcagacctctcgctgtacttggtggtggcggtggccgcagtctcctgcatcttcctggtctttgtcatcgtgctgctggcactcaggctgtggcgctggcataagtcacgcctgctgcaggcttctgaaggcgggttggcaggtatgcccacgtcacattttgtaggcgtggacggggtacaggctttcctgcaaacctattcccacgaggtctctctcattgcggactcgcagaagagtcacctgattttcccccagcccaactatggggacacgctcatcagccaggagagctgtgagaaaagcgagccactcttgatagctgaagactcagctatcattttaggcaaatgtgacccgacaagtaatcaggtgagatttatttctctgcctcctaattgttggtgtcttggcacaagtcttttaaggagatgttttttgagcctgttatgaaaactgtttggggggggggtggggcggcatatatttagttcatatatatttagagcaatacatgtgagttttactttgcctttcatgagattacgataatctttcagaacgtttttgtgaaagtcatttttcaatcttggcatattttcttttgatttcaaaggggccattcaactatgctggtttggtttgaagtaagttgaattttagtattatttttctattatcagtgtatgaggctctcaatttattatatatagatacaaattaatgattcacaaacactttttatttccatttcaattttgctgtgccttcactgatttgtagttatattccaccattatttgctattactgctaatgttcaaattttgatcctgttgatttaatagcatgctccctctagctctccttctcatctatctatctatacacatgcacacacacttatacacgtaagcttttctctgagcaattttattttgattcttggtggctggtaatatgcttagatcctgttgactatttcaactttgtctcatttcttcatcctatcaacacagacatattgactggcttttaactactggatttccttgggagataaaatttagatcacattttttcttaagctctagatgtcttttccattactatggtgaagttacattgactgttctgaggaaataattgaattattgaactggtattatttccttttattcttttactttggtgtctgtgtttgtatgtatggaaggttttttaatgtagtaaatccatatatagaaataacttgattttgattcagtgcttctcaaaaacctattttcaaatgtgctaaagatgtctacagatttattcaaatagagtagtttgtgaatatataaatagattgaaggtatttggactttaattaaactgatttagctagtatccttctggctatttttttgttcattttcagtgtagttgggagtcatagattccttctttctttctttataaggtcattcttatggcaaatagtacattcagttcttttattcagaccaacttgttattgaagcttgatagttgcctgacatacatgttatctgaagcaatgtctaggaaagccaaatgaggaaaggagacttatctagggtttttgatcacaggaatcatttccataatcaattcagtcaacactctcacatcacttctaggtatttgccccaaattacttggatatttatgttccctttcaagtttagttttctcatttaggaatttaccttatgtcattagttgtaaactgactatctagggctcggacaaaaataatttcaactgtaggaaaggcaagtcttccaacagatgcctacatttttcttgaagtcaagaaaaatgttcaggtattttgagcatctagggataggatttatacttgtggaattccaaactgagaaaaatgatgtaaggcattgtactttgactggaattagttaaataaaaaggatatgaggtatttggctgggaaaaggagattgttccatattataaaacctcatctaaactaacttcccaagatcgtggagaacaaaaaggaagggttggctttgaaatgtgatattaagagggttatgttgattcggaggtagtgataaagttctgttaaggtataacatatagtcccattaaatagaggataaaaataaaacaccatcacatttcatgttattaattcctatggcaacctactaggctatacctttatattctctttatgatgaaacatgaaacaataatccttttcagaaacctcttttataagtgataagaagggtttggctaactttattctgaatatgccctatatagctttcagtgctcctccagttttctctgataaaactaggaggaaaattatctgcacatcagattgaaaataatactgcatatcatttcatagtggtcaaaattttcccataccacttgatggggatgttttcccacaaggtttttgttctacaacaggagagaagactttgcctagttcttccaatatgtgcattgcttctgcttagaaaaaaacaaacttttaaattctctttgctgggttaatgactgttctatagattcccatctctaaggaatcttctttggtagtaaacactggaaaacagtcactacgaaaactcataaaatgtctagtttcctatacattagtccaacacatcagtctaattctgaatcccattgaattagcaaaggcttccggctgcagttttctaaatagactcagagccctgctgttggccaatgtgctgcaagaactggagcctgggatctaccaggacgatattctgttcagtcacagaagcaagtcggagagtggccaagacttgggctttctgctcctgcaaatctgattccatacggattggggtgccctcaaactgggagcattgagttttctatgtatggaagtaaatattttaaaagcactttgtgaaacattttctcttaacgtcggagactgcagcaacgcatgggaaggatgggaaacagggtgaagcagagaagcaggacccggcagtggcaagcactcttccctttcctgctgcctttgttctgcggggcaccctcggagcagatccgctactctattccagaagaaacggtccagggctccgtggtggggaaccttgcggaggacatgcggctgcatgttcaggatttattgacctgaaaccttagagttagtgcagagaaacaatactttaccgtgaacacggagaatgggaacatacttgtgagtgacagaatagatcgagagtcactgtcttcaaaatcctctgtgtcatacccttagagattgtagcagagaatcctctaaatgtttttcacataaatgtgatgatagaagatataaatgataacccacctcattttccccaaaatagcattgttttacaaatcaatgaactagcaattccaggcattcggtttggcctggaatctgctatagatgcagatgtagggcctcactctctccagagttaccagctcagttctaatgaacatttctctctgatgatggacaagactaaaggcaagaacgctccagaattagtgctggagaagcccctgggccaggagcaacagagctctcatctcctggtcctggaagcaatggacatgggtgacccagtcccaactggcactgctgcaattcaaattgaggtcactgatgccaacgataatgccccagtttttagccaggatgtatacaaagtcagccttagagagaatgtgcccccaggcacctctgtactaaaggtgacagccactgaccaggatgagggtgtcaatgcggagatcacctactctttcaaatccctacgagatgatattggaaatatgtttgtgctagaccatcaaaatggggaaattaaatccaaagacttaatagacttcgaatttcgtagcagttataccatgagagtagaagctaaggatggtggaggcatgaccagcgaatgtaaaattatactagaaatcctagatgagaatgacaatgccccagacgtggtttttacttcagtgtccagttctgtaactgaggacgcagaaccctggacggtgatcactctgttcaaaacacatgataaagattcgagagaaaatggggaggttacatgcctcataaacgaaagagttccttttagaatcgaatcttccgccaataatgactataagcttgtaacagatgggaccctggattgggagcggatcccggagtacaacgtcaccatcactgccactgacaagggcaagcctccgctctcatccagcacaagcctcaccctacgcattggtgaagtcaacgacaatgctccggttttccaccaagtctcctacgtggtccacgtggccgaaaacaaccttcccggagcctccatcccacaagtcagcgcctctgacctggacctagggctgaatggccaagtctcctactccatcgttaccactgacttggagctgcgggcactgtcgtcctacgtgtccgtgagcgcacagagcggggtggtggtcgcgcagcgtgccttcgaccacgagcagctgtgcgccttcgagctcacgatgcaggcccacgaccagggctcgcccgcgctcagcgccaacatgagccggcgcatgttggtgggcgacctcaatgacaatgtgccgcgggtgctgtaccccgcgctggggcccgatggctccgcactcttcgatatagtgccacgcgccgcagagtccggctacctggtgaccaaggtggtggcggtggacgcagattcgggacacaacgcttggctgtcctaccacgtgctgcaggccatcgagcccgggcttttcagcctggggctgcacacgggaacctgctggttgctgtgcgtgacggaggacagccgccgctctctgcgccgctacgcttcacctagtcttcgcagacagcctgcaggaggcactgccagacttcagtgacagtcctgtgccctctgattcccaagcaaagctgcagatttacctggtcgtggccttggccttgatttctatgctcttcttcctcgcagtgattttggcggtcgccttgcacctgcgatgctcttccagcccctctgcctggggttgctttcaccctggtctctgttctaagactagaccaggggtttttcccaactacaatgagggaactttgctttattcctgcaatctgtatgttccctcggattctagaaaaagaagatttaattttctcaccatgacaccagaaacagtccccccacaagatctttctaatgaagtttctctggtagcaagcttcactgaagagaataacaagataagctctaactctgttgctcctactcacgtgagttccaatgaatgtctttcatttacaaatggatgaggtttaattttcaaaccaatattttggcaagaaaatcttaaacatattatatctactattgcttcaggtttgtttgcccactcttaatatttcctgttcctttctgtgtgggccagtaacttcattattagctttcatgtatttttgaaacattttcaccatttttacgggagactttttttttttttggacggagtctcgctctgtggtccaggctggagtgcagtggcatgatctcggctcactgcaagctctgccttccgggttctggccattctcccgcctcagcctcccgggtagctgggactacaggcgcccgccaccacgcccggctaattttttgcatttttagtacagacggggtttcaccgtgttagccaggatggtctcgatttcctgacctcgtgatctgcccgcctcggcctcccaaagtgctgggattataggcgtgagccactgcacccggcccggagacattgtttatacacacacacacacacacacacacacacacacacacgtgtgaaaagtgggtattatgatactgctgtcattgagatattttaattgaggaataaatttttttcctgtgatgtttcttgggacatcaatatttgagtatataaggctttttctttaatccattaactataaattttgaagaaaatgcatgagaaaatggagaaaatgtgttttttttttaaaaaaaattgagattaaggtctcattatgttgcccaggctggactcaaactcttgggctacagtaatcctcccacctcaatctccagagtagctgagactacagttgcctgaaactgtgcctggcagagaaaaaagcttaaaaaaataagaacatggtaatgatttgataatattcagttacatttacttttgattcttgtaattcaagtaaactcaattttatgtctgatattttctcacagctacctatatatttcttcccaatttaaaatatattattttattttatgcctagcaaatatctttacagtataaatatttacgctcatgaaagtacgtagccagttatttcttagggagaattttttccctatattttgatgggcttccaaaagtattaccagtaattctcagtaattacaattaggtcagttacccaggaaaaggtaagtctgtaacattctttggactaccaattttcttttactaagtttcctgaacaataaatatttttgaaatataatgtattaatagaattctggagtacttccattatttccagtcaatgcaagttggaatgcttctactttatgctaaaaatattaatgtttctttttcacttgggttcttgttaagtgtgattctgataatgtatacaatcacatatcatttttaggtttccataatatcatgaaaatttgatttttaagcgttacatgtcaacaacctggtaaagtaatccttccattcaggatcattcaaggaatctatttaaaaatattttccccaaattatagctgaatcagaaagtttaaattattatattatatgatttgtcaaaaagagaaactcctagggagacatctccataataggtgtgttgggggaacagtaatctcaaagcagatgcactaacattataagattaaaatcattgtttatagaaacttccaattcatttaaaagctcattggggaaaaaaaagctcattgggaaaaaaaaaaaaagctcactaaagtttctattaaagcgaatacggtagatttccatccccttttgaagaacagtaggtggagctatttaagatataaaaacgaaatatcctttctgggagttcaagattgtgcagtaattggttaggactctgagcgccgctgttcaccaatcggggagagaaaagcggagatcctgctcgccttgcacgcgcctgaagcacaaagcagatagctaggaatgaaccatccctgggagtatgtggaaacaacggaggagctctgacttcccaactgtcccattctatgggcgaaggaactgctcctgacttcagtggttaagggcagaattgaaaataattctggaggaagataagaatgattcctgcgcgactgcaccgggactacaaagggcttgtcctgctgggaatcctcctggggactctgtgggagaccggatgcacccagatacgctattcagttccggaagagctggagaaaggctctagggtgggcgacatctccagggacctggggctggagccccgggagctcgcggagcgcggagtccgcatcatccccagaggtaggacgcagcttttcgccctgaatccgcgcagcggcagcttggtcacggcgggcaggatagaccgggaggagctctgtatgggggccatcaagtgtcaattaaatctagacattctgatggaggataaagtgaaaatatatggagtagaagtagaagtaagggacattaacgacaatgcgccttactttcgtgaaagtgaattagaaataaaaattagtgaaaatgcagccactgagatgcggttccctctaccccacgcctgggatccggatatcgggaagaactctctgcagagctacgagctcagcccgaacactcacttctccctcatcgtgcaaaatggagccgacggtagtaagtaccccgaattggtgctgaaacgcgccctggaccgcgaagaaaaggctgctcaccacctggtccttacggcctccgacgggggcgacccggtgcgcacaggcaccgcgcgcatccgcgtgatggttctggatgcgaacgacaacgcaccagcgtttgctcagcccgagtaccgcgcgagcgttccggagaatctggccttgggcacgcagctgcttgtagtcaacgctaccgaccctgacgaaggagtcaatgcggaagtgaggtattccttccggtatgtggacgacaaggcggcccaagttttcaaactagattgtaattcagggacaatatcaacaataggggagttggaccacgaggagtcaggattctaccagatggaagtgcaagcaatggataatgcaggatattctgcgcgagccaaagtcctgatcactgttctggacgtgaacgacaatgccccagaagtggtcctcacctctctcgccagctcggttcccgaaaactctcccagagggacattaattgcccttttaaatgtaaatgaccaagattctgaggaaaacggacaggtgatctgtttcatccaaggaaatctgccctttaaattagaaaaatcttacggaaattactatagtttagtcacagacatagtcttggatagggaacaggttcctagctacaacatcacagtgaccgccactgaccggggaaccccgcccctatccacggaaactcatatctcgctgaacgtggcagacaccaacgacaacccgccggtcttccctcaggcctcctattccgcttatatcccagagaacaatcccagaggagtttccctcgtctctgtgaccgcccacgaccccgactgtgaagagaacgcccagatcacttattccctggctgagaacaccatccaaggggcaagcctatcgtcctacgtgtccatcaactccgacactggggtactgtatgcgctgagctccttcgactacgagcagttccgagacttgcaagtgaaagtgatggcgcgggacaacgggcacccgcccctcagcagcaacgtgtcgttgagcctgttcgtgctggaccagaacgacaatgcgcccgagatcctgtaccccgccctccccacggacggttccactggcgtggagctggctccccgctccgcagagcccggctacctggtgaccaaggtggtggcggtggacagagactccggccagaacgcctggctgtcctaccgtctgctcaaggccagcgagccgggactcttctcggtgggtctgcacacgggcgaggtgcgcacggcgcgagccctgctggacagagacgcgctcaagcagagcctcgtagtggccgtccaggaccacggccagccccctctctccgccactgtcacgctcaccgtggccgtggccgacagcatcccccaagtcctggcggacctcggcagcctcgagtctccagctaactctgaaacctcagacctcactctgtacctggtggtagcggtggccgcggtctcctgcgtcttcctggccttcgtcatcttgctgctggcgctcaggctgcggcgctggcacaagtcacgcctgctgcaggcttcaggaggcggcttgacaggagcgccggcgtcgcactttgtgggcgtggacggggtgcaggctttcctgcagacctattcccacgaggtttccctcaccacggactcgcggaagagtcacctgatcttcccccagcccaactatgcagacatgctcgtcagccaggagagctttgaaaaaagcgagccccttttgctgtcaggtgattcggtattttctaaagacagtcatgggttaattgaggtgagtttatatcaaatcttctttcttttttttttttaattgctctgtctcccaagctggaatgcagcggtacgatcatagctcactgcagcctcaaactcctaggctcaagcaattatcccacctttgcctccggtgtaacagggactacaggtgcaagccacctactgtctgcctatctatctatctatctatctatctatctatctatctatctatctattactttcttgtacagacaggagtctcactatgttgagcaggctgatctgaaacttgggctcaggctagcctcctgcttctccctcccaaactgctgggattacaggcgtgaaccacagtgccccgcccttatcagatattcttttctggctgggcgcggtggctcacgcctgtaatcccagtactttgggaggccgaggcgggtggatcacctgaggttgggagtttgagaccagcctgaccaacatggagaaaccccgtctatactaaaaaaatacaaaattagccgggcgtggtggtgcatgtctgtaatcccagctacttgggaggctgagtcaggagaattgctttaacctgggaggtggaggttgcaatgagctgagattgtgccattgcactccagcctgggcaacaagagtgaaactctatctcaaaaaaaaaaaaaaaaaactttatcctctagtttcatccattgatgacacttgctttaatcacttattacaatcacctccaaatgaagattttataattccattgtttcttctacagttgttaattggctttctaccttgaagaagagttttatattctctatatatgtttgtttctatgattctggaagcatggttttctattttattcaatggcctgtaatctgttaatatcaattatttattttgatgctgaaattgtcccaggattggcctttgggactccctttaggctgatttctatgtcctttctgttacagcaagcttgggattatatccaagatttgtaattccaatgtacttacttctgtcagtgtaaacaaagtacgatttctggactagatgacttgggcattgtgggggaggtggaaattagaggtattctctgtttttcctgtaggatcttgcatttcttcctcttgctgcttgtctctttgtgtcgggaacaggccccccaaaatctggccataaactggccccaaaactggccataaacaaaatctctgcagcactgtgacatgttcatgatggccgtaatgcccatgctggaaggtagtgggtttaccggaatgagggcaaggaacacctggcccgcccagggcagaaaactgcttaaaggtgttcttaaaccacaaacaatagcatgagtgatctgtgccttaaggacatgcccctgctgcagataactacctcaatccatccctttatttccgcccatctcttcgtttcccataagggatacttttagttaatctaatatctatagaaatgatgctaatgactggcttgctgttaataaatatgtgggtaaatctctgttcagggctctcagctctgaaggctatgagacccctgattccccacttcacacttctaaaaaaaaaaaaatttttttttctgagcttggagaaatatatcccttagtacacttggcatttataaagcagacatcaataaatttatatatatgtgacagataccaacaacaatccagtccccttccctcataccttatttatgtacatatattttatataatagatataatttattaacaatttataaaattactttgttaatactctatatcattttctagctgaatttatcaatgataatgctcttttcccacttttatttttttcccattgaccatgcagcagttttgtgtagaccgtctgataacaactgatctgtttatctaggggggagaaatctaattcaatggaaaatataaataaaattgtgataaacttttgtaaatagagtggcttttaactacacttgagatggctagcaaattcataaagtgaatttactttctttcaaagttcagtaattctttctggccattagggatatgtccatttatactttctcagtatcccaagtcatttcatggttttaaatcattcatgaacttccaaatatagtgaatttatttcttctgcatttaaaattttatcacttaaatatacaatataccgtattgccatgacgaaaaatggtaaagactatttttcacttctgttatgcatttcattaatacgatatctgtatgtgtttccaagttagacatttcttttgcccatttcctacactaatgatactaatgatgactttgtggaatattcagaattaacaaaatgtgttttgagtgctttttttagtactggggcaaatttgcagtaatatcgcctgctttttacattaaattccccataacttttacaactatgggaaaatttctgaaacgtgcacagattccaagtgttttctgagaactttatgcttattgtagagtggttacagacactgaatgctaaagtgtattactctttgaaaagcattgcttgatttcttttggtgaattctgtaaaggtgcagggaaacataacgtcccaattattttttctttcttctttgtttgctgcctatctactttgaaagatacaatagttaaaacccagaaaagagattggaaaccccttagagaatgaaagacatccaagggctctaaaatgcggcagttgctgcttctgagaccaaaaaagggggcaaaatatagagtgtgtggttctacttgtgtgattttttgaaagaaagtatttgaatttatctaaaaatactaaatttgtatttacattagttttcaaatagaatttaataagtacagtgttctataggtaatattgagagaaatagaggacaatgaaacctctctcctccatcatcttgtatgaactaccaaaatgtttatcatatggacagttctcatatatagtcaaatagaaagaaagacataataggaaaacaaatgacttgggaaactaagctaacatggtctaattattctgacctctgctcacctaacttgatttaggaacaaatcattgagagttagagcatgaatagtcaagactgttagaccatatctcaaatatcagtgacttcaatcaactatgtttccagtttaagctgaataggctttattaaatagttgttgaatgaatggataaacaaataatgtactctggggattacctgataccaggattctgaattttcagatgtatcatagaaggatagcagctttgcaattaggtaaattgttaactgtgtcacctttagcaagttatttaatctctttgagcttcagcaaagtaggaataatcatatctaatttgaaaggtcgtggtgatggctagggctaacaaaaatctgattcacaacatgcaattaattaacagtagccatttttagtggttgaccaaaaaaaggatttatattttcaatgccagcacactcgatgttctgttgggaaaaataataatgatttttgtgtgcttctccatatggtataatggaatgatttgtggatggaaataaaactgttctaaaatttttgtgacagctggtttaaaaatcttaagtgcctaggcacattcttgattgagaagccacagttttaggccataaaagatgggggaaagatttttatatgagacaattttgtgagtgttactttttctttgtctgaaccatagtgaaatctaaacaaggatcttgtgaaacttattttaaagaagcagtttacttcaatgggatcttagataatttcaccagaaaatggatcaccgaaaccagaaggctggtgatcattatttggtttgggccatataagaattgaaactaacggcttagctttaggatttttaggacacttgttgataatttaggattcataattaacatatgtgttgattgttttctgagactaactgggcaatgggtttggatgtgtttacatttattctgattccagtcataaaattatgtcaaggactttccttgtctttttatgtgtatgacagatgtgtatgtatccatttcatctaacaagttaaagcgttcagctataatttaaaatttgtagcttcactgttttatagtacctaaaattggaatgtaatcagtcagaagacattcatccactgctttcattccagaagtattatgctttttgaagcagcaatagcataggaatgttgaggagactatactatacttttatagcatatttaatctcgtagatcacttttcaatgaattataaggctgatgacaaatgagcaaattgtatcagttttctttatgacatgtaacagagtatagctgtgatcatgaattggatagttctggtgtaaaaatctgctttatccccatataagatgtcaggttcagaaaagcaaacacatagtttcgaagagatgttgatcaaactgatgaggctaaatctcaagaaagagacacagttaccctctaatgttacactttgagttcacctttttttttttttttgagacagagtctcaatctgtcgccaagctggagtgcagtggcactatcttggctcactgcaacctctgcctcctgggttcatgctattctcctgccttagcctcccgagtagctgggactacaggcacacgccaccacacccagctaatttttgtatttttagtagagatggggtttcaccatattggccagaatggtcttgatctcttgatcttgggatgcacccaccccacctcagcctcccaaatagctgagattacaggtgtgagccaccatgcccgaccactttgagttcacttttaagaaaccatacttaatggaaaattaccagtaacagggcatactgtttaggatgcattcctaaaatattaatggcaaaagatagccagcctatggcaaagctaattggaaaaaatattttataaaggatgagacttctggataccatatgggaagggctctggttcaggaaaatgtttttaaaaaactgtcattgaagagaccatagaatcaaacaaaataatttaatctgtatgtaaaagaagttggtaccaccataatttttcttatacatgtcatataaggatctactctgtgtattgtcattgagggcagatataatttcttagttcatcattaactctctgaagtatttcacacagtagtttgtacaccttctaagtactcaatacaatgcttgagttcaattattggaaagtggtctcttggagaaaaaagaatcatagtgcaaaaccaattattttacatggacttttcctctatatctaagccctaataagaggcagctgtctgatatacatacatacatacatacatatatatatatatatatatatatatatatatatatatatatatacacacacacacacacatatatgtatatatatatttggagtaggggatggagtcttgctctgtcacccaggctggagtgcaagtggtgtgatctcagctcactgcaacctctgcctcctgggttcaagcgattctcctgcctcagcctctccagtagctgggattacaggcgcctgtcaccatgcccagctaattttttaaaatatttttagtagagacagagtttcatcaagttggccaggctgctcttgaactcctgacctcaggtgatccacctgccttggcctcccaaagtgctgggattataggcatgagccaccgcaccctgccaactgtctgacttatcttaaaaggctaaggacctggtttgtttgtcaaattttgaaaatagatgcctcagttcataagatttccatattgtgtggcaggcgcctgtaatcccagctactcaggaggctgaggcaagagaatcacttgaacccgggagacagaggttgcagtgagctgagatcacgccactgcactccagcctgggcgacatagtgagactctgacaaaaaaaaaaaaaaatccatatgtgaaaattcttagaagcttcctatacaatttcagctgaagattcagccaacagttcattctgagactgtgttccatggaaaaagtaaagcccaggcatggaagtgggaatggaaagaaagattctaagcctacaaatactcaaacatcaagaagaaataaaaataagtcatcacttcgacttcatgtgctaacatcactgaggttataaattcccaggaatattttattgcgggagcaagactgcactgctgcctttcagcttgcaaattccagtgagaaacgtctttctctctgctctcaactaactctacagaacgctgtcctctcatttcttcaggctgcagttctagagtagggactcagagtgccactgttggccagtctggaaacagagataaatgagccaatccccagacattccggcttggtggcttttctaatttcatggaatgcaaatccaagagcagacccacaacattcctattatggctcctagttctacaaattataagcaggaacggaacggatttacaggcaatgagttcagctccttcttggctggagattctataatccaagaagagtttgaaaaggggcttatttgggctggagcagcagcaactctaactgtggaaaaggtggggaatggtgctggactgacagtctgggtagaaccaaggcgactactgcctcctttcctgctatttctatcctgctgggcattctctatgatgcagatccgttattcagtcctagaggagctggccaagagtttggtggtgggaaaccttgccaaggatctgggactcagtgtcgaggacatgcccacttgaaagcttcgggttaatgctgaggaataatacttcattctaagtggggaaagtggagacttacttgtgaatgactgaatggatcaggagcagatacgccccccaattatagcttgggccataacgctttgaaatagttgaaggccaggcatggtggctcacacctgtaatcccagcactttgggaggccgaggcgagcagattacgaggtcaggagttcgagaccagcctgaccaacatagtgaaaccctgtctctactaaaaatacaaaaattactgggcatggtggtgcaggcctataatcctagctactcggggggccgaggcaggagaatcgcttgaacccgagaggcaatcgcaccactgcactccagcctgggtgacagagcaaggcgccatctcaaaaaaaatgaacaaacggtagttgaaaattctttaaatgtttttcacattaatatggagattcaggatatgaagaatcatgcaccacggttcagcaggaatgttattaagttacgtatctctgagtttacccagctggaacaagatttgcaacagaacctgcagaagatcctgatgttgagagaaattccttacaaaattatcaccttagcagcaactctatatttctctttgaagtaaaagtgaccaacagtggaaagacatatgttgatcctgtgttagagaagctgcttgactaggaaaagcagagctcccatcccttagtgctagcagccttagacggccccccaacaaagcagcatcactcaactcctgatcctattggttgaagccaatgacaaccctgtgttcatctaggatgtgtacagcgtcggccttcaggaagatgtgcatccgggcactcctgtgctgagagtgagggccaccaaccaggactagagtgtcaaggcagagatcacatatggcttcacaacccagagtacccatatctagtttggccttgatcaaatagtggagaaatgaaaactttaagtacattggacttttaaagatttttaatttccatggttttggtagcaagtgacagagagggactcattgtccagtgtacagttgagaccgaatttctagaagataatgacaatatcctagaggcgatttttacttctaattccacaatgattcccaaagattctgcaccttggacagtaatcactgtccaggatttaaatcacaagatctttaaatcacaagatctggattcgggagaaaacgaggtcacatgtctgatataagaaaatgcaccttgagaaaaatcttcctccaataattaactacatgcttgtaacaaatggggccgtggaccaggaacagacccaaggtataacatcagcatcactgccactgacagaggcaaaccaaccctctcgtccagcccaagcatcaccctactcattggcgatgccaacgacaatgctctggttttctaccaggcctcctacgtcgtccacgtggccaagaacaatcttcccaaagcctccatagtgtgcaagtagacacctccaacctagacttgggacccaacagccaagttccctattccatcgtggccagtgacctggagccacaggcgctgtgattctaggtgtccttgagcgcacagtgcgccttcgaccaagagcagccgcgagccttcaagctcacgctgcaggcccgcgaccaggactagctcgcgctcggcgtcaacgtgagcctgcgcgtgttggtggacgacctgaatgacaacgcaccgcgggtgctgtaccccagctctggagcgcaatggcttcgcgctcttggatatggtgctgcacgccgcggagcctggctacctggtcaccaaggtggtggctgtagacgcagatgtgagacacaatgcgtggctgtcctaccacgtgctgcaggccagcaagcccaggctcttcagcctggaatgcgcaccgacgaggtgctgacagctcgcacgatgggccacaggaaagcgactcgccagcgcctactggtcgcggtgcactgcggtggacagccgctcctctcgctaccgccacgtcaccaccactaccgcccctcgtcgccgacagcctgcaggagactctgccagacctcagcgatcactctgcaaagctacagcctgaatccaaaattaatttatatctggtgattgccttagctttaatttcctttttattcttcctgattgcattgtttgtgctggttttaaagtgccgaagaccccaaaatgatcctgtctgagtctttcccacggatgtctatcccgcgctaagccccaggtttctgggtaactgtagctctatgatgccatattcctaccaggtgtgtgcttctcctacgaatccagggctgagtgaacttcttttttgaatccctacccctcaggactcaatagcagtttcactgcagaaagccccttggggaaggggatgattgtgattattctaattgcttgggcagaatccactctccaaggtgaaaaattcttgatgaaactaagttcagtcacaagcaggttttcttctagcattaaatattttcagagatctcagtaaaaagcatttctagcagcaagaccaaaggcctaagatgagaaatatttggcatggtgagcttgagggacagtagtcaggcagacaagagtatcagacatgccagagcatttggggcctgtaggtaaggagcatgttttgattatatatatttgtatgtgtttgattatattttataattttactttgatattcaaattgtactgatccaaaaataagggagggacaaatcttggccattgtagtatgagagatgtaaatttacaactcagaatccctgcttatcacttctccttcagcacacaactgtttcattttctatttaagaaacttcctctcactgcaaaaagacattctggctgataaagttagcctataatttcagtaaatctaagaatatgactaatggaagttgccagacctaaactttgaaaattattgttccactgaagagcgtcttatgactgagtgttccagtctccttctcaagctgaaccttgcttttcaaaccagattaagaacactatcataagttatactgcattttatttccctacccatgtccactgcatcattctctatagtacaaagagcttgtctcgccaggcgcatctataatcttagcactttggggcgccaaggcgggtggatcacttgagcccaggagtttgagaccagcctggacagcatggcaaaaacccatctctacaaaaaaaaaaaacaaaaattaacaaggtttagtggtccatgcctgtggtctcagctacttgggaggctgaggtgtgaggatcacctgagtctggggagattgaagctgcagtgagctgtggttgcgctcctgtactccagtctgggtgacagaattagaccctgtcccaaaacaaacaaacaaataaagagcttctctccttatgacttatttaaagcttgggaaattgttccaattcaaatgctttaaatggacttgagctaaaacagaatgtggtatatgaaatgttcttataatcaggtgattgtaaaaattgatccagataatgttagcatagcattttactgaactagtagtttacaaacacttcaaaaattatagaataacatttgcatataaaattcctcatacatttccctatcagtgaattggaagcttacaatatacaatattaccaaaaagacaaaaaaaatgaaaaggaaacagttacctttggaaaacataattaggtaaaatgggtaatatggaaagtctgaaaactgaaaaaattactgataagtcaagagaaaaggaatattagtaggaaaattcataaaagtgtgtctgactactcacagcaggtttccttattggtatgtattctgtggtccatctaagctatgttaattttattttaaatgctacctgggtattggcttctaaaaggaattcagtaaatcagataatttggcatcttcaatctagattctgatgctcacctgaaaagtctgctaaggattggaaaccaagaaaagtgaagtatctcaacagatatgtgtcacttgtgtgtactggattttttttttttttttttttttttttttttttttttgagatggagtttcactcttgttgcccaggctggagtgcaatggcatgctctcggctcactgcaacctccgcctcccaggttcaagtgattctcctgcctcagcctccctagtagctaggattacaggcatgtgccaccacgcccagctaattttgtatttttagtagagacggggtttctccatgttggtcaggctagtcttgaactcccaacctcaggtgatcttccctccttggcctcccaaagtgctgggattacaggcatgagtcactgcgcccggtcgcgtactggatttatattgtgtaatactttgctctagcagtatagtaggtgagacagtgactgtgtctagtgagcaaaaggcacttatttgacacttttgactcttcctttctacttaccttatttaaaattgatttttgcatgtggcatgatgcaccagttcattgaggtaggggttgaagttatttcccatttttttcaataccatttattaaaaatattttcctctttctgttgaatttgcttggtgcctttgttgaaagtcatttcactgatatatgtagttctatttctatattcttgatcatgtttcatttgtctattcttttactaatagcacactgtctcaattattgtagctttatagtaagtcttgctacaaagtcttactacaggacaaagcttgtaggatttttgaatgggatggcattgcatctatacctttatcagggaaagagggaaggagggaggaggatcatcttaacaatattgacacttcaaatccatgaacatggtatatatttccatttaattaggtctttaatttctctcagctatgttgtatagttttcagtgtagagaggtcatgtatatttctcattaaattgtccctacatatttgatgttttctaatgttattgtaaatagtatttttaaaattgtatcttctaattgttcatttctagtttacagaaaaatgaaaaactatgtttttatgtattctatatgcttttgaaaagtaagaggtgcaaagtgctctattcttacactatattgtgtgagaatataagtcgaaaccactctgcataagttcaggcttccattctcttcagtttgtaggttgagagaacccatccagaaacagtaaacattggtgtctgcccaagtctggtcctgggtggttcattcattcatttacataacaaatatttattaactgtctgctatatgcaaggcactgacctatggactaaggatgcagcaatgaacaaggcatatatgattcctgagttaatgggccctattctaatacatgatattttacaggtctgataaaagccaacaaggagaaatacaaaagcactaagagaaagcttatagtagggaagcttcgcctaatctgaaggtcaaggaaggctttctttttttcggaaagtgatatttagagagatgaatagattaataggatgagtagaagttatctaggtaacaaggaaagtaaaaaagaaattgtcaggcagaggaaatagcatgtgtaaagatctttttaaaaaataaaaggtgtgactcaagcaatttaaaagggctagggaggctagaaacagaaaataaatagatgaaactaataaggcagggagagccttgtaaatcacacttaaaattctggattttgttctaaatacccttgtacttaggagctattaaaatattttaaacaaggcagtgacaagatatttgaattattaagcttactctggctgctatatggagaattgatttatgagggttataaatagaaataggaagataagataggagactatggcaatattcctggtaagaaatggaagaagagctggcttggattaaaggggaggcagtggatgtagaaataaatggatgaattatagatatatttaggaaatgggttcaataagacttaataatggaataggtggaatataaatttcatgagggcagggggtgttttgtttattattatattcctaggtgtctgaaaatattgttgtgttgcctggcaagtggtagatcttcagtgaaatattattaactgaataaatacaatggataaatggggagcagggattaagagtgattcctgggtttccacattaaggaactggatggacaaagctaccatttgatgagaatggaagactaaagaatgatagatttaagagaaatcgagttgagttccagccatgttcatttgaaggatctgagaaacagtgcagatattcagtgtgtgattagacatatggtcatcattcttttttttttttgagatggagtctcgctctgtcacccaggctggagtgcagtggccctatctctgctcactgcaatctctgcctcccaggttcaagtgattcttctgcctcagcctcctgagtagctgggactacaggcgtgcaccaccacgcctggctaatttttgtatttttagtacaagacagcatttcaccatattggccaggctggtctcgaactctgatctgcccgcctcggcctcccaaagtgtggggattacaggcgtgagccaccgcgcccagccggttaccattcttttactctgagttcttccattgtgatcatctagtcagatgggtagatccttataaggctgagcataataagcttcctgatagctctacactggtatgttttggggttcatggctgagctacttttgtgttttatttatcttcctgatctctttttcactgtaagaaacatccagcacccagggaaatttgctgtctaattcatactccactcttcagactagtcctagtgttcagttttgttttgttttttttctgtgtctggaattctattaaaatgtgtcaggctgttttaatttttgttgtttaattttctttcacatgattatatgtgctccatggatttttttgtttgtttgttttttgtttttgtttttgtttaagcggggtcttgctcttgtcgcccaggctggagtgcaatggcttgatctcggctcactgcaacctccgcctcccgggttcaagtgattcttctgtctcagcctcccaagtagctgggactacaggcacatgccaccacacccggctaatttttgtatttttagtagagacgggtttcatcatattggtcaggctggtctcaaactcctgaccctggtgatctgcccacctcggcctcccaaagtgctgggattacaggcgtgagccaccgcacccggaggaaatttttaacctcagtttttcttcaccatctgtaaaactgcatagaaggaatgtttaggataaaagatgcataacaatcataacaaaattgttgggttttaatgttatgagtacacttggaggattctatgtccacacataccttaaacatcctatagagtccttagcattttaaagttgaaaccaacagtatgaatgatggtagaattttcccccccaggaagttagaactgttccatatcttgatagagggatgggttataaggatgtacacattttccaaaactcattgaacttaagagtcttgcatgtgactgtatataaattatactttaattgaaaataaatttaagaaaataaaattggctgggcgtggtggctcacgcctgtaatcccagtgctttgggaggccgaggtgggtgaatcatctgaggtcaggagttcgagaccagcctggccaacatggtgaaactctgtctccactaaaaatacaaaaattagctgggcatggtggcggacacctataatcccagctactcgggaggctgaggcatgagaatcgcttgaacccaggaggtggaggttgcagtgagccaagatcatgccattgctctccagcctgggcaacatgaacgaaatgccatcttaaaaaaaaaaaattaaaagaaaagaaaattagcctcccccaccctcactatacctcagactcacccctgaaagatcactactattcatccctggttatgtacacttacaaacattttctgtgtgtatgcgaatgtatgtgtggggttttctttgcacaacaggatcattttacagtatatatactgttgtgcaacttgctctttccacttaatatctcaaggaatcttttctttgaatctttatagccatgtacctcaatcttagtagttttctttattttatttttgaataggaaatacatttacatggttttaaaaatcaaaacaatatactatgtatatattgagaagtctgacttccatccctatcctactcctattccacccttgcttcctcctgtcccctgtaggtaaacattttataactttattaagcatcctgtcagcatttcttatgcaaatatgtacatatatttttatttccccattttttttacaaaaagataaaatactatacaccactttatatcttcctttcttcacattatatcctttaaaaatatttccatattggccgggcgcggtggctcacgcctgtaatcgcagcactttgggaggccgaggcgggaggatcacgaggtcaggagatcgagaccatcctggctaacacggtgaaaccccgtctgtactaaaaatacaaaaaaaaaaattagccaggcgtgatggcgggcgcctgtagtcccagctactctggaggctgaggcaggagaatggcgtgaacctgggaggcggagcttgcagtgagccgagatcgtgccactgcactccagcctgggcgacagagcaagactgcaactcaaaaaaacaaacaaacaaacaaaaaagaacttccatattaatatatagaaagctgttttttttaacagttgcttagcattcctttggattattaaccagtctcataaatgagcgctattgaatagccctgtacctacatcagtttttacatatgcagtatatctttgggatgaattcccagaaatggaattgaaattgctgggtcaaagaggaaataggtgtaattttcttaggtattttcacaagaagtgttaattctaactttctgttttgaaatgatttcaaattttcaaaggagttgcaagaattgtacaaagaactgtatctccttcacccggatgcaccgggtgaattatatgtattatataattgtatctgtaggccaggtgcagtggctcactcctgtaatcccagcactttgggaggctgaggcaggtggattacttgaggccaggagttcaagaccagcctggccaacatgataaaactccatctctactaaaaatacaaaaattagccaggcctggtaccccatgcctaagggtgaggcatgagaaatgcttgaacctgggaggcggaggttgcagtgagccgagatcgcaccactgcactccagcctgggcgacagagcaagactctgtctcaaaaaaaaaaaaaaaaaaagtaaaaaagttttttaaaaagatgtatctatatatacatatttacatacacacccaagtgtgtatgtatatatgtttgtgtgtatgtacacaaacacattatttttatatgatatgatttttttatgacatgattatttttatgacatttgagagtaagttgtagaaattatgtttctttattcctaaatacctcattgtgtatttcctaacaaggacattcttttatataattaaattttaataataaaaatcagaaaatttaacatcaatgcaatataattatttagcctatagtccatatttaaattctaccataccttatagtatattttactatacctcatagtaattttttttagtccaaaatatcacacattgcatttagttgccatgtctctttttttttttttttttttgagacagggtctcactctttcgcccaggctggaatgcagtggtatgatcttggctcactgcaacctccgcctcccaggttcaaatgattctcctgccttagcctcctgagtagctgggactacaggcatgtgccaccacactcccaccacacccagctaatttttgtatttttagtagagacaaggtttcactatgttggccaggctagtcttgaactcctgacctcaagtgatctgcccacctcagctaagtgctgggattacaggcgtgagccaccatgtgtggcctagttgccatgtctctttaatctactttaatctgaaacagttcctcagccttgtttgtttatatgaaactgacatttgtaaagactagaagccatttgtcttgtataatgcctttaatttatatttgttttatgtttcctcgtgattttatatatagagtttgtttgtttgtttgtctgtttgtttgttttgagatggagtctcattcttgtcacccaggctggaatgcagtggcgcagtctcggctcactgcaacttctgcctcccaggttcaagcaattctcctgcctcagcctcctgagtagctgggattacagatgcctgccaccatgcctggctaatttttgtacttttagtagaaacggggttttgccatgttgcccaggatggtctccaactcctgacctcaggtgatccgcccgccttggcctcccaaagtgccgggattacaggcatgagccaccgtgcccggacctcatgattgtatttatttatttatttaatattattattattatttttttttttttgagatggggtcttgctctgtcacccaggctggtgtgcagtggtgcgatatcggctcactgcaaccgctgcctcccagattcaagcaattctcctacctcagcctcccaagtagctgggattacaggcatgtgccaccacacccggctaatttttttgtattttttttagtagagacgaggtttcaccatattggccaggctggtctcgaactcctgaccttgtgatccacccaccttgacctcccaaagtgttgggattacaggcgtgagccaccacacccagccttatgattgtatttagactagacatttttttggtagtatattatttagccattgctgtgtaacaaattatcccaaaacttagtggcttaaaagaagcatttattatctcataaattttgtggatcaggactgggtatagctttgctgagtgcctctgcctcaaagtcttacaaggcagcaattaaagtgtcacctaaggctattgtcttatctgaagggtcaacagaggatggatccgcttctaatctctctcacatagttaatggcaaaattaagttccttgtggattgttagactaagggttccagttccttgctggttgttagcttgaggtctacctcagttccttgccatgtggacctccatagggcaaccagcttctgttagagcaagtaaaggagagtgccagagagggcaaatgtgatgaaagccacaatctttttataaacctaattttgaaagtgacatacaaggctaggcatggtggctcaaacctgtaattccagcactctgagaggccaaggagggtggactgcttgagcccaggagttcaagaccagcctgggtaacatgacaaaaccctgcctctactaaaaatacaaaaattagctggtctggtggtgcatgcctatagtcccagctactcaggaggctgaggccagagaattgcttgaacccaggaggcggaggttacagtgagccgagatcacaccactccactccagcctaggccacagaatgaaaccctgtcaagaaagaaaggaaggaacaagggagggagggaggaaggaagggaggtagggaggcagggaaagaccgagaaagtgacataccatcatttttgctgtagtttgttcattagaagcaaaatcacttggtccagcccacactctggggagatgattttctaactccatttgtaataacttattctacttttattagttggcattatacagtaagaaagagctttcttttctcttcttatttattcatatatggctcatgtgttttttccaatgagttatattctattactaacattttttattttgacctcaaattgttttagatgttaccaataagaacctcttcaagctggttcttgtgtccttttgccataactctctcattttcttgaaccctttcttactttctgatataagaaaatattagagactcatactttccttgttccagttctgagatgaaccatttatccaaaagccttgcttcattttagtagggaatagtatttagaaactaagatctgggtgtgaggtatgctcactgctaatgggctgtcactgtttctaggccttgtcagcagacggagctaggaaaaacacacataaacacacccatatttatatttgtacacacactccctcaaaatcgtgagttcatattgatacctccagttctggttcttcctagccttccccctttccatctttgtatttttattttccaacagtaagaaccctggctcccagtgctatgaatatatttactcatttgctccatccactgcactccagcctaggccacagaatgaaaccctgtcaagaaagaaaggaaggaatgagggagggagggagagaggaagagagagaaggaagaaggaagggagggagggaaaactgagaaagtaacataccatcatttttgctgtagtttgttcataagaagcaaaatcacttggtccagcccacactctggggagatgattttctaactccatttgtaataatttattccacttttattagttggcattatacagtaagaaagagctgctgaagatttgcttgcaattggttgtctttaaactgagggtatattgtcaaagtactgtgctgaaaagttacctgtagtatagttatgtgattcattaaaataaagtttgtttctattatgtgcagttttagagttttgccacactctggttgattagtatattttctgttgcttttttgttttgttttgttttgttttgtttttgagatagggtctcgctatgtcacccaggctggagtccagtggtacaatcacagctcactgcagcctcaacctcgtgcacttaagcgatcctcccacctcagcctcccaaatagctggggctgcaagtgcacaccaccatgactggctaattttttaattatttatttatttatttatttattttagagatggggtctcactatgtttccccaggctgaccctgaactcctggggtcaagtgatcctcctgccttagcctccaagtgctggtattacaggcataagccaccacacctagcctagtattcttttttgaatatgtaaaacattaacataaagtcaaaactattaaaaaaaggtgtactcagaaaattgtcattcctcccctataccttctgcctcattcacaccacactctgtagataatcgatttcattagtttgtggtttatcctcactgtgtttctttttgcaaaacgcaaaaacaaaacctatacatatttatattttcttatgtcctcttctttcttacacaaaaggtaacacactatgtaggtagtcctggctttgaacagtttcactataaaaatatttgttactacagcttaaataacataagtctcctaaaaataattcaaattttagttaccatggtatattaactttgagtagttccataaaggacaaacttggctgctagcccttcagtccacagagcactttgaaaataacagatgagcaaaataatgtggccaatcacatgacttctttcaaagtatgtcagtgatcagtcactgtgtgcctataatttagttcatgcacagacagcaaagcatgtagttgtgttgccttccagtgataaacccacataacattttagaaaaatgtattaagaattggccagcaaagataaaagtgcagcaaagaaacaaaagtgataatgttttcagtgaaatttgaattgaacataaatggagttatagaagaaatagctgaccatgggaatgttcacactgctactttcaagaatctctagaagggcagctaaaggagcttagtgaaggtgaatttattgacatgaatgagaaaagtaattgtgatgaaaaggatgaagatgtcccagagaaagtaatgccagcaaaaacttcacattaaaggaactctcagatatttcaaagcattgaaacctccaagaataaataaaatgttggaagttgatccaaacttagaaaggagtatggcaacttgtcaagatgaagaaaaggtgcttattcctttttatttatttatttagagacagagtttcactcttgttgcccaggctggagtgcaatggcatgatctcagctcaccgcaacctccacctcctggattcaggcagttctcctgcctcagcctcccaagtagctgagattacaggcatgtgccaccacgcccggctaattttgtatttttagtagagacagggtttctccatgttggtcaggctggtctcgaacccccaacctcaggtgatctgcccacctcggcctcccaaaacactgggattacaggcatgagccaccatgctccacctgcttattccatattatatgttataggatgaaaagaggccaaactaatcttgacatgttttttacaaggaaataatcctccatggttctaatttttttttttttttttttttttttttttgagacagagtcgcgctctgtcacccaggctggagtgcagtggcacgatcttggctcactgctagcaccgcctcccgggttcacgccattctcctgcctcagcctcccgagtagctgggactacaggcgccggccaccacgcctggctaattttttaaaaaatatttttagtagagacggggtttcaccgtgttagccaggatggtctcgatctcctgacctcgtgatccgcccgcctcggcctcccaaagtgctgggattacaggcttgagccactgcgcccggtgggtctaatgttttaaattacactgtgttaaataaatattagtttgttggttttttttttagtttttttatttctctacaaatttacaaccaataagagtttttaatgctttgacaaaaaatgttaaaggtcatagtacaatcgcatttcttcccattgattattaacatcactttacatagtttcatcttgcattagcaattttgtgtgtgtgtttgtggttttaaggagcggagagtttaataggcaagaaggaagggagaagacagaaggaaggagctcccccttacagagacagagggagcggggctccaaaagaggaggtccccatctaccgcggataccagccaggtatatatgcagaggctggtggaggtgatgtctgatttgcatagggctcaggggattggtttgaccaggcatatcattcacgtagcccgagaaaaagctggccctcccaccccagccttttaatatgcaaacgtagggcgccatggatgttctaaacacgtggagatatgtggggggcagccatgtggccaggaacttgtggggcaagggcaagaaggctgtgggaatcgccaagttgaatggacctagtttctaatggcctgcatttgcatatcaaaggttgctggcctggctcctagagccggggctttaaaagaaacttttccggagatgctttaaaaaatgaaaacttcccaaggaccccttttcctgtctatctgcataaaataatttcttttattatttatttatttatttatttatttatttatttatttatttatttatttattttgagacggagtctcgctctgtcgcccaggctggagtgcagtggcgcgatctcagctcactgcaagctccgcctctcgggttcatgccattctcctgcctcagcctcccgagtagctgggactacaggcgcccaccaccacgtccggctaattttttgtattttcagtagagacgggatttcaccgtgttagccaggatggtctccatctcctgacctcctgatccgcccgcctcggcctcctaaagtgctgggattacagaataatttcttaataactcctaccacattcctccctgtggcgatatcaaactaactgctgttaggaggctttgggcgaccattgcttctggctacttcctgctgaaaaggggcgtctaatggagaacagcagctagggctcctcctggggttgatctaagggtcctcggaagaatggcgtccatgtgtggttcagtttacagcaccgtttggagtttgattgcttctaggcgagaagaaacaattcaagttatagtattgagtatacagagtccaaatatcaatacaagacatataagcaagagagtgcttaataaaggggttaaccaattccataaagaagactggaagtaattaaagagggattgtagccactcggggctgaagcccacattttccctgagcctgtcaataattttgatttgatttttaagtccctgtagatttgcctcttctttactacaggtgttaatcccaaagaagcatgtttcatttaaaaatgcattactggccaggcgtggtggctcgcgcctgtaatcccagcactttgggaggctgaggcgggagcatcatgaggtcaggagtttgagaccagcctggcctacatggcaaaaccccatctctactaaaaatacaaaaaattagccatcgtggtagtgggcgcctgtaatcccagctaattgggaggctgaggcaggagaatcgcttgaacccgggaggcagaggttgcagtgagccgagatcgcaccactgcactccagcctgggcaacagagcaaaactccatctcaaaacaaaacaaacaaacaaacaaacaaaaactgcattactaaatccaataaaaagtcctagtagactcagtgatagtaaaactttcatgcttcctttttgccagtaactattatccctgctataaggatactaattaagcaaaatacgacagcaatggaaactctgtccaatatttcagttagaaggtgctaccatggataaccctattgcaaatagtagagtgaggaaagcagttcccacaaatgtggtgtggtaggtaatttccatctaaaattttacttgccaacatatagaattcccctctgtgggcctacgaagttccttggttttattttcccaaacaaagaaacctccgggttacaggtaccttacttactttcattacctggcacaatttgcaaaataattgcccagaactagcatattgattcacattttcacattacccatccctttttcccccccaccaagctgcagaagatcaccacttgattcacaggaataagcagggccagggttagtctaaaatgtaggcaaaaagcttaaaaacaattaatgagactagggtttaatgacaaatgtatgataagctttggagcaaaatttttctctccagtcctcatttttggtaaaaactaattatgaatgaactttaatcttatacttggcctgattatttgcatgaagtgcagcaagaatggttatttctacataggacttttggattggctttgatgaaacactgttccacaaggaatttcagattagacttttaaagctgagcccagacatgggtttgtatcctctaatacctgtgagttgggttatcctctcctcttgaggtcccaagataaactcagagcttccagacctgttagaaagtgacattcttcactgaccacaggttaggaaccctgtgtggggactgtgtagacaaggtgtgaggccagttctccccaaggggcttttattggctctgcatgtcaagcttgattccttaaagggaaacacaccctttcagttaaagccttggcaaaataaccggtttttccaattgtgttctgttgacaaagaaaaatggattcttgctgcactgatgcgaacaactatattgccgtaagttaagagtacttacagatagtctccaaattttagaggaaccaggcagagaaaaatgaacatgctccaaattttgttcacagtagtataccttacttgattattaaaggccataaatagtttaaaataagtttcctttcccagtccatgcaccaaaatgatacggctctgatgagtggaggaacaacagggttcctggtcctcatgctggtttagataaaatgacacagacacatgtggagtggttttaaggagtggagagtttaataagcaagaaggaagggagaagagagaaggaagacgctcccccttgcagagacggagcgggggttccaaagctgaaagaggaggtcccccacattaacaatttttaaaataccgtacaactgcagaaaatgaggactgcctgtacatactgtttgacactttgtttttttttttaacttatcaactttattttgtttgtttgttttggttttgggtttttgtttgtttgtttgttttggagacgagtctcactctgtcagccaggctggagtgcagtggcacaatcccagctcactgcaacctccacctctcgggttcaagcaattctactgcctcagcctcccgagtagctgggattacaggtattcgccaccacatccagctattggttttggtttttgagacagggtcttgctgtgtcacacaggctggagtgcagtggtgtgatctcagctcactgcaacctctgcctcccaggctcaagtgatcctcccacctcagccttccaagtagctgggactacaggcatgcacaccatgcgcagctaattttttctattttttgtggagacggggtctcactatgttgcttaggttggtcacaaattcacagcctcaagcagtcctcctgcctcaccctcccaaagtgctgggattacaggcatgagccaccacatccagccttaccagctatattgaagtataatttatataacataaaatttgccttttaaaattatacagtgcaatgcattttgacaattgtttacatctgtgtaaccaccatgcaatcaaaatatagaacatttctataaccttcaaaagttccctcatgcccctttgcaatcaattcactacttctccagctccaggcaacaactggtctgcttcctgtcactataaattagtgttgcctctttcagaatttcatctaaatggaatcctataacatatactattttgtatccatcttcttttactccaaagttcttgaaattcattcatgttcctgtgtgtatcagcagcgtgttccatttgattgttgagcagtattgcattgtgtggatatatcacaatgtgttcattcattcaactgttggtggacatttgagttgtgtccagtttagtgctattctgaattaaagtgatgtgaacaatcatgtacaagtatttttgtaggcatattttttttatttctcttggataaataccccaaaacagaattgttttgggggtcatatgaaatgggaagtatatgcttaactttataagaagctgccaaactatttttcaaaatggtaatatcactttacattttcatgagcaatgcataaagcgttccgcttgctacattttctcaccaatgcttcctattgtcaattttttaaattttagcaattctagtgggtgtgtgatactatctcattgaagtttcaactgtttttccctgttgactagagacactgagcaacttttcatgtgttgtctatttgtatatcttcttgaagcattcgttcatctttaactgagctgaacgccttcttaaaattgagctatgggagttttaaaatatatccttgtagctgggcgtgatggcaggtgcctgtaatcccagctactcaggaggctgagacaggagaatcgcttgaacccaggaggcggaggttgcagtgagccgagactgcaccactgcactccagcctgggcaacagagtgagacttcatctaaaaaataataattatacatgtaattatatatgatttttatatatgtaatatatatattcttgatgtgagctctttgtcacatacatattttgtggatattttatcccagactatgacttgtcttttcattttcttagttgtgtcttttgaagagcagaagatgtaattttgataaagcccaatttattttttcttttatagtttgtatttcttatgtcctattcaaaaactccttgcctactgaaaacttatgatgattttctcctatattttcttttagaagttttatagttttaccatttataatttggtctatgaatccttttgagttgatgtttatgtatggtgtatggtgtgaggtaacaatgaagattcatatttttttccaaaggaatatccaattgtctctttggaaaaatatgctgagaaggctatcttttccccaccaaataatcttagcaccttaatcaaaaatcatttggccatggacatatgtaggtgtgggttttttctgggctctctgtgttagatggatagatagacagatacagatatataactgtgtttacacatatgtaactgtaaacacagttatatatctatatatccaccaacagttgaatgagaataaactattgttataagcatatatacacattgtatatatatgtgtacatatacatattgcatatgtatgtatacatatatacacacaaagtatatatatgtatgtatacatatatacacacttaaagtaatggcctccagttcgatccaagttgctgcaaaggacattatttcatgccttttcgtggctgagtaatattccatggtgtatatatatatatgtgtgtgtgtatatatatgtattatgtatatatatatgtgtgtgtgtgtgtgtgtgtatatatatatatgtgtatatatatataccacattttctttatccactcattagtcgatggggacttaggttggtttcacatttttgcaattgtgaattgtgctgctataaacatatgtgtccaagtgtctttttcatataattacttattttcctttgggtagatacccaatagtgggattgctggattgaatggtagatctgttttttgctctttagagaatctccatactgttttccatagaggttgtactaatttatattcccagcagcaatgtgtaagtgttctcttttccccacatccacaccaacatctattgttttttgactttttaataatggccattcttgcaggaccaaggtggtagctcgttgtggttttaatttgcattttcctgatgattagcgatgttgagcattttttcatatgtttgtgggccatttgtataccttcttttgagaaatggctatttgtgtcctttgcctactttttaatgggattgtgttttatttttcttggtgatttgttagttccttgtagattctggatactagtcctttgtcagatgtgtactttgcaaagataatattttggatgttatatttccattataatttagttcaaagtattttctaatacaccttgcaatttcttctttgacccatggattattttaaagtttgttattttgtttgtttattttgagacagagtttcactttttttgcccaggctggagtgcagtggcacaatcccggctcccagattcaagcgattctcctgcctcagcctcccaagtagctgggattacaggtgcccaccaccacacccagctaatttttttttcttttttttttgagacagagttttgctcttgttgcccaggctggagtgcaatggcacgatctcggctcactgcaacctctgcctcctgggttccagcaattctcctgcctcaacctcctgagtagctgggattccaggcatatgccaccacgccaggctaattttgtatttttaatagagacggggtttcttcatgttggtcaggcgggtcttgaactcccgacctcaggtgatctgcccgccttggcctcccaaaatgctgggattacaggcatgagccactgcacccagtccaattttttgtatttttagtagagatggggtttcatcatgttggccaggctggtcttgaactcctgacctcaggtgatccgcctgcctcggcctcccaaagtgcagggattacaggtatgagccaccatgaccagcctaaagtgtattgtttagtcaccaaatatgtaagtattacccaaatatatttgtcactgatttctaatttaattgtattgtgatccaaaaatatacattgtatagtttctattcttttaaattcgttaacatttcttttatggcacagaatatggtctatcttggtgagtgttgcttacacacaactgtgtaactgaaaactgtgtattctgcttctcgtggttgttgtatcctataattgtcaactagatcaagttagtaagagtgttgttcagtgatcttttcttcttcagtgtttactgtatttgctaatcccatccagtgaagtttccatttcatatattgtatttttcacttttagaagttccatttgactctttcatttccatcctcaattatcttcatatttttctttaaatttttgagcacatttataatggaggttttaaagtccttgtctgctaattttgtcacctctgtaattcctatgatgattttcttcctggcttggggtcataatttgttgcttatttgcatgtctaataatgtttttattggacagcagacattgtaaatgttatatttttgagtgtttggattttgtctttctttaagaactattgcagtttgttttggaaggctattatgttttttgcagatcaggttgatcttttcaaggcttgtttttaagctttgttaggacaggtctgtagtaacttttgccttgggctaatttagacctaccacttaattctgacttttttgattaatctgagtgttcagcagggtctctttattatggctaaatgaaattcaaacattttccagccctatgtgaccatcaagaattcagctaatagctccctggcagttcttcgcccagctgcagaaaagtgtcagtgcactctatgtatgctcagattattatttagccaaagacttggggatccatattaatattcctggagttctttgtgtagctccattctctttagtactctatcccataaattctggctgcctcaatctcctaatctccccaaactctaatatctattcctcaactcagcaaaaccatggtgttattcttggatttcccctttcctgccccacagtctgaaagttgtctccaggcaaaaaaaatggagatcctagtttgcggatcctcatttccttctccttttttttttttttttttttttttttttgagatggagtctcgctctgtcacccaggctggagtgacgtggcgtgatctcggcttactagaaactccggctcccgggttcatgccattctcctgcctcagcctcccgagtagctgggactacaggtgcctgccaccatgcccggctaattttttgtattttgtttagtagagacggggtttcaccgtgttagccaggatggtctggatgacctcgtgatctgctcacctcggcctccaaaagtgctgggattacaggcatgagccaccgcgcccggcctgcttctcttctcttatgggttagaatcctgcactgtcttttgaacaaatgtctaaaagcttttatcacacattttgatccacttcccagttgttatagtggtatatctggtttcacatgactgaaaggaaaagttttcaccttgctttttgtactaataatatatcctggaaatcattctatataaatttatagaaatcttcatttttaaaatagcttcataaaactccattgtaaaaaccaggtgcagtggctcatgcttgtaatcccacactttgggaggccaaggcgggtggatcacctgaggtcaggagttcaaggccagcctggccaacatggtgaaactccgtctctactaaaaatacaaaaattagctgggtgtggtggtgggcgcctgtagtcccagctacttggaaggctgaggcaggagaattgcttgatttcaggaggcggagattgcagtgagctgagattgcgccactgcactccagcctgggctacagagcgagactccgtctaaaaaaaaaaaaaagcaaaaaaaaaaactccattgtatgtgcacatatcattatctgttcaacccatctatgacttgtcatttaggtagtttccatccaatatttttgcaatataaaaaatgctaatgaagaacctgagatatatatatatctatatatatagatatatatgtttgttgttgttgttgttatttttgaagtatgtacgtataataaattcctaatagtgtgattgctgcatcataaggtaaaggcatatgtagttttgttaaatatagctattccccatcttgcattcctacaaatagatgagaatgtccattgtcccatagtctcctttgcagagtatattgtcaagctttttaattgttgccaacctgatgggtaaaaagatatctccaaataattttaattaaaatttctcttattatgaatgaggttaaatagtttttcatatgtttaaaagccagtttatatctttttgtttttttagagacaggaatcttgttctgttgcccaggccaaattgcagtgatgcagtcatagctcactgtagcctcgcactcctgggctcaagcaatcctcctaccttagcctcccaagtagctaggactacagatggatgccaccatgtccagctaatttttttatttttttgtagagatgtgaggtctcactatgttgcccaggcttgtcttgaactactggcttcaagtgatcctcccacctcagcctcccaaagtgctaagattacagccatgaaccaccacaaatgaccctatatatttttttgaattgtctgttcatgtcttattttcatttttctagtagttttttttttaagtgttttagcctaaatttgtaaaaagtttaggggatatatgaagggactctaaatgtttatgaagaaatttaattaaaagataaaaataaaaatataagctttatttttcaacatgagctccatcaagttcaaggcacttttgtaagcaatgatactagccatttagttcacccctaaagaactgagagtcctgggaatttagccatgtcaatgcagtattttttatattggttactgaagaaaaaatgggtgccctttaaagttgtaagattaggaacaaaaacaagtcagaagaagccaaatcagcactgaaaggtgggcacttaatgattacccaagaaaactctcaccaaattgcccttgcttcatgagaggaatgagcgggagcattgtcgtggtcaggaaggattctggggaagttttcccaggcattttttctgctgaagctttggtaactttctcaaaacactctcataataatcagatcttatcactctttggccctccaggaagtcaaccagcaaaatgctttgaacatcccaaaaaagcgcttgccatgacatttgctcttgaccagtctgcttttgcattggtcaaatgccaccacttccacctcttgtgctttgttttcaggatcagactggtaaagtcatgtttcatctcttgttacagtttttttttttttaagaaacccttcaggatcttgatcacatttgtttaaaatttcaactgaggctgggcccagtggctcatgcctgtaatcccagcactttgggaggccgaggcgggcaaatcacgaggtcaggatttcgagtccatcctggctaacatggtgaaaccccatctctactaaaaatacaaaaaattagccgggcatggtggcaggcacctgtagtcccagctactcgggagggtgaggcaggagaacggcatgaacccaggagacggagcttgcagtgagctgatatcatgccactgcactccagcctgggcaacagagtgagactccagctcaaaaaaaaaatcaagtgaaaactctggtcttaaactgcagctgatctattttatttttattttttttcagacacagccttgctctgttacccaggctggagtgcagtggcaccatcatggctcaatgcagccttggcctcgtgagctcaagcaatcttcccacctcaggctcccaagtagctgggactacaggcacatgctaccatgcctggataatttttttgcagctaatctagatgtaatggttttggcacccatctaatggaaagtttgctcaactttaatttttcagtcagaattgtgtaagctgaaccgagatgtctatggtgttggctattgtttctgctgttaattgtaggtcttctttaattagagcacagacaagatcattttttttcctcccaaattgatgtagatggtcttttgctgtgggcttcatcttcaacattgtctcatcccttcttaaaacaagctagctacttgtaaactgccgttttctttggagcattgtctccataaacttttcacaaaacatcagtgatttcaccgttcttccactcaagcttcatcataaatttgatgtctgttcttgtttccattttagcagaattcatgttactctgataggggctcttttcaaactgttatcttattcttcttagtgcctcaaactagatcctattcagacatggtataacaagttagtatgggtttattttggtgcaagaaatattttgaaatccacacatttttttcataatatgcattttccatgaagtttttgaaaactccttgtattaggaatattagtcctttgtccagtaaacagactgcaaatattttctcacagctcatcatttaccttttggcatttttttgcaatgcaatttttttccctttgtttttgttttttgtgtaatgaatcaatgttttcttttttttttttttttagaccaagtctcactctgtcacacaggctggagtacaatggtgcaatctcagctcactgcaacctctgcctcccaggttcaagtgattctcatctctcagcctcccaagtagctgggattacaggcacatgccaccatgcctggctaatttttgtatttttagtagagatggggtttcaccatgttggccaggctggtctcgaactcttgacctcaagtgatccactcacctcggcctcccacagtgctgggattagagacgtaagccactgcccccggccaaatcaacgttttcttatattgcatttaggttttaagtcatagttagaaagcctttccccacacctaggttatagaaacattcattacttttttcttccagtgctagtacttgcatggtttttggtttccacatttagatccctgatctaattggagtttattcttttgtgtgctgagatatggatctgattatatcttttttcccaaatggctatccagttgtcccaatgccatttattaagcacttcatctttgtcccagtgatttgagatagcatctttatcatgtaccaaacttctatagtgccagaagatttttattttttttagacagggtctggctctgttgcccaggctggagtgtagtggcacaatcccagctcgctgcaacctccgcctcacatgctcaagtgcccgcacctcagcctctcaagtagctgggactacaggcacatgccaccacaccaggctgatttttatatttttttgtagaatgagatttcaccatgttgcccaggctggtctcaaactcctgagctcaagaaatccgcccacctcagcctcccaaaatgctaggattacaagcatgagccaccacacccggctgccagaaaattttaatgatcagaaaaccacaattctttcttcctctgttatatgttgaagtaaaatacttcatttagaaaactaagccgggcacagtggctcacacctgtaatcccagcactttgggaggttgaggcaggcagatcacctgaggttaggagtttgagaccagcctggccaacatggtgaaaccctgtctctgctaaaaatagaaaaatttgctgggcatggtggcgggtgcctgtaattccagctacttgggaggatgaggtaggagaattgcctgaacctgggaggcagaggttgtggtgagccgagaccacgccattgcaccccagcctgggcaacaagagcaacggtaaactccatctcaaaaaaaaaaaaaaaaaaagaaagaaaaaagaaataactcagccatacaaggctacccatttggtgagaactaataataagttagatagcaaggtaatagcaaaatgtgggtgcaaaattaaagcaagttatttctgaggagaatgtaggtctcatggaagattttcatgtggacaaatttagtaaattttttgcaggtagtttcctgacatatttaacatttgtgatatagtaaacaataagaaggtactaaaggctgggcgcggtggctcacgcctgtaatcccagcactttgggaggccgaggtgggcggatcacaaggtcaggagatcaagaccatcctggctaacacggtgaaaccccgtctctactaaaaatataaaaagttagctgggcgtggtggcgggtgcctgtagtcccagctactcgggaggctgaggcaggagaatggcgtgaacccgggaggcggaacttgcagtgagccaagatcaagccactgcactccagcctgggcaacagagcgagactccatctcaaaaataataataataataataaggtactaatatgatccagactagaagagaatagcactaaaatgggagatggggtaaacctgtggttttttttaccttaggcttttgacttccaaaattattgtttttgctgggtgcggtgggtcactcctgtaatcccagcactttgggaggccaaggtgggaggattgcttgagcctaggagtttgagaccattctaggcaacaaagcaagaacctgtctctaaaaaaatttaaaaattagccagaaatggtggcacatgtctgtagtcccagctacttgggaggctgaggcaagaggattgcttgagccttttgaagttgaggcttcagtgagccatgatcaccccactgcactccagcttgggcaacagagcaagaccccatctcaaaaaataaaacaaaatagactgggcacgatggctcacgcctgtaatcccaccactttgggaggctgaggtggatggatcatgaggtaaagagatcgagaccatcctggccaacatggtgaaaccccgtttctactaaaaatataaaacttagctgggcgtggtggtgcacacctgtagtctcagctactcgggaggctgaggcaggagaatcgcttgaacccgggaggtggaggttgcagtgagccaagattgtgccactgcactccagcctggcgacagagtgagactctgtctctaaataaataaataaataaaacaaaataagtaaaataaaataaatgtttgtagttccaaaatattttgatgacataatttcttcttgttctaataaaactacatatgcattggtcctatgacctagtaatcacactattaggaatttatcataaatacacacctcaaaaattacaaaaatacatatataccagcttatttattacagcgttatttgtaattgcaaaaacattgtagatagaatggaggtcacataaaacttattcttaagattcagaccgggtgcaatggctcacgcctgtaatctcggcactttgggaagccgaggcaggcagaccacccgaggtcaggagtttgagaccagcctggccagcatggtgaaaccccatctgtaccaaaaatacaaaaattagctggtcgtcgtggcacgcctgtaatcccagctactcgggatgctgaggcgcgagaactgtttgaaccccggaggcagagactgtagtgatctgagatcatgccactacattccagtctgagcaacagagcaagacttcgtctcaaaaaaaaagatcatagatcatcttatcaaatcaaagtatgcaaaatattcaagtaaacttcagataaatatgaaggctaaaccattcagcttcttcaccaaacccttgaatgtcccacctgtctaaatggagatacatgtttgtttgatttattggttaactgtttttattccatttttcctcaaatgatcccataatttgaccttaggaagctgttcaaatagacacattaggttgaatggaaagactactcgatgatatttaggattttaagaggattttatgtattttttccttgtgtgcaataatttaatagcatcttgaataggattttctgatattactaaccctctgggaataatattaggtaattagacagttagctaatattaaaatatgtatcaggtaatatttattgagagtttcctctgtgccaagcaggatcaacttcataggcaggcgacctgtgcggggacacagggcttcatgcttagataggcccccttgctttgaaggcccctaccctttggttagggctctgctgttaccatcttgaaattcttaataatttttattttatttttttgagtcagggtcttgctctgtcgccctggctggagtgcagtggactcactacagtcttgaattcctgggctcaagcaatcctcccacttcagccttctgagtagttaggacgacaaacacacgccaccatgctcagataagttttttgtttgtttgtttttttgtttttgtttttgttttttgtagagatgggactgtccctatgttgctcaggctggtctcaaattcctggcctcaagtgatcctcccacctcagcctcccaaagtgctgggactacaggcatgagccactgtgcctggtcaatcatttttattaacaagcccaagccctcttttttttttttttttttttgagacagggtctccctctgttgtccaggctagagtgcagtggtgcgatcttaccttcactgcaacctctgcctcctgggttcaagtgattctcctggctcagcctccctagtagctggaattacaggcacccacccccatgcctggcaatttttttgtatttttagtagagatggggtttcaccatgttggcaaggctggtctcaaactcctgacctcaagtgatccacccaactcggcctcccaaagtgctgggattacaggtatgatccactgcgcccggcctccaagccccctatttttattttgcactgaccctacaagttacgtagctaggcttagttatgtttttagcaaggaaagtgtataatctcatgtaccttttgaaagattactcaggtctctgcatgtgaaatggaatttagggaatgcaagagagggagtaaaaataacagcgaggaagctatgatagcatttaaggttgctttgactcaggggtagcagtagatagggtaagtaattgatagtttcaaaatatattttgggagtagtaagcattggtatggattagtaatatactggatgtggggatgcagaaaaaaatattaaaaattacttctgaaattctggctggaatagaagtgccacttaccaggtaaggaaggttggagacataacatatttgagggtgtggtcaaaagatgagtttgacattatgctatgtcatataaaagacatataaaagactacctattttataattcctttttaataaaatattcagaaaaagcaaaactgtggttgcctgaggctgaagctaggaagattgactacagacaagcatgagggaaattttgggggtgatgagagttttctaaaactggattgtggggttggttgcattactgtataaatttattaaaaatccctgcatcgtataggggcactatattgtatgtagaaagctgtgaaaagattttaaaaatgattgacatgtctgtggttatatcaatgagtactattattattcccattttatacataaagaaaataaaagagaagttaaaaataaaagtttcatggttacatagctactaggtgtaatatccagtattggaatttgaatctttttgacactaagaccttactctcgatcatataatacattcactttctattttaaagttatattatagccgggcgcagtggctcacacctgtaatcccagcactttgggaagccgaggcaggcagatcacgaggttgggagatcgagaccatcctggctaacacggtgaaaccccgtctccactaaaaatagaaaaaattagccaggcgtggtggcacgcacctgtatcccagctactagggaggctgaggcaggagaatcgcttgaacccagaaggcagagcttgcagtgagacgagatcgtgccactgcactccagcctgggtgacagagtgagacaccatctcaagaaaaaaaaaattatattataaatgctgcatctcattggtcagaagctctcttgaaattataaaacaaagaagaaaaaagataaagactgggaaattgtgttgaatcagtatataaatcctgtatactggtccttccatttcccctagaaataagtgatacaggccaggcgctgtggctcacacctgtaatcccagcactttgggaggcggaggctggcagatcacctgaggttgggagttcaagatcagcctgaccaacatggagaaacccccgtctctactaaaaatagaaaattagctgggcatggtggcacatgcctgtattcccagctactcgggaggctgaggcaggagaattgcttgaacccaagaggaggaggttgtggtgagccaagattatgccattgcactccagcctggggaacaagagtgaaactcaaaaaaaaaaaaaaaaagaaagaaaaagaaaaagaaagaaggaaggaaggaaggaaagaaagaaagaagtgatacaacaagttacagcatctttgtttattatccactgtgagttgtattaccacactttacttggctctttggcaaactatattatctcttcagatcactagggctaggaaggcccactggtaacttgaaggagtaaatgtatcttctaaaaaatgcttacttccagggagattggatccacacaagtgaatacatatatagtccttagtgtatgctatgattattttactatgtcagtagcataaagattgctatattaataagcattaagtgcctgctgtgctagacagtgaggatgcaagtggccaccaaaatagcatggtccctgccctcctggagcttctttttttcttcttcagtgggggaagcagatactttgcttatgcaaaaataattataaaatttaaagttgtgccaagttcaatggaaaaaatataaggtgttctgagagagcataacaaaggatcctggttttaactggggcctaatggaagacctctattaggaaataacatttaaactaagaccagacagacctgtagaaattagcaaagcaaagggagggaggaaaaagcagctttcctggcaaaggaacaatttgtgtgaaggccctgagacagggaagggctggggttctgaccaccctccaagtggtgcaatggaatatagtgagagagggagaagacatgagaacttggatactatgcaaaggatttggtattttaattcaagagcagtatgatgctactgaggagcagctggacaattgtgtgatccaattaaaattttaggaagatgaacctcgctattgtggagaatgcatacacaagggttctgttggttcatgaagaggtcttaagaaaactatgagctgggtgcagtagctcaggcctgtagtcccatctacttagaagtctgaggcgggaggatcccttgagcccaaggagctggaagttacagtgagctatgattattccactgtactccagcctggatgacagagcgagatcctgcctcagaaacaaaaaccaaaaaacaaacaacaacaaaaacaacaacaacgaaaatctcagaaaactacaggccttattatcaagaaaatgacaggccttattattgagaaaactacttacatttttaaaagctgattttcaaaaaccagattgtgaattaagtgatgctgaataggggaaaaaaagactgataaaccagtgtatctctgaataacccactagatcagtgcttgtcaaactttaatgtgttttcaaatcaccctgatgttttgttaaaatgtaagtcatgtctcagtaggtctagaggagggcatttctgcatttctaacaagctccccggtgatgcctagaccattggtcctcacactttgagtagcaagtgattgggctatactctttattctaaattctaaatgtattctatcttctaatgcctatcagccctcttgctggtctggctaattatcaaacttgagcatttaaaactgggggttttcagagattaattgaagtgttaaagacatggaaatataggtcacatatggcttttcatctcttccggaaatatcctatatatccttacttcttttctacctacctaacctatgtgcctaccccttcacttatgttcaaggttctattatacttcaaaaggactctatgcaatcaaagtgatgtccaagacaaatatacagaaatagtatgaggctctaacactttacatctaatggagtggtttgcatcattaattgaggcttactctgtgccaggcactttacctgccttcttcatttaataggataggagcaggaactcttagaggttcatttcttgttcaaggatatacatctcatctctggcttatatcacagtggactcttttattcactatcctaatcattataattttgtttggtgacaacaattctaaatgcagaaaagttaaggctctttattctgtgactaaaggctttgtattttctaaagatttgtggagctttgctgccattatttcaataattttataaagatcctaggtggtaaataggcctggctttttttctttttgaaatcttctccgtcttcttcttcattagcagtgcaacttcttgtggcatatggtacccaagatcttgggaaaaggattgatcaagtaaagggaaacgatagagagagtgtgctctacaactgagatcatgctccttgtgaaagacagggtagggaaatttcttattgctccctggttcttaagaaatgagagctaacaatgacatccagttttaaaagaaataaaatctgaattgtacttttaaattttataagccagagttaaaccaatagattgtaactcctgctaatttgatagtagctccagataatgaggaagtgacagggaatgctaatttcatttggtaagagataaaactgaaattattaatgtctccacggaaatgctaaatgcctccttacaagtagggtccggctaattgtctgtcttccaacaagccagatttgttggtgtttttccagacaatgttgtgtagttttcggtttggttcgatcccctttcttgtgatcaaagaaagtgattcaaatgtttaatgagtcttgatttggattggagacttgcagaacggctagcctcacagccccaaggctggctttccctaaggtaggtttcctatgcaccgatactggcaaggcgctttggctggaaactctggaaggaagccaaaggaaagtgaagttcctggcgctagcgcgtgtcctgctcagagagcccggcgctagctcattcttcgtgcagttattggctgggactctgtgtgccgctgtcggccaatgaagacgctggagatcgggcccctgcccgtcccctttctgcgccccgggatgaggcagagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattgcaaagtgttggtggaggttgtggatgtgaatgacaacgccccggagatcacagtcacctccgtgtacagcccagtacccgaggatgcccctctggggactgtcatcgctttgctcagtgtgactgacctggatgctggcgagaacgggctggtgacctgcgaagttccaccgggtctccctttcagccttacttcttccctcaagaattacttcactttgaaaaccagtgcagacctggatcgggagactgtgccagaatacaacctcagcatcaccgcccgagacgccggaaccccttccctctcagcccttacaatagtgcgtgttcaagtgtccgacatcaatgacaaccctccacaatcttctcaatcttcctacgacgtttacattgaagaaaacaacctccccggggctccaatactaaacctaagtgtctgggaccccgacgccccgcagaatgctcggctttctttctttctcttggagcaaggagctgaaaccgggctagtgggtcgctatttcacaataaatcgtgacaatggcatagtgtcatccttagtgcccctagactatgaggatcggcgggaatttgaattaacagctcatatcagcgatgggggcaccccggtcctagccaccaacatcagcgtgaacatatttgtcactgatcgcaatgacaatgccccccaggtcctatatcctcggccaggtgggagctcggtggagatgctgcctcgaggtacctcagctggccacctagtgtcacgggtggtaggctgggacgcggatgcagggcacaatgcctggctctcctacagtctcttgggatcccctaaccagagcctttttgccatagggctgcacactggtcaaatcagtactgcccgtccagtccaagacacagattcacccaggcagactctcacggtcttgatcaaagacaatggggagccttcgctctccaccactgctaccctcactgtgtcagtaaccgaggactctcctgaagcccgagccgagttcccctctggctctgccccccgggagcagaaaaaaaatctcaccttttatctacttctttctctaatcctggtttctgtggggtttgtggtcacagtgttcggagtaatcatattcaaagtttacaagtggaagcagtctagagacctataccgagccccggtgagctcactgtaccgaacaccagggccctccttgcacgcggacgccgtgcggggaggcctgatgtcgccgcacctttaccatcaggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacaggtaaggtttagcaagtcatgcttgaccctgttagtgcttttttattcctacatcatattgaggaaggaatggagctgtttttttagtgatgaagatgttttcctggtgatgcattcacactttcaactggcccttcctagatcaaagttagtgcctttgtgagatggtggcctgccagagtgtggtttgtggtcccatttcagggggaagatacttgactcatctgtggacctaattcacatcctcagcactcttttgctatcacaactaaccaatcttgctaagggatggttaagctaaaacacaagatctcagcgatcagagtttagcttggtatcatttacattaggaataagctgctggatacctctaaccagtggcagcttctaggaatacaaaaactacctcattcctccacctttcaagtgattgtgacatttgtattaaaactaatagctttttgataattttcctttgtttatacagatcgtgtacctcattctcagataattttttatgaatgaaatgaaattccaggcatcctttaaattttatttcaagcattctactggaaatgatgtgcaccctgcttacaaaatatttttaccttataacagtaatgcatgtttgctagaaaattcagaaaatacagaaaagtatttaaaaaattaaaactataatctccaaacccaaagataaccatttttaattataaaagtaataatttatttcaaaaataaatctaggcaacccaagaaaacataaagtagccagactcagtggtgtgcacctgtagttcttgctgctcagtgcctgaggtgggaggattgcttgagcccaggagttctgggctgtggtgcactatgctgatcaattgatcaatccactgtctgcactaagttcagcatgaatacagtgacctcttgggagggcaggaccatcaggttgcctaaagaggggtgaactggcccaggttggaagtggagaaggtcaaaactgctgtgctatccagtagtgggatgacatctgtgaatagccactgcactccagcctaggcaatatagggaaaccatgtctctttaacaataacaacaacaacaacaacaatcccagaaactacaaaaggagagtctttttggtgcctccagtgttagtccctgtccttccagccttatttttcttaagtatatgcacaatgtgaaaggtagataaattcatatccttagacaggtaaagcattcattaattcagggtggtatgcaaggatactatccaaggcatggtatccatgcaaggtgactgcaaggcctttgccctggagagaaccctatacatactctcaactgtaggagaaacactgttattttgttactcagtgcatcattgctatcaactcttggatttggcagttagtcaaatgaggttctaccatttaccaactaggagtctgtggccaagttactcaatctcctttctaagcctcttcctcatatgcaaaaagggaataataagtgttttataagattcatgcatgatataatgtatgcaaagtgtttagcatggtgcctggcatatcataactgttaaacaattattagccagctcctagcattttgggaggctgaggcaggcggattgcttgaggccagcagttcaagaccagcctgagcgacatagtgagatcctgtctctacaaaaaaaaaaaaaaatgtgttttcattagctgggtgtgttggcatgcacctgtggtaccagctacttgggaggctgaagtgggagaattgcttgagcctgggaggttgaagctacagtcagctgtgattgcaccactacacttcaaccatggcaatagagtgagaccctgtctcaaaaaaaaaaattatcagctattactataattatttttattagttcctcactcacctaaaatctcaaacacaccttagaaatacacatatgagaacaaccaaaaatgacaaagtagaagcacatatgaaaaggctaagaaagcatgaaagccagcaagaaataactgccgctcttctggtcagcctggaaagcaactggcattttccctagaacaatgttttcaaacttggttgcacattaaaatcacctagagaccttttaaaaattctgaaacccaggccacaccccgacaaatgaaagcacagtctctgggggtgggacataggcatcattttttgaaggtccccacttgatcctaatgtgcagacaaatttgaaaaccacagctttgggaggctgaggtgggtggatcataagatcaggagtttgagaccagcctggccaatatggtgaaaccccgtctctactaaaaatgcaaacattagctgggcatggtggcgcatacctgtagtcccagctactctagaggctgaggcggaagcatcagtgagggagaatcagtgaacccaggatgtggaagtttcagtgagcccagatcacaccactgcactccagcctgggcgacagagcgagactccacctcaaaaacaaaaagaaagaaagaaaaaagaaaagcagtactctggaacctaccaatccatcatttagcatatttgtgaagtaaagtgttattctggtatttgcagaaccagaatccagctttattgggccaggcccaatttttttaaaaaacatggtaaggtctcccagccttaaagtattacatagcatagctctaaaagatcactgtaggaagacataaaatggtatttcagtcatctaagggaaaaaccttcctaaagcactagcccctggacaactattatttaaacatctacagctgttcaatagatattgggttctttttggagggatgtgacaaaattcttgtataattagattgtgatgatgattgtatcagtttagtacatgtaaatacactgaaaaccattggattatacactttaaatatgtgatttgcatggtatgtgaattatgtctcagtaaaaatctagagatggggctgggctcagtggctcacgcctgtaatcccagtacttagggaggctgaggccagcggatcacctgaggccaggagttcaagaccggcctggccaacatggtgaaacttcatctctactaataatacaaaaatcaggccgggcctggtggctcacgcctgtaatcccagcactttgggaggcggaggcgggcggatcacgaggtcaggagtccaagaccagcctggccaacatggtgaaaccccgtctctactaaaaatacaaaaattcaccaggcgtggtggctgaggcaggagaatcgcttgatggtggaggttgcagtgagccgagatcgcgccactgcactccagcctgggtgaaagagcgaaactccatctcaaaaaaaaaaaaaaaaaaaaaatcagccagatgtggtggcaggtgcctgtagtcacagctacttgggaggttgaagcaggagaatcgctttatctcaggaagcagaggttgcagtgagccaagatcatgctgttgcattccagcctgggcaacaagaacaaaactcactccatctcaaaaaaaaaaaaaaaatatctagagatgggagaatcatatggctggcataaaaaggtcaagtcaaagatatgtaagattaaggctttacgatgctccagttctagtaaaacagaccaggtacttgttttggtgtgaaattgccaatataagtatagtactgtacatattagttgtttagcttaggtaagtcttttaatctctttaaactccagtttcctcatctataaaataaagagaatatctactttgcaaacttgttgtgagagtgaaaagtaatgcatataaagtccctgtatggagcaagtactcaataactatttgttgaactaaaaatgataatactgatattcaccatttattagcatccctatgtgccagacactgtaaacaattaaaagttatcattctggtacccagagtacagtatgagacagacatgcaaaaaaaaaaaaaaaaaaagataatggagatctgcatagcataagatgcagtgggaccaaacgggaaaaaacacctaaatgagcctggagaaaggaagaaatgatagaggtggtgatgcttgagctatgatctaaaggttgagtagtagcttgtcagacagtaaaggggaaaggacagggcagggaggggccattgcaagaaattccatgcagagggattatggtatttcattatcactgaaccttaaactgtgtgtgtggccgggtacggtggctcatgcctgtaatcctagcactttgggaggccaaggtgggcagatcacttgaggtcaggagtttgaaaccagcctggccaacatggtgaaacctcatctctattaaaaatacaaaaaattagccaggtgtggttgtgggtgcctgtaattccagctacttgagcagctacttgagaggtcgaggcaggagaattgcttgaacccgggaggcagaggttgcaatgagctggtgtcaggccactgcactccagcatgggcaacagagagagactccatctcaaaaaaaaagtgtgcgtgtaaaacagacagtctttgtaggagatgaggtgaagcaagtaggcaggagttagatcctgagttacctttgggccaagccaaggagtttttattttattccatatagatgacagtcactgcagaaatttgaactgatatgcatatatcatgaggtttttttgttttagaaatattattctgtcagtcataagtgaagggactggggacattgggactggaggcaaagagatcttatctctttgcaatagtttgaaagctattgcaatatttgaagagaagattgataaatgcttgaaccagcacagtggcagtacagatggagggagctgactacaataaaatcatcaggacttgttgattgacatgatataggaagtgagggacagggatgagtcaaggctgatccccctagatcctgactaaggaagctgggtggttgacagtgccattcacagagacagtgaattctggcataaacacctaataggtcaggctggtttacacctccatcattcccatgggagaaggtatagaggggtgtgtgtttgtgtgtgtgtgtgtgtgtgtaaaagaacacagaaagccagattcctctttttgacaccagaatattggttcccaccatagtcaaaaggatattcctgaggatcgaggcttggaaaaatattggggaaggataagaactccagttgttgctgctttttttggcagccagtgtaacctaggtaaggacttggttgaattaagaaatttcatgtccagatcaggatggatttttctatttctctgagctctggtgtgtttcccactcagattgcaggtcgtaggtacctacggtgtgaattgtgttgtgtttctgtgcttgtgcaagggagtagctaggttgctgggaggtctggatgagggtgggggtggggtgagatcaagtctccagctccaagaggtcccctggggctaagtgaaaagcttgctcttttgaaatggtcttcgttggtaattaacaaaagatcaagaataccttggtgtcagataaagggaatttgtaggcacaatgctgttggtagctgatctcaatcattcaaggaagctattaaatctatgaacattagcattctgccaggtaaagagatctggtccttagcacctcccagacacactgattctttactgttttgaaacatctccctctcctggcttcctccaccccgcttccatactgtccttgaaatcaatgaatggtaatttagtgtatctagtgtatcactagcaaatgtctgaataagaaaggtttggtttccgctgtgtctcctgttacaatgagaacatgtactgcataaatttaattggctacgttaatgtgtaagccttttctgcaaagagatggatccgtttctgaatattctgcagaagggcagagttttgagtatatggcagtggttctaattagcagttgctccaatacaatcagactgagacggaagctactcatttagaatactggttgatgacaacactggcttgaacaaagtgaccactctccaatggctactctccctctcagtgggccgcaggttgctagggctcaggctgtggctgttttccccgccgaaaaggggcggggtcagtcggtgtgttaggaaaaaaaatgtatatatatatatatgttgtctgcctccccacagagataacaacccgtggaaaaacatgccgttgagcgggaggaaggcgaaaagataggctgggttttttggggggtgggggagcgtggaggatagggtgggctttttcccctccaatgctgcgacgcattaaccctgctgctgttgggacgttctctgctcagcctattggctgagcccgggagccgctgtctgccaatcgggtggtgaaaggcagacaaatctaccccgccaccagcaaaaacggcgcgtaacccttgcggcgccggccgaaccgcgccagagctggcgcggggaaagggagataggtgtctccagctgctgtggctgtttggggcgggtcggcttcatccgcgtctcaggagcaagtagagaattagcgggcggcagcaatgctccgcaaggtgagaagctggacagaaatctggcggtgggctacccttttgttcctcttttaccacctgggttacgtttgtgggcagatccgctacccggtcccagaggagtcacaggaagggacttttgtagggaatgtcgctcaagatttcctgctggatacggacagtctgtcagctcgcaggctgcaggtcgctggagaggtgaaccaaagacacttccgtgtggatttggacagcggagccctgctcatcaagaacccaatcgaccgagaggcactgtgtgggctcagtgccagctgcatcgtgcccctggagtttgtcaccgaaggtcctttggaaatgtaccgagcagaggtagagatcgtagatgtgaatgatcacgccccccgttttccgcggcagcagctggacttggaaattggggaggcagctcctccaggacagcgtttcccgttggaaaaggctcaggatgcagatgtggggagcaattcgattagcagctataggctgagctccaatgaacactttgcactggatgtgaagaagcgcagcgacggcagcctggtcccagagctgctcctggagaagcctttggatcgagagaagcaatcggactaccgcctggtgctgactgctgtcgatggagggaacccgccgagatctggcaccgcagagctccgggtatccgtgctggacgtaaacgacaacgccccagccttccagcaatccagctacaggattagtgtgttggagagcgcaccagcgggcatggtgctcatccagctcaatgcctcagacccggacctgggtcccagtggtaacgtcaccttttatttcagtggtcatacccctgatcgtgtaagaaacctctttagcctgcaccccactactggaaagcttactcttttggggcccctagactttgagagtgagaattactatgaatttgatgtgcgggctcgcgatgggggttctccagccatggagcaacattgcagccttcgagtggatctgctggacgtaaatgacaatgccccttacatcacagtgacctcagagcttggaaccctccccgagagtgcagaacctggcactgtggtggcacttatcagtgtgcaggatccagactcagggtcaaacggagatgtgagcctccgcattcctgaccacttgccatttgccctcaagtctgccttcaggaaccagttctccctggtgactgctggacccttggatcgagaggccaaatctagctatgacatcatggtcactgcttctgatgctgggaaccctcctctcagtacccacagaactattttcctcaatatttcagatgtgaatgataatccaccctctttctttcagaggtcacatgaggtgtttgttcctgagaacaatcgcccaggggacctgctttgctcccttgcagcctctgacccagactctggcttgaatgcgcttatctcctactcactcctggagcccaggaatcgagatgtatcagcttcctctttcatctctctgaacccccagacaggagctgttcatgctactcgatcctttgactatgagcaaacccagacactgcagtttgaggtgcaggcccgggatcggggcaacccaccccttagcagcactgtaacagttcgtctatttgtgctggacctcaatgacaatgctccagctgtgctccgtcctcgggcccggcctggttccttatgtccccaagcactgcctccatcagttggtgctggccacctaatcacaaaggtgactgctgtggacttggattcaggttacaatgcttgggtttcctatcagctcctggaggccccagatcccagcctgtttgcagtctctcgatatgctggggaggtgcggacggctgttcctatcccagctgacctcccaccacagaagctggtcattgtggtaaaggatagtggtagtccaccactctctacctctgttactctcttagtgtccttagaggaagacactcatccagttgtcccagatcttcgagaatcttcagctccaagggaaggagaatctcgtctaaccctctacttggctgtgtccctagtggcaatttgctttgtctcctttggctcattcgtggcactactctctaagtgtcttcgtggggcagcctgtggagtcacatgctttcctgctggcacctgtgcctgtctcaccagatctcgaaggagggaggggcttcccccttccaatgggatcctccgaatccagctagggtcagatgaccctatcaagtttgttgatgtgggaggccactctcatggctgtacacccttggcttctgcacccactcggagtgatagcttcatgatggtgaagtcacccagtgcacctatggcaggggagcctgttcgcccaagctgcccaccctctgatcttctctatgggctagaggtgagacctttgcaggctcaacaaatgcttgagggttattctgatccaggcatatggctaggccatgtcctagagagtactggcctctcagtaagtgcccatagtgatgtcaccatttttgtaagaggtaactatgtggtagacgctgtgctttgtaactgtttcgtgaattaaccagagttgtcacagtttagcattgggggcgggtcatgcctatatctgagtaagaaatgaaagtaattggtgatcaagagccaggctgttgtggaagcatgatgatggaatgtgggagcacaggaggctacagtgcacagggtacagtgcaccaggcagtcacttggacaaaggtggctgttttctctactcttcctgaaagaggggatcagattctgaagtaccttaactctaggttaccatttcccaagggattgaggggaaataaaatctttgtctcccagtatctagtacactgtgaagggacctctctatttgaaacatagagacagcagaaagaggagagaactaaaggaatagagaggcacgcatcagagtggtggcatagatcttttggtctgggtcttaggactcatatcaagtccctactggggatttgaactagatgcggtaaattggaaggttggggcgggttggtcatcacctttggaaaaaacagtaagtgaaatcacttatgtcagaaaactggtttacagttggctgattcatagaaacagccaccctgtgcatctttaagttgagttctcctgaatttggtgaaaccatgaaacctagaagccaagccatccatgcttggcctctgaccaccctcctgggtgacctgattcagccccagaaatgttcccctacccaaaaactgtaacactcattccacatttggggtctggggtgtcagaaaagctaagtcccatgtcagctgacattgagatttccgcaaagcattgctggagagtcagggcaagactttacaaggttcttactaatcttttctctcaccttagcagcattcagcaggatgggggagggtgggggaatacatgggctttgcctctcccagaaggacaagattttgctggttcaagcaaagtggtggaagcttctgaagtcatgcaggaagttgctgggacagaacgctgaggagttttgtatcactttgtcttccctgttgagtaccatctgagctgtcaaactttgctgccaagggggctgaatcaacctgcagcacgaagtgagtggggaggtaggaagcttctgtgacacagatttgcagcctgtgttcccaaggtttccaggattgaggaaactccataattggttgagagcacacagactttttggccaatcagactcagagctgaggtgggagatctgctcttccagcccgcctctcctcctccagctccccagctccactcaaattcagctcccctcccccctgcccacccccgccactcggtgactaagaactgctgcaagcaggcaaacctccgagcagtttttaagaggctggaaggagacataagagacttcagctgctgcattccaagccctgggtctaccttggagacaggacagcacagacttactctccacaaagggacttctgggtcatggggcccaagacactcccacagctcgctgggaaatggcaagtgctgtgcatgttgtccttgtgctgctggggctgggtgtctgggcagcttcgttactcagtggtggaggagtctgagccggggacgctggtggggaatgttgctcaggatctgggcttaaagatgacagatctgttgagccggcggctgcaattgggctctgaggagaatgggcgctatttttccctgagcttgatgagtggtgccctggcagtgaatcaaaagattgaccgagaaagcctatgtggagccagcaccagctgcctgctgccagtgcaggtggtgactgaacaccccctggagctaatccgtgtagaggtagagatcctggatctcaatgacaactctcctagctttgccacccctgagcgagagatgcgcatctcagaatcagcagcatctggggcacgattcccactggacagtgcccaggatccggatgtgggcaccaatactgtgagcttttacactctaagccccaacagccacttctctctgaatgtgaagaccctaaaagatgggaagccattcccagagctggtgctagagcagcagctggatcgtgaagcccaggcaagacatcagctggtgcttactgctgtggatggggggaccccagcccgctcagggaccacccttatctctgtcatcgtgctggacatcaatgataatgctccaaccttccaatcctcagttctacgtgtgggaatcccagagaatgcacccattggtactctgctgctccgcctcaatgccactgatccagacgagggcaccaacggccaactagactattcttttggagaccacacatctgaggcagtgcggaacctctttggcctagaccctagcagtggggcaatccatgtgttgggtcccatagactttgaggagtcacgtttctatgaaattcatgcaagagcccgtgaccagggacagcctgccatggagggccactgtgtgattcaagtggatgtgggggatgtcaatgacaatgccccagaggtgctattggcctctttggccaaccctgtcctagagagcacaccagtgggcacagtagtggggttgtttaatgtgcgagaccgggactcaggtagaaatggtgaagtgagccttgatatctctccggacctgccatttcagattaagccttctgagaaccactactcgctgctaaccagccagcctttggaccgggaggccacatcccactatatcatcgagctgctggccagcgatgctggttcaccttccctacacaaacatctcaccatcaggctcaacatttcagatgtcaatgacaatgcaccccgcttcaaccagcagctttacactgcttacatcctagaaaaccggcctccgggctcccttctttgcactgtggctgcctcagatccagacactggggataatgcccgcctcacctactccattgtaggaaatcaggttcagggagccccagcctcctcctttgtgtatgtcaacccagaggatggacggatctttgcccagcgtacctttgactatgaattgctgcagatgctgcagattgtggtgggggttcgagactccggctctcccccattgcatgccaacacatctctgcatgtgtttgtcctagacgagaatgataatgccccagctgtgctgcacccacggccagactgggaacactcagccccccagcgtctccctcgctctgctcctcctggctccttggtcaccaaggtgacagccgtggatgctgatgcaggccacaatgcgtggctctcctactcactgttgccacagtccacagccccaggactgttcctcgtgtctacacacactggtgaggtgcgcacagcccgggccttactggaggatgactctgacacccagcaggtggtggtcctggtgagggacaatggtgacccttcactctcctccacagccacagtgctgctggttctggaggatgaggaccctgaggaaatgcccaaatccagtgacttcctcatacaccctcctgagcgttcagaccttaccctttacctcattgtggctctagcgaccgtcagtctcttatccctagtcaccttcacctttctgtcagctaagtgccttcagggaaacgcagacggggacgggggtggagggcagtgctgcaggcgccaggactcaccctccccggacttctataagcagtccagccccaacctgcaggtgagctcggacggcacgctcaagtacatggaggtgacgctgcggcccacagactcgcagagccactgctacaggacgtgcttttcaccggcctcggacggcagtgacttcacttttctaagacccctcagcgttcagcagcccacagctctggcgctggagcctgacgccatccggtcccgctctaatacgctgcgggagcggagccaggtgaggggctcggcgccgccccgggcgacccctgggggcggcactggagaagccgcccgtcctcataagggattgaacttgcatccactcctctccggccggcttggtcgctggctgcgctccacccgattctcgggatcattggaccgtttgcgcgaaaccagagtggccgattaagggatggggctccgagcaccgggggtggtggcgactgtgggcgaggggaggtgggaccgacccccacccctacactcaaaaaaggccggggcctccttcgagcttccggtgaatttcgggcgatttccgcgggtgtcgggggtcccgggaggaggcagtcacagatccacccctgcagccagcctcctaggcgccggctccggcacgcttcgccggtctgtagatttcctcttcgatttctccccagctcccagcatctgtgacttcactgttaccctccctatccccgcatcacccaaccgcacctgtctgcgggacttaggtgtgcgcgcggggctcatgcgtgtcctccctgctggccacccccacggcccacacaagttgcacgggctcgccacgccccgccaacacgtgcgcggacgcacgcacgcactcctcgcacgtgggcttacgcgaataccagctttcactgccactcgctcgcggccagattcacaggcctgttccggtccactcgcagctcccctctgccgctccctccgccgggctcaggagtactcgtagctgattgtgcgcgcctgagggtcccagatcgcggccgcccaggaccaggcgaggactccggagcctcctctcacctctcccacctgcgccccgggctgggccgggtcgcctggggggcggcctgagcgaggcgcggggccaggagcgctggagcgactgccgctctaagtgccgggcgggcaggactctacgatccttgggccagaggtccggatggtcccgggactccgtctcaagggtcggcgacccctcaacccagaagcctcgagcaggcggacaggcagagctgcccagtggccgaggcgcggcagggctccgcgttgggcgagtgagtgagcctctataggacagcaggactgggactccagtggcaccagcggccccttcctcccgcaggaagtgaaagcctcgagcgccctggctctcaacccccagagatacaggcttttggcgccgtcgtgatcacaatgtgcccagcgatctagggtcagagatttggaggtgaccaaactatctgacactctaacaagtcctgtctcctctggcagatggaaagctataggctctgccagatgccagggtgcccttatgtgtgaggaaactacaatagtaaaaaacacaagtttctccaactccaggagcttttattcaaaatatatcaatgcctaactctgctcctaggactgtattttgaaacacccccaggtgattttgatagctgattgagagaaacttactatataactcctttgagaacctcatctcatttgctcttcccaccattgctgttggctaggtactaacatgcctctcttataacagcttcacagaggtcaagtgacttgctcaagttcacagagcaagtaagagagattctaacccctgtctaactccagaatgtgtgcttttaatttcttggcacttggaactttaaaagcttgaggacaggagaggggagttgcctctgctgggattttgcttctgctgggatggggcaagggtggggttccttcccttttaggaccttacatgtggggaaagtcttctgtggctcctcatttctgagcagtccccgcagcgcaaacttggccagttatccttttggagattgagttcccccagctccgtttcctcctatcacaatcactgcatttccatgtagattctgctgtgtctaagaatacagtggctgagggctggccatccctgtgcccttctccatggcagccccagaatggtgctggtgactcccgatacacctggaatgctaggtttctgggttctgctcatatcactgccacctgtgagccttgagtgagccactggcagttccggagcttccttctccctggagtaatctgagatactcacactctctgcttctgggagcaagtatgagtattaattaccagcccaccccagaaccagtgaggaggtggctctaggagtgctccatgagagtgtgtgatgggataacacaccccctggaaagaccagaagggactcaggaatgaagtggctggccagagccccacaccttcagctaggtgggagatggctacacatcagccccttgggagccctggagacttagttggccctgcttggaggctgtgggagctggatccctccccgctgcatcccttccatttttctccgtctcagacagagcagccttgttctcttctccttagtcacagaccattgtctggcacggagttctaggggtgagaagtgtcccgggacttggatgccccgcaaaggcccaatctggcatgactcctaaattaataatgtatttagctgtgggaagagattcttgcaagccaagggcccagagaagatgtccctgtgaatgtgtcactgcacaacctggcaccaaaagggttaccaagaacagcagccatcttgctgcagaggatgctttgttcccagctgaggagttgaataaattcattctagggctggtagaattctcattgaaaagcctcctttgccactttagggggctttgtctgcacctcttcccccagttccacagaagatgccttcagtccttgaattttggctcaggagttctgactctgggggcagggaggaaggggccatttctttaggaaaggagtctcagcttgctcactgtggtcagatgaaatgtgatttatctcttggtttctggtacctcagacctctgagacctgaggtgtattttgtctttggagatgagtccacccctgccccctcttagtccgttttcttctctgtgcccactcccctccttctctcccggcccatccctaggggctcgggtgacattctaacttctcacgggtactcagcccctttccctctgttttctccacagcaagccccgcccaacacggactggcgtttctctcaggcccagagacccggcaccagcgggtaggtgactgattctccagcccaccctcttctctgcggcattttctcagggatgacgtgggaggagatgggggagggcccagcatttgctacagatggcttctccctcagtttgagatcccagggaggtcttggtgtgcggggggctggcacacagaccccggaaggaagaggcgactgccctgactgttcaggaagctcaattcacatgcttgccccttccctcctcgccacgaccggcaccttttcctatcccctgagggcactgtggaaccaaaggatggtcttaagctggtctctgggtgaaagcgaggctttctatgcccatgtactgcctaaccccctcccctgagttgagctgggctccattatgacctggggctcaggcagaaaagcatttgaccggaggaggcggtccgcactcagcgcctcctccagagcctccagagccgaggctgactgcagcctggggagagtggaggcagcacagctggaggtggaactgaggaaggactgggcggggcatggagcaggcccccttctccggcccctcctcccactgtcctctgcccctacttgtcctgctctctgtctgtggggtctccgtgtctctgcccctttttcttgagtttccgtctttgccactttctcttacctctcagtccttccctcagtctctatctcgctttgcaatctctgcctctccctctcttctccatctctgtcttagcttccgtcttgattgctgcacctcagcctcagtccctttcatttgtctacttgcattgatctgtgccgcccactgtgcctgccatggcataagtgctcaataaatgtggagtgagtaactacacgggacccttagtctctttctccttctctatctctgcctccctgtccttgtcctggacctcttttctgtttctcctttcaccgtttcctagcgccttgtgttcttctatccccagcctctatgtttctctgtctctcactatttctgctttcctctctgttctttgtctctctttgtctctgtctctgtatatctttctttgtctctgtctctggtctctgtgcctgttgtctttttctgcctctttctctgttactctttctttatctctctttttcttttatcttgtcttttttctctgagcctctgtctctgtctctcatttttttgtgcttgtgggcaagccagcacacacaaccccccacccaccacccaccaacaccccgctctcttccttccctgcccctcacacactgagcctttgatcgcagctctccaccagacaccctcccatccaagcagccccagctgctcatttcaatctggtatgaattcctgctgagacaggaaccccctgcgggctgaaggggagggaaacttcagcagaaagaccttcagttggtctgagcagagtgggataggctctgcgccaggcctcccagttagaagtcaggagcctggaggagtctcagagcccagggagagaagcaggagcttgggccaccttaccctacctcctcaatggttgagtacttgctgtccacatttgccaagttgctacagatgctgagcttccaagagttatctttcccccatcctgcaaccaaccaaacccttgttgccacaaggacccaggagcccttggtgtatggcagagattccagcttctgggcatgcacagtcctgtcacccattttaggaacgcaaagcgcttcttagaaggcccctaaaaagcagcagatcaaaaggcttgggctgcccttgcccttcctttgaccccagctgttgtccttctccctgctggccttgccaaccttctcataagttatccattaagtcattaatgtattcattcgttcatttattcaacaaatatttatcgagcatctactatgagcagggccctgtgctaaacattgggctataggagtgaacaagtagatgtgatcccagaactcataggcttccagaccagcagaggagactgaaaatttgcaacaagtaacacttaaaaaaaaaaaaaaaggctgggcactgtggttcacgcctgtaatcccagcactttgggaggccaaggtgggtagatcacttgaggtcaggggtttgagaccagcctggcagccaacatggtgaaaccccatctcgattaaaaatacaaaaattagccaggcgtggtggcaggcacctgtaatcccagcgacttaggaggctgaggcagaactgcttgaacccggaaggcagaggttgcagtgagctgagatcacgaaaaaaaaataatctagccacaaatcacagtaagttctgagaggcagagaacaatgtgagtgtaatgggggggggaagatcagagaaggcttctaggaggaggtgacattgagaagttctaggccatttatgttccctctacctaccaccaccccaggccatacactggctttgaagcagaattcaccattgaacctggaagccccaccaactgcctctcatgtgtcctctggggtgagcaccttacccctgcctcaactcccattccatcaaatgagaggcttagtggcctggaatacatgtgggagctcttggagatatggaggagaaggtgcggaacctctctctctctcctctctctgcttccttagttaacttgtggaggatgcaacaaaccttttttttttttttttttagacagagtcttgctctgttgcccaagctggagtgcagtggtgcgatcttggctcactgcaacctctgcctgccaggttcaagcgattctcctgcctcagcctcccgagtagctgggacagcaggtgtgcaccaccacacccagctcatttttgtatttttagtagagatgggtttcgccacgttggccaggctggtttcaaactccccgacctcaactgatccacctgcttcagcttcccaaagtgctagaattacaggtgtgatcgcccccggccacaacaaacatttttgattcagcggctccaaagtgaaataagcgttaggatctagtccagtaacttcaacttctctccttcattcattcaacaaatggtcagtgagcactttctgttggccaggcagtgttctcgatgtgggaggcccctgccctcaaggagtttacagtgcactgaaggagacaaatattgaccaaataattacaaaaataaatgtgagactgaaactgtcataagtgctaggtagaattgtatctggtggtgtgggcgtataatagggatttgatttagggagcaggaggacatcctggaaatgaagttgtgctgagatctgaaagacaaatacaaattaaccagctaaagaaaagaaggaagagcattccagatggtcaggcataccagcttcaaagcagggctggtgttgagttcttcagtaaacttggttcaagatcaagccagctctgggtcacactgcctacacagaaggaagagcattccaaatgggaaaagcctatgcaaaagccttgtggtgaggcctcctgggatcaagggaatggcagggagttttctctttgctggcactggagtgaggggatgaagaggagaggttccttttatccagtctaaccctggttccagccttctgttgatgccctgcctcactccctccccaccatcttgcccactgccctccagcctggtctggtcagacacaccagcttcaaagcagggctagtattgagttcttcagtaaacttggttcaagttcaagtcagcactgggtcacactgcctagacagaaggaagaagacctggccaggtgtggtggctcacgcctgtaatcccagcactttgggaggctgaggtgggtggatcacctgaggtcaggagtttgagaccagcctggccaacatgatgaaaccccatctctagtaaaaatacaaaatattagccaggtgtggtggtgcacacctgtagtcccagctactcaggaggctgaggcaggggaatcgcttgaacccaggaggcggaggttgcagtgagctgagatcacaccactgcactccagtctgggtgacagagcgagactccatcaggaaagaaagaaagaaaaagagagagagggagggagggagggaaggaaggaaggaaggaaggaaggaaggaaggaaggaaggaaggaaggaagaaaagaaagaaaaagggagaaaaaatgaagaagacttacattctgaagttcctgcttggcacatgcttctcctccccaccactatcccttctcaggtcatcctttgggtgtctgatcccaatagctgttgtctcaagctctgagcccagcaaaccatttcccccttcttaggctgtaacccaggccctgccctgcagctgtccccagcctctgcacaaagagtctccatttggtccctagactgttctctgatggctccacactaccatccctcctctgagagacagtatccctgctctctctcagtttgggcagtcattcaacaaacaaatagcaacttaatttttttccacttataaaatagtacatgctcattatagaaacatgaaaaatagaaaaaaaattaaaaggaaaaccacccatcattttacaatctagggagaaccaccaccaactacagtttaatatgaaacatttcaaatatgtacaaaagtagagagaatggtgtcatgaacctgtatgataccactatccagcttcaactaatgccttatcttgtttcacctatatccctacccttatcctgtccttggattcttttgaagcaaatctcagacatcatataatttcatcttggtctccaccatctttaacagatgacttttttttttttttttttttttggagacagagtctcactctcttgcccaggctgtggcacaatctcagctcactgcagccttcgcctcccgggttcaagcaattctcatgcttcagcctcctaagtagctaggattacaggtgtgcaccaccacacacagctaatattttgtattttcagtacaaacagggtttcgccatgttggccaggctggtcttgaactcctggcctcaagtgatccaccctcctcggcctcccaaaatgttgggattacaggtgtgagccaccttgcccggccagatgattctttcataaggtccacattttatatttgagtgagtgtctcttaagtatcttaatgctcttttaatgtaaaagacttcccctccatcttccatttttgcaatttatttgttgaatccctgccttttcatatatatctttctaaacttttctttgtgtaatcaaagaacatgcatgagcttcatttttatttttatttatttatttatttatttatttatttatttatttattgatacgtagccttgctctgtcacccaggctggactgcagtggcgcaatctcggctcactgcaagctccgcctcccaggttcacgccatgctcctgcctcagcctccagaatagctgggactacaggcgcccactaccacgcccggctaattattttgtatttttagtagagacggggtttcaccgtgttagccaggatggtctcgatctcctgacctcgtgatccgcccgcctcggcctcccaaagtgctgggattacaggcgtgagccaccgcgcctggccgagcttcattttaaaaaaatctcattcacctaaataagttgttcacaaacttgtcacactttcatgtgacactttattcacatattaagaactgttattcccagtcatacggtacatttcctactagttttttaaaaatagcaactgaggccatactgtccaacagaattatagcttttttcttctttgcagtgtatcatgagaatttccccatgtctttcaaaattcttcccaagtcatttgcagagtaactcctcttatgaatatacatattattttacagaataagtcctcatatgaatatacatattatttttctaatgctaatgggcttttgctacattagaaaacatacacattcatttacaattttttttttttgagacagtctcgctctgtctccaggctggggtgcagtggcgccatctcggctcactgcaagctccacctcctgggttcaagcaattctcctgcctcagcctcctgagtagctgggactacaggcacgcgccaccacgcccagctaatttttgtatttttagtagagacggggtttcaccatgttgaccaggatggtctcaatctcttgacctcgtgatccgcctgcctcagcctccctaagtgctgggattacaggtgggagccaccatccccagcctcatttacattttaacacaattaaattcagggtgttgtcagggtgacttcctagatttctcagttttttgagcatgatgtagggagtattttattatagtccagtctatgggatattcccttatacacacacacacacacacacacacacacacacacacacacaccccaaactcaatagggcaagaaccatattcatcatctcttaaatcctaggtcctgtcacaggccactgcttggaaaatagttgactaaatgtagtccatttcttccatttttacttttcactattccccaaatcctggaagagtccctcatatctgctgctggggctccaaggcctccaagctgaagcccagtacgttgttgtgcataagatcataggccctggaatcatattaggctggctttcaggttgcaactctaccagttccagctgtgtgactctggtatagtctctcaacctctctgagccctgttttcatctgttggaaaatatagataatcacaacacttatctgcagggtgattccgaggataaaaaagacaaatatattacccagtcagcttagaataggaagctctcagtaaatggttaaaaaagaggtctctctccctctgctcatctcttacccagcttcacataattggcagcccacccacctgtttggccctcaaccttcaaccatttcccaggacgcctccttacactcctgatcatcatggttccaaccccactgttccactcagctttgttccctcaacaccactgctccctgtgacaggtcatcctcctaacctctggcatctggtcccgttgtctccctgacaacccgcatgctctcctccctgcaacccccgccgcttgcctgctctccctactttattcccattagcccccttcacctggggctgagaacacctggccttgaccctgcaccctcagccaggcccacagagctcagtcgggccggaagtaaggaccccagatattcagttgaggaatttaacattaatacaataatatagaatccaccagcagattttcataaatgttctgtgtgttcttttatccttttttttaatccaggattttatcaaggagcatagattgcatttggttgtcacgtctttcctctcctttaatctggagccagctcccagtctttttatttttttaatgacatggatatttttaaagagtccaggccagttgtactttaaaatgtccccgaacctggatttgctggctattctctgatggttagattcagattacacaccttggtaggaatacttcccgcagcatcacactgggactcatctaacgtcggcctgtcccactatcagtgatgccgagtttgttcgtgtggtaaaaacagtgtcccagatctctccattataaaaatatatttttataaagatattttaaaatatttgtgaaaatataagtaatctgtggatgatactttgagataggcagcaacccttcatgcaattttagtattccctgatgatccttgcctgtatctgtttttacatcagtgattacaaagcggtgatgttctgtcattccttctacatgtatttgctggtattcttctgaaaattacctggatgatttcttcagatttaaattcactgtcttttccttggggaagcctggactggctgagctgcctaaccctgactctctgtcttttttttttttttgacagggagtctagctctgttgccaggctggagtgcagtggcaaccttcacctcctgggttcaagcgattctcctgcctcagcctcccaagtagctgggattacaggcgtgtgccaccatgcccggttaattttttttttttaatatctattttagttgagacagggtttcaccatgttggtcagaatggtctcgatctcctgacctcgtggtctgcccgcccctgcctctcttcataccctctggtagcccctgacacagcccatggcaagtatcacaattgcaattactctattgtgtaattatttaaaatcagcctctcagtgcccaccatgagcaccgtaaagatggacagtttctatcatactcacagccacaaccccagcacctggctctgtgtctggtacatagaaattgctcaagaaagaattgttggaggggcgcggtggctcacgcctgtaattccagcactttgggaagcggaggcaggtggatcatgaggtcaggagttcgaaaccaacctggccaatatggtgaaaccccatctctactaaaaatacaaaaattcgctgggcatggtggcatgtgtgcacttgtcgtcccagctgctcaagaggctgaggcaggagaatcacttgaacctgggaggcagaggttgcagtgagccgagatcgcgccactgtactccagcctgggtgacagagcgagactccagctcaaaaaaaaaaaaaaaagaaaaaagaaaagaaataattattgaatcaatggaaacagaattacaactcttcccacttttgggaaggagaattgagattcctgctttccccttcaaccctagctttatgtttgttgtgatggtatagaggtcacacatggcagccttgtgtctgttcttaggctgagttcatctacttagggacggggaatcccagattgggcaaaaccaaaagcagggacagaccttggaaaaattgtaaagcagttcttggttgtgctcacccaccatgacaaaatatgcacacacacaacgcaacacacacacagacattttcatgccttcaaggcctaccctacagcctttcccatggtgccaaacccttcttcttaccttacagtcacttaactgtctctgctggtctcttcccactcatttaggcaacaaatatttattgaaaaacttctctgagccagatggtgccaaacagttacctaaagggcagactgtgtgtgtgccagggctgtttcccgccaacactcccctgcaaattgaaataatttcatccttggaaattcaaaaaaatcatgaaaattgtcactgtgggaaaattccaagtagagctgaaccttctaagaagcagagagttcttcttatggtttagtatttttttaaattatgaatcatttcatgttttttcaacactcggagtttctaaaagtctcacttaggtccaagtgctaggctttgtgctaggtgcttcagtaggaagcaggtggagtcgctgcctcacagaagccagtgtggtggaggaacagacaggcactacaacagctgcagtgtgactagtgccatgtggggcagccgctgggatgggagtacagtggaggcacctgcccagtctgagtggatctcctctgatatattttattcgtgtcatcatggcaaatgttgggggactggcattctagggaacaccatctgcccaggattcacagcaagagggaacttgagggataggaaagtgcaccttggaaaaggtttgatgatagagtgtttgagggcggggggtgggggttcttgtaaaataggaggggcaggttcttctatggccgtggattttactctgagggcttaggaagccattgaattttagaaatttcttctccctgctccagggtctcttggggcctcctacatctccccctaggtacctcctaggtccccactttttctctagctctggaacattctcttccatttcccaccttcacagtcctctggagaaggtctgatctccctcactatgacaggaagccaggctctctcatggtgggtgggggaatgcactatgttcaatgcattggaccagcctggccaacatggtgaaaccccgtctgtactaaaaatacaaaaattagcctggcacagtggcaggtgcctgtcatcccagctacttgggagactgaggcaggagaatcgcttgaacccaggaggtggatgttgcaatgagccaagatcgcgccactgcactccagcctggatgacagagtaagaccctgtctaaaacaaaaagaaaaaagcatcggaggcagcaaagagctggtttgagggactgacttgtgggattctggcttctgaaggattgtagaagtgcctcctaccttgctgagagaaacaggtcttgggcatggggtagggttagggtactaggtttgggagccctgggagaggacaggaggggcatgagctgtgccggcctgggagtctgtgctcaccatcctactctctccccagctcccaaaatggcgatgacaccggcacctggcccaacaaccagtttgacacagagatgctgcaagccatgatcttggcgtccgccagtggtaagtggtgtcagtgtgtgtatggaagagtgggagacctggggttctggggtgcatctcacagccaccatgcccacggactggatgtcaaacctgtgtagtttctccagatctttcggcaggtctgaaaggacccacaattccaaacataaagcctggaattgtggctaaggaacagcagaggggttgggggtcctgggatgcctggaggagagcgaacaaggaaaagactcatggagggaatagtggttacaagtctagctctggaatgggacagtgtagctcaggtcctagctctgctactatccttgggacttggatcgacttgctcaatctctctaaacctcagtttcctcagcctagaaagtggggacagggaccccaaagggttgttgtagagattaaatgagatgataccacaaagcatagagttctgggcctggcgcttggaagccctcaagcaatgaaagtgggtgtagaaatccccagccgagagaacacctcctctttatgcgaggctcctcttttgctgcccctaactccagagtaggattctggttttcccataaggttgactaagggcttcctttgtaatagagattcggctagtggtggttgtccctgaagagtcactagggcccagagcaggagaagaagaatatcatttgtccttaagagcacagcctaagctgggcgtggtggctcacgcctgtaatcccagcactttgggaagctgaggcaggaggatcatgaggtcaggagttcgaaaccggcctggccaacatagtgaaaccctgtctctactaaaaatacaaaaattagctgggcatggtggtgcgtgcctgtagtcccagctacttgggaggctgaggcaggagaatcgcttgaacctgggaggtggctgtggtgagcagaaaatcgcaccactgcactccagcctgggcaacagtctcgctctgtctcaaaaaaaaaaaaaaaaaaaaagagcacaggctttagaggcaggccaatctggattcaaatcctggcacctggcaccaccacttagcaatgagtccttaggtaagttattaaaccccctcggtttcacttactattaatgggcacagtattaacggatctcattgtggtgttaccagggccaaatgcaagtccctcagcacaggattggcagagagtaagggcacaatatattattatctttgctgacccaaacccgttttttactgggtagaaagcagaattagaataatgcctattaataaagactagcttctggagcagcaaatcctgggcttataaggaggctggcagaggatcaaggcattgccctatatcatgaactgatagccctgccctccagcatgtctggaggactggtgggtagagaaccaggtgaaatcacaagaagcactgtcatcacacctgggcacatactaaacaaactttaggggcctcctgtcaatgaatcctctcaatagctctgcaaggcaggtctgatttctcacactcgacagatgagagaaccgagaaggcacttgccccagggtcctcagttttgagctgccaagctgaggttctaacctggctcaactcctaagtttatgctctttctactatagggaccatggctgcctttggatccagcctcggcttctctattacctgagcaggatgagaggctgtcctcttcctcgagctctgctttattcttccagatcagggttgccagataaaatacaggatgcccagttacagttgaatgtcagataaacagcaagtactatttcagcataagtcagtctcaaatgttgcatgagacataatgtactaaaaaaaaaaatgctcattgtttacctgaaattcaaatttaactgggagccctgtacttttatttactaaatctggcaactctaccccagatgtctgtgaggttaagtggggccaggcctacagctgacggaaggacagagagagaggtggcagggactgctggcctcctgaggcagagctgtcccaggtctggtggggctatgattccagagaggccagagactgagtatgaaagtggcaggcggctgggtctgaggagatgccaagttggcctcttgagggaaataaacaggtatatttagctgttgtggccttgcgccctgaggccaggaagcagctttttagcctaaatccagatgttaaaaacagaaatgaaatcagtatttatggccccaaaccctccaagcaagtcatgcagctcgttcccctgtcaaggcctcccacctttggcccacacagggcctgaccctcgtctaagcctgcgccctggggaacggaccctgggggtggaggtggtgggtcaggccctgctctcactttcacacccgcttcctagccctgaaaccagagaggttcctgaagtccagcccagccaggcctgtggggctgctgagaggggttaagtaagagggagagtaaaaaccgacacttgggaggaggcttttaaaataaacatctgcggggagggatgctctcaaggaggctgcggtttgcagctcagccagctgtgttccagctaatcagcctccttgggctactctggagttgctgccttggccctgggatggggtaggttaagaggacagagggaggtcagggagctgggggctgagtttccctgagtagaggctggcacaggagagaaggcatcacccccacctcgtccaggccagaagatgtccagcttcttgaggctctcctaagtctgcctctcctgggaccaagagaaaatcccggtccttgaccaaggtgggccttggggggagtggggtgtagagggaggggcactggagaactgactctacagaaagtcaaagctggcaatccaacttcttcccctcagatttatagatgggaaaacaggcttgagccacgcagagacttgaccaagctcacacagttccttagtggcagagcagagcaaatattctctttcttttacattctggatttccatatcttctctccctcctggtccagcccaacctcagggcaccccccacgaggtgggcgggggatggctttgtcacttgcacccactcggggtgctactcagagatcttgggtgcacataggacgtgggtgggccgagcttctagctactccgtcaggcccttcctgtcattctgtctctgcctcccttctccctgcttctccgtgttcctcctcattcttttctgtgtgcagggagactacaccccccaccccgctctttctctggcgcctctgaggtcccccctctagcccctaaatcactctggaatcctggctctttgaagccagatctgggcccccctcccctaccccttccattcccaggctgggaaaggctgaagaggctgacggctggaggggagggggcggggcggtggcggatctggcttccttttggagttaattagggaaaacagagaaatgtcagcggaatgaaagggctgggggtgggggccagctggggtaggagaggaggaagtgggcagctgctccctcccactcaacccctctcccccgcccccagaaagctctcagctccggggatttgcgacatgaaatgggggctgtagaaacctgagcgctggtgcgtgaagagaaaaaccgaggcgcatcccggctctcccctcccgtgtgccctcctcctcttatgccggcttgaaaatatttcctgtctctctatttctcaatccctggttgatgtcccaggattactcagcctctccggctttagtcactctcgctacccgctcccagggtccagggtggaggcagagggaggctgggagagaagctctactgccagctgggcctgggctggcctgggcatccctgaggttttaactgtctcctaaccacagaggatctcagggcctccagcagcgagccccaatgagtcaaactcttgtttcctcctctcccacccccgacccagtcagggcaggtgaggggtagaggtgatggcatgctggatgtgacggtgttgatgatgtattgcacaggatgaagcaccatctcatttagtcctcacagcagccttcacagtgcgtacaaatcagctggcaattccgagaggctgcattctaaacaagttcctgggtgatgctgagccagggccagagtgtggacttctctgggccccagtttcttcttctgtacagtgggacgttggactggaggtgctgtctgatgtcacctagctgtggcactctgagcctgtgcctaaagtgtccctgagatgtctagtccccgagatcatcatctcctcagcttcatagagccgagctcttctccatcttctctctacctcccattcactcagaacagggataaggtccaagctgctggtggtgatggtgactgactgtcccttccagcatgcgcttaggtacacttgggcctgaatgcccctctaacaaatgctaccgggtatggccttggtccttctaacacttggttccctcatctgtaaaatgagggtcataccacatagctggctgggctgttatgtagaggttaaaagtgattgtgcatgtgaagcatccagcagagtgcctggcacacagtaggtgctcaaatgctgttttgaaatacaaaaattagctgggctagtggtgtgcacctgtaatctcagctactcaggaggttgaggcaggagaatcacttgagcccaggaggcagaggttgcagtgagccgggatcgcgccactgcactccaggctgggcgacagagcaggactccatcttaaaaaaaaaaaaaaaaaaatgctgttttgaaatggaggcttggaagagcactcttcacccccaccccacacacttactaacggaactaccgaatctctactcgtgccaggccttgcttggcaaaggctaggggcatgtaaagccatggtttcatggctgctgccctccaggagcccatggtctagtgtgggagtcagaggctcccttgagaaagccagggcaaggaactgagagcccgtgtcacagccctgagagaaataccagcgaatgtgttttgagcacttacatctaccaggcactattttacgtacctgacatacattttcttatttagcattcactaaaaccagaagaggtggttaccattatcatccccattttgcagatgagaaaactgaagtggcataaggaggttaggtagacttgcccaggatcacagtgagtaaggaaaggagctaggaatcaaacctagactttctcactccagagcctcttaacctctaccctcaactcttgtgaagagagactaccttggtgacccctatattcccagtgctcagcgtggtcaaggcccagggtgctgtataggcattcattaactgctggggatataagacagtgactgttgaggaccctaagtttagctcccacctgatcttcctctgtctctgcagaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctgaacgtttctgtataagcgatggaagctcctggcatgtgtgcatgaagtgatgagctgaggtgggtgctggaagaagggcggaatcgggaggccactctgtgtcattgcgcgtctagatgtttccgaattgcgtgtgtgtgtgtgactgtgcaatatggttgtgtatgcttgcaatgccgttgtgcctatgagac

SEQ ID NO: 14860 - DNA, 132266 bp, Human
acaagtgcttacattgtttaataatcatacactttgcttgcctcaacaagaagttcaaaagtactattaaacaaatagaatttaactccagtttacagaattcatctataatacctctattagttcctttaaacaaaatttatctactttgtgaatgcaaagataactatggattattttgatagatcaaaacagaatgtccttcaaagtgttccctgtattctggagcaatgccaccagaaagcagaaataggttacttaggagcctcccacaaaacgaagttaagctttcttagtgttagttctggattctcctcctggttccaccaactactctccaggacctagaagaatttacaaaccaagactgtttcttgccaggtctttattccagagcaggtcattctcttttattctgcaactatgtgaaaggagctttcttttctttctgctagcagagggtagcctcggatccatcaataatttagttttactctatcaacatcagtggagagacgagtacctctaaggatcctgtcaggacagtcctgcattttgctcaaatgctgtctagagatccctgttttctcaattacactagaatagagtaggatgaagatttgaattgcatactaggatgaagacttgaattgaattgcataatgaaaagaatcagccaatccattatccagtttcttatgaattcacagcccagtaggatctctgcagatttctgccttctgtagaaaatgggttgcttctatagctgattgctgcagccaagacaaacaacgatttctttctttttttctcacaagactgggagtgagaatatttggattccgacattgttctactactatataatcaataatcaggaacaaggcaaggcaattccctctttctttctttctttctttcttcttcttttttttttttttttttttttggcagagttttgctcttgttgtccaggctggagtgcaatggtgtgatctcggctcaccacaacctccacctcccgggttcaagcgattttcctgcctcagcctcctgagtagctgggattacaggcgcgcgccaccacgcccggataattttgtatttttagtagagacggggtttctccatgttggtcaggctggtctcaagctcccgacctcaggtgatccgcccgcctcggcctcacaaagtgtgggattacaggcgtgagcaacagcacctggccccccctctcattttttaaacggttaaaatgaaggtgttagaccgtctctaaggttctatacaatcaaaaatttattaaaataggtctatatattttacaacaattttgactttctgaatcttgcatcatggtgtctagaacatatgtgttcaattaatactgaattaattaaaatttatatacactgatgtaaatattttctaagtaaaatctttcatatgtatttaaataaaatttacctttttgccttcaataactgattttcccatgtgcaataacgtgtgagtcagtgcccaaaagagtcacttgaaagttgcaaggcaaagcagttttttaaaaattatctaagattatcaaacaccggtccatgaacactgttgcattaattcagtgtcttaaaatggatttttaattatcagggatatctagagcaaagaaatctaacagggaaattttgaaagatgaaacaattttctatgaaatcagtgtattgtgtgcatcaatgtggtgcagtaacttagtaaggactcacagcgccgctgttcaccaaccagggaaaaatggtgcgagagatcccacagaaaccaccgagttttacagcacagagaaacgacagattgcgataagccctcttccaggctgcactaaactcaagcctctatcctgctggattctgagctccccttcctaagacagaggggtccacccggatacacccgcattctgaagcacttcccgagatcggcgcctaagcaagagaagcaggacgactatggcggctcagccgaggggcggggactacagaggattcttcctgctctccatcctcctggggaccccctgggaagcctgggcaggacgtattctctactccgtgtcggaggagacggacaaagggtcctttgtgggagacatcgccaaggacctggggctggagccccgggagctggcggagcgcggagtccgcatcatctccagaggtaggacgcagcttttcgccctgaaccagcgcagcggcagcttggtcactgcgggcaggatagaccgggaagagatctgcgctcagagtgcgcggtgtctggtaaactttaacatcctgatggaagataaaatgaatctttaccctatagacgtggaaataatagatattaatgacaacgttccaagattcttgacggaagaaataaatgtaaaaataatggagaatacagctcctggggttcggtttccgttaagcgaggctggggatccagatgtgggcacgaactccctccagagttaccagctcagccccaatcgccacttctccctggctgtgcaaagtggagacgatgaaactaagtacccggaactggtgctggagcgggtgctggaccgggaggaagagcgggttcaccacctggtcctcacagcctctgatggcggcgacccgccccgatccagcaccgcccacatccaggtgacagtggtggatgtgaatgaccacacgcctgtcttctctctgcctcagtaccaagtaactgtccccgagaatgtgccagtgggtacaagactgctcacggtacatgctatcgacctggacgagggagtcaatggggaagtgacatattcttttcggaaaataactcctaaacttccaaagatgtttcatctgaactcgcttacaggagaaatatcaactttagaaggattagattatgaagaaactgccttctatgaaatggaggttcaggctcaagatggtcctggtagtctgacaaaggcaaaagtactgatcacagttttagatgtaaatgataatgctccagaagtgactatgacgtctttaagtagctcaatccctgaagacacacctcttgggacagtcattgctcttttctacctacaagacagagattctggaaagaatggtgaggtgacctgcaccattccagaaaacctaccttttaaattagaaaaatcaatagataattattatagattggtcacaaccaaaaacttggaccgggaaacactctctttgtataacatcacactgaaagccacagatggtggaactcctcccttgtccagggaaactcacatattcatgcaggtggcagacaccaacgataacccacccaccttcccccactcatcctactcagtctacatcgctgagaacaaccccagaggggcctccattttcttagtgactgcacaggaccacgacagtgaggataatgcccagatcacttattccttggccgaagacaccatccagggggctccagtgtcctcctatgtctccataaactctgacactggagtcctgtacgcgctgcaatcctttgattatgagcagttgagagaactacaactaagagtgactgcacatgacagcggggacccgcctctcagcagcaacatgtcactgagcctgttcgtgctggaccagaatgacaacccgcccgagatcctgtacccggccctccccacagatggttctactggcatggagctggcaccccgctccgcagagcccggctacctggtgaccaaggtggtggcggtggacaaagattcaggccagaacgcctggctgtcatacctcctgcttaaggccagcgagccaggactctttgcggttgggctgtacacgggcgaggtgcgcacggctcgggccctgctggacagagatgccctcaagcagagcctcgtggtggccgtccaggaccacggtcagcctcctctgtcagccaccgtcacactcaccgtggctgtggctgacagcatccccgaagtcttggccgacctgggcagccttgagccctccgacggtccttacaactatgacctcacgttgtacctggtggtggcggtggccacagtctcctgcgtcttcctagccttcgtcctcgtactgctggcgctcaggctgcggcgctggcacaagtcacgcctgctgcaggcttcagaaggtggcttggcgaacgtgcccacctcgcactttgtgggcatggacggggtgcaggctttcctgcagacctattcccatgaggtctccctcaccgcggactctcggaagagtcacctgatcttcccccagcccaactatgtagacatgctcatcagccaggagagctgtgagaaaaatgattctttgctaacatccgtagattttcaggaatgtaaagaaaacctgccaagtattcaggtgagcccagcccttcctttatttccatgaggaatttatttgcatgatatttctctattattttgcaaaacaaatgttttgaaaatagggatttaaaaaactttatagaggtaaaaatgagtttaccagtttccttcagtggtgacactttaatatagaacacataggatatagtatttctttagtgaaagcctatggacaagattatgaatatgtggactatcacattttataatttccacctactttccaatctatgttccaacctactttcttaactcatatattttatacattggaatgaatcgagtctttcatattgcacaaggttagcaggaataaaacacacctcagctgtcttctcaggattctctttagcattcaaatatgtaaaaggttctgaaagatttcttccatgtgaagatttttttctgtggctgattctgcctccatgtacctcagcttggtggtcctaaaaaatcttgattgcttcttgacctatttacagtataatcatttattaatggggtggtagtagaaggttggatttatgcctaaagaatgaaatgtgtgtgtatcacacttcactaagatctatatcaaagacagacatcaagtctaatgccacactaaaggccatcggacaaaaccaataaaatatgtcaaataaaatgtcattttaagtgttgtaattggcatttgtgacataggcaattacatgttttaacagagaattccagtatgttgttttagtggtacagccagatgaagtgtgtctgtgggctatcaaagtgggagattggggatactggctttgtttcaactgtctcacgtactcaaaccttagaccatcttatgtacacagatcctagaccagtagttgattttatttattaggtctactgaaaaattcagttggaaataacccaatctgggattaactacttccatattcttttgtataacattttagtaaagctcagtatatcaagtgattgtcatccagaaggggtggatgacaaggtaatcttgattccagagacctttgagtattaattaaaaacacacttttagccaggtatggtgttgcaagctgtagcccacctgcatgggaggctgaggcaagaggacagcttgaacccaagaattggaggcccacctagataatataacaagactctgtctcttcaaaaaaagacttctttttagactagtgttgtatttggtagtattttgcacatgatagactctgtacaatagtgtgggggatacattttttttttttgacatggagtctcgctctgtcacccaggctggatacattttacaagttctgcagtgttcacatttcagatgtacaatcacttggggtagaagacaatgttgctgacaccaacaatgttactgagggaagatcctatggcagaactacggttataaggtattttgtaaaagaaaatctcctgaccaaaatttattagatgcataaaattgtttttaagcaatggagagacataatcactaaactcagtgagctattgcaatcaaactttccagggattgtttccttcaattcagaggtcaccaaggaatgtaaaataagtgcagaggtaggaagcagtgcttcagtgcagcagatctcagtgactttgtgttttgaggctatgtattatccccctgataactttgaagatgaatgttgtatttcataaccagtaaaataattgtgtaatgaggagaggagtaggctactgcctgtgatcatcgaaatgagaatcacataatattcctgtaatgaaatcactgaaactattgggaagggggtgtatttgaagataagtataaattgcaccttctaaaaggcaattttggtattactgatactctccggaaaaagttgaaataaatcaacttggaggtacttagaaaagtggagaaaatgttaggaacaatgaaagaaagataaaatgtatccagtatatttctaatgagtaagtatggaaaattactgtactctgagacggtttaggccaagtctgtgttatggctatctttatatagatagtgcatgtttgaagattggggaaagcttatgtcaataaatgtttatgtacttaatctacatgatttgcctaaaaatcctcaaagttgggatgaaggcattcctaagagtacatttttagacgtcattaaatatacagacgtatccacgtagtttttgttctttcagttaggcacacaattataattattgcactggttaacttgaagcagcagaggctgtagtttcctagtgctgactctgggcgccgctgttggccaaagtggagagcttggcgctccagatctcctcgcgcagccgcagcgcgctttccagggcagccccagctcagactccccagcgccagcctttacaccgcttcctcctcggaaaaagaagaattttttcttgaactggaactgcaactaaagtccgttcggagatccaaaaatctgcaatacagaggttatttgtaacccggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacacgatttatattaggatctgcccatgatgcggatattggtagcaacacactgcagaattaccaactcagtcccagtgatcatttctcactgataaataaagagaaatcagatggcagtaaataccctgagatggtattgaagacacctttggacagagaaaagcagaaatcctaccacttgactttgactgccttggactttggagctccacccctaagcagcactgcacagatacacgttctagtgactgatgccaatgataatgctccagtgttcagtcaagacgtatacagggtgagcctttcagaaaacgtgtacccggggaccacggtgctacaggtgactgccacggaccaggatgagggtgtcaatgccgagattactttctctttcagtgaagctagccagatcacccaatttgacctgaactctaacaccggggaaattactgttttaaatacattagattttgaagaagtcaaagaatattccatagttttggaagcaagggacggtggaggaatgattgcgcaatgcacagtggaggtagaagtcatagatgaaaatgacaacgccccagaagtgatattccagtctctacccaacctaattatggaggacgccgagctgggaacacatattgctttgctcaaagtccgtgacaaggattccagacacaatggagaagtgacttgtaaattggaaggtgatgttccatttaaaatattaacttcttcaagaaacacgtataaattagtgacagatgctgttctagaccgcgagcagaatccagagtacaatataaccgttacggcaacagatcggggcaagcctcccctctcctccagttccagcatcaccctgcacattggtgatgtaaatgacaacgctccggttttctcacagtcttcctatatagtccacgtggccgagaacaacccgcctggagcctctatttcacaagtcagggcttctgatccggacttggggcccaacggccaagtctcttactgcatcatggccagtgacctggagcagcgggagctgtcatcctacgtgtccataagcgcggagagcggggtggtgttcgcgcagcgcgccttcgaccacgagcagctgcgcgccttcgaactcacactgcaggcccgcgaccagggctcgccagcgctcagcgcgaacgtgagcctgcgcgtgttagtggacgaccgcaacgacaatgcgccacgggtgctgtaccccgcgctgggtcccgacggctctgcgctcttcgatatggtgccgcacgctgcagagcctggctacttggtgaccaaggtagtggcggtggacgcagactcaggacacaacgcctggctgtcctaccacgtgctgcaggctagcgagcccgggctcttcagcctggggctgcgcacgggcgaagtgcgcacagcgcgtgccttaggcgacagggacgccgtccgccagcgccttctggtcgccgtgcgtgacggtggacagccaccactctcggccactgccacgttgcacctggtcttcgccgacagcttgcaggaggtgctgccggatatcactgaccgccccgacccctctgacctccaggctgagctgcagttttacctagtggtggccttggccttgatctcagtgctcttcctcgtggccatgattctggccattgccttgcgcctgcgacgctcctccagccccgcctcctggagctgcttccagcctggtctctgtgttaaatccgaatccgtggttccccccaactacagcgaggggactttgccttattcctacaatctatgtgttgcacatacaggaaagacggagtttaatttcctaaaatgtagtgagcagttgagttcaggacaagacatactttgcggtgattcatctggggccttatttccactttgtaattccagtgaattgacttcccatcaggtgagtttcctttaagtataatttaatgctcattgcctacccatttctccatattcacaagaaaatatacatatttgcaggaaaatatataatttttagatgtcatggatcattttaggaaagttgtagtcagttaaaaagctgtcatatcattctacaaaggaggagtaaagtaggagcaattgtgtggcccaacatttgtttgttttttagccaagcttagatttataaagcaatgagggtgtggttttaaccacaaagtgaaagtgttagacagttgttggctctctcctaaaaagtgaatgagatttttcctatacattttccttcttgttgactaatatatgatgaatacttttttcagcttggatataccataaatataaaaataataaagccaaagaatttaagctaaaattcaacacttttcttaactaatttaactggtatggtctccatagtagtccactgttttgtttcctgtgttaacttcccttttgtttcaaaagctcttagaataaggagtcaactggatttttatgtccatggaccccttgtgattatatgcagtgtacgctgtgtgtgcgtgtgtgtgtgtgtgtgtgtgagagagatccttttacttagaaaaaggtctactatgctcattagaagatcaaaagcagattctccttacttgtaacataggagtttcaggattaatctgtattcaagctcattctatatccttcatcaaagaaaagacaatgttttgtgtctgttgtccctctcacacacagccctaatatataatgtgtaactgccttatctgcagccctaaactaatatagctagaggtcttctaatcattctcctacctctaggaaagaaatatagtcttgaaaactgccaatctggtgtgcatacaaaatatatacaaaataccaaggaacattatatgagccttttgctaggtatatctaagcaactgcttcagttaatggccactttacaaattgctgaaagaaggaaacgtctttcgattcttttttttttctttttttttttttgagacagagtctctgtctgttactcaggctgtagtgcagtggcacaatgatagctccctccagcctcaaactcctgggctcaagcattccttctgcatcagcctcctgactagctggaactcaggctcatgccaccagacctggctaatttttctgttttcagtagagaaaatattttctttcactaatttaactggtatggtttccattgtctacccagttttccatatgcataagaaaatatattcacaggaaaatataaagttttcagatttcatgagtggttttaagaaagttttagtcagtgaaaaaactatcataccagtcttcaaaggaagggtgaaataagttcatctgctacgttgcccaggctggtcttgaagggaaacagacttttttgtagtcatacttatcctttggcttcttagtaagtattatatagtcattactttttgcagttttttagatcaaagtgttaatgtaggtaaagttaattttagaatatatgtaaaagtcaagtctgctttaaatttaatcatctctttggtgaaagggatgggatggagctttgctttttatcatatattcatctgtacctttcaagtattcaaatagaaaaatataaacaatgtaaataaaatagcaaaacaatgtaatatctcataaaactgcaatggtaaaagcatttatcctattgaaattccacaatttttatttgaaaatattatcgacatgtaattcaagtggcatttagaagaataatttaaaagcaacaactctatagaaagcttgtaaaatgattaagtagtttaaaccaaataaaacaatttctgagtcagtcatctccagtaggtctattttagtctcaagataaattcatttctggtgacaactgaagttcttagttatttgttagtatatattggagacatttacaataaagcttagagcacaatgggaaatgaaagtatcatgttttttttaagaccaaatgtattgcagaaatgtgagtaatttaatccgatgctacaatctgatcattctgatctaatctgatcatttaataacactaaataaaaccttcatctcacattctttggctgtttcttttaaaatatgggtttacggataaatcaaataaattcaaaacaaagtaataagcaaatgatttttttttctcagtaatctagtagagtattacatttagaagtaatctgtatctcagtgcagtaactatttaggactgtaagcgccgctgttcacctactggaagacaaatgcaaccgaaaacactcagatctcacacctcacgaagacccgcagatgccacaaactaactgctggactgcagcgaaacccgacccctgtttggaggcactccaggtttccggaggattgtcatctccatagctgcggcaagaaactaaataagacccatttatgcacagtgaagattctgagaggattctgcagcaaaacaacaatggccgctccacagagtcgccccagacgcggcgagctgatcctgctgtgcgcgctgctgggaacgctgtgggaaatcgggaggggacagattcgctactctgtgccagaagagacggacaaaggctccttcgtgggtaatatctccaaggacctggggctggacccccggaagctggcgaagcacggagtccgtatcgtctccagaggtaggacgcagctctttgctctgaacccgcgcagcggcagcttgatcaccgcgggcaggatagatcgggaggagctctgcgctcagagcccgcggtgtctgataaatattaacaccctggttgaggataaaggaaaactctttggggtagaaatagaaataattgatattaacgataataacccaaaattccaggtcgaagatctagaagtaaaaattaacgaaatcgcggttcctggagcacgttatccactcccagaagctgttgacccggatgtgggcgtgaactccctccagagctaccagctcagccccaatcaccacttctccctggacgtgcagactggagacaatggagccataaacccagagctggtgctggagcgcgccctggacagggaggaagaggctgctcaccacctggtcctcacggcctcggatggcggcaagccgcctcgctctagcacagtgcgcatccacgtgacagtgttggatacaaatgacaatgccccggtttttcctcacccgatttaccgagtgaaagtccttgagaacatgcccccaggcacgcggctgcttactgtaacagccagcgacccggatgagggaatcaacggaaaagtggcatacaaattccggaaaattaatgaaaaacaaactccgttattccagcttaatgaaaatactggggaaatatcaatagcaaaaagtctagattatgaagaatgttcattttatgaaatggaaatacaagccgaagatgtgggggcacttctggggaggaccaaattgctcatttcggtggaagatgtaaatgacaatagaccagaagtgatcattacgtctttgtttagcccagtgttagaaaattctcttcccgggacagtaattgccttcttgagtgtgcatgaccaagactctggaaagaatggtcaagttgtctgttacacacgtgataatttaccttttaaattagaaaagtcaataggtaattattatagattagtgacaaggaaatatttggaccgagaaaatgtctctatctacaatatcacagtgatggcctcagatctaggaacaccacctctgtccactgaaactcaaatcgctctgcacgtggcagacattaacgacaaccctcctactttccctcatgcctcctactcagcgtatatcctagagaacaacctgagaggagcctccatcttttccttgactgcacacgaccccgacagccaggagaatgcccaggtcacttactctgtgaccgaggacacgctgcagggggcgcccctgtcctcgtatatctccatcaactctgacaccggtgtcctgtatgcgctgcaatctttcgactatgagcagatccgagacctgcagctactggtaacagccagcgacagcggggacccgcccctcagcagcaacatgtcactgagcctgttcgtgctggaccagaatgacaacgcgcccgagatcctgtaccccgccctccccacagacggttccactggcgtggagctggcgccccgctccgcagagcgtggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagatgcgctcaagcagagcctcgtggtggccgtccaggaccatggccagccccctctctccgccactgtcacgctcaccgtagccgtggctgacagcatccccgaagtcctgaccgagttgggcagtctgaagccttcggtcgacccgaacgattcgagccttacactctatctcgtggtggcagtggctgccatctcctgtgtcttcctcgcctttgtcgctgtgcttctggggctcaggctgaggcgctggcacaagtcacgcctgctccaggattccggtggcagattggtaggcgtgcctgcctcacattttgtgggtgttgaggaggtacaggctttcctgcagacctattcccaggaagtctccctcaccgccgactcgcggaagagtcacctgatctttccccagcccaactacgcagacatgctcatcagtcaggagggctgtgagaaaaatgattctttgttaacatccgtagattttcatgaatataagaatgaagctgatcatggtcaggtgagtttagttctttgcttgcttttaatttccagatgaattttatttggcataaattatgttttgaaaaacattgtgaagatagttgaaaataatttttaaggtgtatcacagagttttgggtttattttggtggtgttactataaaattgaactctaatagtcataggttattgtttcatttgcttttaaacgacttggaaaagattgttcaaccattttaagccttccagtattttattcctattatcactcattcacttaagaagtagctacccgtccatactggtaattttgctattgtttgtttgtgtgtgtgtgtgtgtgtgtgtgtgtgtgtgtgtgtgtgtgtatcccaaactagaacttcagaaaattatcaagaagtctaaagccttgttattagcttagcaaaagtaaaatatatctcagaatttttagggttatgtttagcatttgaacctgtaactaggctcttgtagatttcttcactttaaacctcttttctgagccctgtttctgtaccagtgcccttcaaaactttaatacttcttaccatccttcaaaacatgaacaaactttaaagatggatcttggtgggagatgagactggttactaaatattaagtatgtgagtcagtggtcacctgggctccatgcccatggagacatgaaatctaaagcctagaatgtccattgctcccccaaacaaaaaacaaaagcaaaaacattagatctgaattaaaatgtaattttaaactgttgaaagtgacttttgtaaaatatgtaagaacatatttcaatacaattccaattagctgtttcggttgtgcattgatgtgaagtggtgagaatgttgatattaagaaccaatgtttcaggtacacaagttctaaataagctgatcaattcaattaaagttattcagtcttggctggacacagtgcctcatgtctgaaatcccagcactttgggaggctggggcaggaggaccgcttgagccccgggggtttgaaactgcagtgagctatgatcatgccactgcactccagcctaggtggcagaactagaccctgtctctaaaaaaactattattaggccgggtgcggtggctcacgcctgtaatcccagcactttgggagactgaggtgggtggatcacctgaggtcaggagttcaagatcagcctggcaaacatggtgaaaccccgtctctactaaaaactacaaaaattagccaggcatggtggcatgcgcctgtggtcccagctactcgggaggctgaggcagaagaatcacttgaacccgggaggtggaggttgcagtgagcctcgatcctgtcactgcactccagcctgggcaacagggtgagactccgtctcaaaaaaaaaaaaaactaatattaatagtaaaaactcggtataggctatccattattgtattcctgcataccttcttgtagcatttgaataaagctaatacctgaattgattgttgtaaggtagaagtagatgacccaataaatgtttgttattaatgaaaaggacatttcctaaggattgtgtagtgttctactgtatggtgcatattcagtggagtgggagttaacttcatagtttgtgtaccatttggatgcacatttgagaggacaacatattattggcactttgcaattttaaaaactcggatgaaagttgccctggtaggaaagaaaatccttactctccctaaaaatgttggctagttgtttttattaatctgacaaatggactaaagaaggttgaccaatgtccacaaatttatgtaaatgaacttatgagcttcatttatccaattccaaagtcatttcagataggataataatgcaatccactagaatatccctttgtaccttgtattgcagaatagataagcatttccccaataactcttaagaatgaatttatgtactgtaaaagatatgacataagagaagtattttgagatatgaagaagagcaacgtagtagggtatatcatttcttagctacatcatatgggcagtatacttgaatgaatatttcctgaagtagaagagtaaagaaaaattatttttataaagaatgttaatatagtcaggaagaggagatgtttggggattggtataaaattgccacaactttacaaaatagttttaaatagtatagatttccctaatatgtgtaatataaaacactagaaatattggggagttggaaatcatagaaatgaacagaagaatgataaaattgtttccatagctaataaaaaatgaatttttgaaatcagtatagtatgaaggctctgagagcaagaactgtatcatattaattattatattgccagtgacaagggcaatacttagttctagctaagagttcaaggtatgtttgcagaatggtgaaagaatggaccaatgtatgcaggtttgtataaaaacccaacgtgatatttctaacaatttggaaaacagagaaagataccttaaagaagttgttataattttttattaagtatatggacgtaaaaacttggcttgttaagttaggcacacaaaaacaattactgcactggttaacttgaagccgcagaggctgtagtttcctagtgctgactctgggcgccgctgttggccaaagtgcagagcttggcgctccagatctcctcgcgcagccgcagcgcgctttccagggcagccccagctcagactccccagcgccggcctttacaccgcttcctcctcggaaaaagaatcgtttcctaaactggaactggaactaaagcccgttcggagatccaaaaatctacaatacagaggttatttgtaacctggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacaagatttatactagaagtagcagaagatgcagatattggcttaaactctctgcagaagtataaactctctcttaacccaagtttctcattaataattaaggagaaacaggatggtagtaaatacccggaactggcactggagaaaaccttagaccgggaacaacagagttaccatcgtttagtcctgactgccttggacggtggacatccacccctaagcggcaccactgagctccggatccaggtaaccgacgccaatgataatcccccggtattcaaccgagacgtgtacagagtcagccttcgggaaaacgtgccaccaggcaccactgtgttgcaagtgtcagccactgaccaagacgagggcatcaactcagaaattacttattccttctacagaaccgggcaaatctttagtctgaattcaaagagcggagaaattaccactcaaaagaaactggattttgaagagaccaaggaatattcaatggttgtagaagggagggatggtggtggactggttgcacaatgtacagttgaaattaatattcaagatgaaaatgacaatagcccagaagttacattccattctctacttgaaatgattctggaaaacgcggtgcctggaacactaattgctttgatcaaaatacatgaccaagattctggggaaaatggggaggttaattgtcaattacaaggcgaagtcccttttaagattatctcttcatccaaaaattcgtataagttggtaacagatggaaccctagaccgagagcaaaccccggagtacaatgtcaccatcacagccacagacaggggcaagccgcccctctcctccagcataagcgtcatcctacatatcagagacgtcaacgataacgctccggttttccaccaggcgtcctacttagtcagtgtacccgaaaacaaccctcctggggcctccatcgcgcaagtctgcgcctcggacctggacttggggttgaacggccaagtctcctactctatcatggccagcgacctagagcctctggcactggcctcttacgtgtccatgagcgcgcaaagtggggtggtgttcgcgcagcgcgcctttgactacgagcagctgcgcaccttcgaactcacactacaggcccgcgaccagggctcgcctgcgctcagcgcaaacgtgagcctgcgcgtgttggtgggcgaccgaaacgacaacgcaccgcgggtgctgtaccccgcgctgggtcccgacggctctgcgctcttcgatatggtgccgcgcgctgcagagcccggctacctggtgaccaaggtagtggccgtggacgcagactcaggacacaacgcctggctgtcctaccacgtgctgcaggctagcgagcccgggctcttcagcctggggctgcgcacaggagaggtgcgcacagcgcgtgccttgggcgacagggacgcggcccgccagcgcctgctggttgctgtgcgtgatggtggacagccgccactctccgccaccgccacgctgcacttggtctttgctgacagcttgcaggaggtgctgccggatatcactgaccgccctgtaccctctgacccccaggctgagctgcagttttacctagtggtggccttggccttgatctcagtgctcttcctcctggccgtgattctggccgttgccttgcgcctgcgacgctcctccagccctgccgcctggagctgcttccaacctggtctctgtgtcaagtctggacctgtggttccccccaactacagtcaggggactttgccttattcctacaacctatgtgttgcacatacaggaaagacggagtttaatttcctaaaatgtagtgagcaattgagttcaggacaagacatactttgtggtgattcatctggggccttatttccactttgtaattccagcgagtcgacttcccatcctgagttggtgagtttcatttatgtctattctttttcattacccacccaattttctgtatttacatgaaactatcgtacattttcaagtccaatgagttgtcttagggaagtcagagctgctcagaaagctgtcctaccattctttaagaggagcagtaaattgtgagtttttatgtcgcataaaagaagtagccttatagatttacaaagtagtgagagtttgctcttagcttcctctctagcaaaaacatttggtgcgtttttttgtcctctttctcaaagctaatgaattttacctattcgttgtctcattctttaacatgtttatattttattgtatgtagataaaccattaaatttaatgtatgtaatcatttaattcatcttttaaagcaaagaaactgctagtagatgtctttcttcactgatttcactggtagttttcatctctttcttatgttcctcatatatgctttcttattcctacctaatggatttatgattttttgaatctcctaaaattttattaaaaatactatatgttggctgggtgcagtggctcatgcctgtaatcccagcactttgggaggccgaggcggttggatcacatggtcaggagttcaagaccagcctgggcaatatggtgaaaacccgtctctactaaaaatacaaaaattagctgggtgtggtggcgggcgcctgtaatcccagctactcaggaggctaagacaggagaattgcttgaacctggcaggtggaggttgcggtgagccgagatcactccattgcattccagcctgggcaacaagagcaaaactccatctcaaaaaaaaggaaggagaaggagaggaagaagaagaaaaatactacatgttatgtgtatgagagagaaagagagagactgattcactgaacttagaaggtccaaatcatccaaataattttctaagtttatccaggttttcttggatgcaaaatccttttccacctctatataattaccagaagaaacttacaaaaaaaaggaaatgctattgcctgaatttctcttgctcggaatcctgacatattcttgaagaaggggaaaaagacaccggatttgtcttatcgtttggagctttaaatataaatgactggatgttttctcaacatccttgtaggatggaaggtgaatacaggattattccatttttaagacaaaaactactagtcttgtgtacatacaaagctcccattacatggtataagtcttttgcttggtttcccttagtatgtgattcagtaaatgggttccttacaaagtgctgagatttcttataataccacttacttttaacctttcagtagttttctttgttgtatattttgtgttctttttcccaaattattatataagtttaagtgatgcttagaataatgtttaagaccactttaaaattgcataatttattgatgaaggattaaaatagaaacttgcttttcagtgtatatgcatttgaatcattgaaacacagtctgtgcatgcattacatattcacattaaaaaactaagcatttttgaaatagcagaaaagtttaagcaattacaaaaatgtgaaaatttccaactttaatcctgttaatatttagcaatattaggcgagaacatctgtaactattgctgaattaatattacttttataatacaaaaatttaaaataaacgtttttccaggaattttatcatcaaaataaaccccagaaaataatttcaaagtggataatctatccttatatatgtattaatacaattatatattttacatttacaaatatataggtataaaaattaaaaatgaatgtacttccaaacaagattgcacataaaaattacttcagaaaattgttaagatacacagaaaaaattgaagcatcataaaaaggaaattataatagtttacatatctagaaatagagtgcaaagttctaccaagaataagaataaattaatattaagcaatggtttgtgattttataatacacttacagaaattttattccactttatttacaactcagatatctaaaaaatagattgcttttgaaatacaaatgcaagaaacaattggagaaatctaaaatcataattagaagagagtagtgttttctttatcagccatctgatataatgttacacatcagtgggtgtagtaacggcttaggactctgagcgccgctgttgatcaactctaagcgaaaatcaggactccatccggatttccagttctgcggctacacaaaacccggcagataccacaaacctgctcccaggctgcagcaaaactcagcctctttcttctaaggaaaagatcaccatactttgcagggtggaagaaagaacctgatgaagcagcgcgcacagagatccttttgagaaaattccaaagcgaggcagcaatggcagctccaaccaaatgccagctccgcggaagattagtcctgctatgctcgctcctggggatgctatgggaggccagggccagtcagattcgctactcagtgcctgaagagacagaaaagggctatattgtgggcaacatctccaaggacctggctctggagccccgggagctggcggagcgccgagtccgcatcgtctctagaggtaggacgcagcttttctctctgaacccgcgcagcggcaccttggtcaccgcgggtaggatagaccgggaggagctctgtgctcagagcccgcggtgtctggtgaactttaaagtcctggttgaagacagagtgaaactgtacggaatagaaatagaagtaactgatattaacgacagcgccccaaagttccaggccgaaagtctggaagtaaaaattaacgaaatcgcggttcctggagcacgttatccacttccagaagctattgatccggatgttggcgtgaactccctccagagctaccagctcagccccaatcaccacttctccctgaacgtgcagactggagacaatggagccataaacccagagctggtgctggagcgcgccctggacagggaggaggcaactgcccaccacctggtcctcacggcctcggatggcggcgagccgcgtcgctccagcacagtgcgcatccatgtgacagtgttggatacaaatgataatgccccggtttttgctcaacggatttaccgagttaaagtccttgagaacgtgcccccaggcacctggctgcttactgcaacagccagcgacctggatgagggaatcaacggaaaagtggcatacaaattctggaaaattaatgaaaaacaatctctgctattccagcttaatgaaaatactggggaaatatcaacagcaaaaagtctagattatgaagaatgttcattttatgaaatggaaatacaagctgaagatggtgggggattgaaagggtggacaaaagtgctcatttcggtggaagatgtaaatgacaatagacctgaagtgaccattacatctctgtttagcccagtgagagaagacgcacctcagggaacagtaattcttcttttcaatgctcatgaccgagactccgggaagaatggtcaagttgtctgttctatccaggagaatctatcttttacattagaaaattcagaagaagattattacagattgttgacggcccaaattcttgaccgagaaaaagcctcagaatataatatcacggtgactgcaacagacagaggaactccgcccctgtccacagaaattcacatcaccctgcaagtgactgacatcaatgataatccacctgctttctctcaagcctcctactcagtctacctcccggaaaacaacgccagaggtacttccatcttctccgtgattgcctatgaccctgatagcaatgagaattctagagttatttactccttggcagaggataccatccaagggtctcctctctccacctatgtctctattaactcagacactggtgtgctgtatgctctgtgctcctttgactatgagcagtttagagatttgcaaatgcaggtgacggcaagtgacagtggaagcccaccacttagcagcaatgtgtcattgagactgtttgttttggaccagaatgacaatgccccagaaatcctgtaccctgccctccccactgatggttctactggtgtggagctggcaccccgctctgcagagcctggctacctggtgaccaaggtggtggcagtggacagagactcaggccagaatgcttggctctcctaccgcctattcaaggccagtgagccagggctcttctcggtggggctgcacacaggtgaagtgcgcacagctcgggccctgctagatagagatgcgctcaaacagagccttgtggtggctgtacaggaccatggccagccccctctctcggccactgtcacgctcacagtagccatagctgacagcatcccagacatcctggctgacctgggcagtcttcagatccctgcagacctggaggcctcagaccttaccctctacctcgttgtggctgtggcagtcgtctcctgtgtcttcctcaccttcgttatcacgctgctggccctcaggctgaggcactggcactcctcgcatctgctgcgggctaccagtgatgggttggctggtgtgcccacctcacactttgtgggtgtagatggggttcgagctttcctacagacctattctcaggagttctccctcaccgctgactcaaggaagagtcacctgatcttcccccagcccaactatgcagacacactcatcagccagcagagctgtgagaaaaatgagcctttgtgcgtctctgttgattccaagtttcctatagaagacacccctttggttccggtgagttcattttttttctttctttcttttctttttttgttttttgttttgttttgtttttgagacagagtcttactctgttacccaggctggaatgcagtggtgtgatctcggctcattgcaacctccgcctcccaaattcaagcgattctcctgcctcagcctcccaagtagagtagctgggactagagtagagtagctgggactacaggcctcccaagtagaataactgggactacaggcacgtgccaccacgcccggctaattttttgtgtgtttttagtagagacggggtgtcaccatgttggccaggctggtcttgaattcctaacctcaagtgatccacccacctcagcctcccaaagcactgggattacaggcgtgagccactgcgcctggcccttaactttctattatagttagctttctctttaactgtctgtacttaaggtagtataagttgatatcagtgtgtttctcatcacttttcactgggcctaattgttgctccaacactgaaaggaggcatttattagttatatttgctgatataactttcatgttctcataataattaacctgctgtcaacgtaaaccatacttcatggggtagctctcagcctgcattgatgtgggctttttgggtagggttgcttcattggttgcagtggactcatatcataaaattcttactcctttttttttttttttaagagatgggggtgtcattctgttgtccagggtggaatgcagtggtgtgggtaaagcttactgcagtctcaatctcctgggcttatgcaatcctcccacctcagccttcacagtagctaggactgaggtgggagggctagcaagctatgttgcccagactggtctcaaacgatcttcctgcttcagtttcccaaagcactgggtgaggtgtgaaccacctcacccagcaaattcttactcctacgatcatttattcaggtcatactatgtttgtaagggtaaactgataaaaaggtaaatgtattcttcttagagaaacagctgaaagcccagatttattgcttctattcttccatttctatgacaggaaaacacctctttgaggttatatttttcagatcacaagtgtgtaaagtctgtttgtgtttacagatattttctgacgaagattcaaacttcagttatccacttccaaaccctagtaaaccaattttttccctttaatggtgaaagttgtcacatcttttattctcatatcttcaaaggtcttaatttcctaatgctttaatgttaaattatggagaatagtaggacattcttcttttctatagtatatgcttgctcaagagaagtttctaagactggacactgtgaaatgacaaaacaaggaattaaaaatatttctctcacttatatattatttctggctcaattctccaacttttgagtctagaaatgaacttgcatatcagatataatttaagaaaatattctcaggaactgctgggaagattctaaaactattttactgtttttagctataaggaagagaataatgtattatttaatgttattttaaacatagtgttgtttcaaatagtaaataacatttcacaagacatttgaaaataagctttgaagttgactcaaaattctatgctaaacatgtgatccatagatacactgatgactgctggcatttctgtggaaatgaagaattgttttatttgtttgtaattatttgggtttcagttgctttatttttaagaaaaaaaagctgaagtgtctgggaatcctttatgacatacagacattttaattatttcaaacacgttttcccccttaagtgggtagcaaaaaaaataaagcatacttcaggctcatatttttaaccatgcaacaagaaaattgttacaatttctgttctgaggagtagccttcatacttagtatttataaatattgaaatgtatgttaatttggggaaaacataacagatatccatgaaggcttgtatgtcatggtaggtagttactattcgataccacaaaaatgtctcttgcccttaaaaccagaacacgaggctcaccagacagatgactgaatggagtatggaaaatctttatttctgtttttcttaggctatgtaggacttaacttattgtgcattggtaacagattgtagaacataagctgaaagataaaattcttgaccttaatgtctcatcttaaaaagaagcattggttgacattctatatctcgtattacttaaaaataatgggggagcgcagtatatattaaacaaagattggctttgtggtgatcattgttgaaggtggggtgatggctatgtgaaggttcactatatatactccctactgttgtataagtttgaaattgtgcataatagatttatttaaaacacaaagcatagaaatatctactataatattatggtgagagcaaaatttgagggggatgtacacctgcattttcgaagaatatatacatttcggagaccgaattcaaaatgaaaaaccgggctgctgtcccgcacggagcctctgggcgccgctgtcggccagtgcagagcaagcgctgacgccggggatccgtcagcctctggcctgggattccctgcgcagccaacaacagaaagaagaaaaccagctcccacacagagcctcccggctgcgcagacctttcccagcacagcggattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtgctatttcctttgctgctgcctttgttctaccccaccctgagtgagccgatccgctactcgattccggaggagctggccaagggctcggtggtggggaacctcgctaaggatctagggctcagtgtcctggatgtgtcggctcgcaagctgcgagtgagcgcggagaagctgcacttcagcgtagacgcggagagcggggacttacttgtgaagaaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaatttgataaaaaggaaatacatttagaaattttcgaatctgcatccgctggtacacgactatcgcttgaccctgccacggatcctgatataaacataaactcaattaaagattataagataaactctaatccttatttttcattaatggttagagttaattccgatggtggcaaatacccagagttatctctggagaaactcctagaccgggaagaacagagatctcatagcttgatattgactgccttggacggaggggacccaccaagaagtgccaccgctcacatagaaatttctgtcaaggataccaatgataaccccccggttttcagcagagacgaatatagaattagtcttagtgaaaatctgccccctgggtcccctgtgttgcaagtgacagccactgaccaggatgagggggtcaatgctgagataaactactacttccgaagcactgcccagagcacaaaacatatgttctcattggatgagaaaacaggtatgattaagaataaccagtcatttgattttgaagatgtagaaaggtacaccatggaagtggaagcgaaggacggaggtggtctctctacccagtgtaaagtaatcatagaaatccttgatgaaaacgacaacagcccagaaataatcatcacttctctctctgatcagattttggagaattcacctccaggaatggttgttgccctcttcaaaacacgggatctggatttcggaggaaatggagaagtcaggtgtaatatagaaacagacattccattcaagatttattcttcttccaataactactacaaactggtgacagatggagccctggaccgagagcagacaccagaatacaatgtcaccatcgtagccactgacaggggcaagccgcctctttcttccagtagaagcatcaccttgtatgtcgctgacatcaacgacaacgccccagttttcgaccagacgtcctacgtggtccacgtggccgagaacaacccgccaggagcctccattgcgcaagtgagcgcctctgacccggatttggggctcaatggccacatctcctactctatagtggcgagtgacctagagcccctggcggtgtcgtcatacgtgtcagtgagcgcgcagagcggggtggtgttcgcgcagcgcgcctttgatcacgagcagctgcgcgccttcgcgctcacgctgcaggcccgcgaccacggctcgcccacgctcagcgccaacgtgagcctgcgcgtgttggtgggagaccgcaatgacaacgcaccgcgggtgctgtacccagctctgggtcctgacggctccgcgttcttcgatatggtacctcgctctgcagagcccggctacctagtgactaaggtggtagcggtggacgccgactcgggacacaacgcctggctgtcctaccacgtgctgcaggccagtgagcccggactcttcagcctggggctgcgcactggggaggtgcgcacggctcgagccttaggcgacagggacgcagcccgccagcgcctgctggtcgctgtgcgtgacggtggacagccgccactctctgccaccgccacgcttcatctggtcttcgcagacaacttgcaagagatactgccagacctcagcgaccgccctgtactctctgacccccaggctgaactgcagttttacctggtggtggccttggccttaatctcagtgctcttcctcctcgccgtgattctggccattgccttgcgcctgcgacgctctctcagccctgctacttgggactgcttccatcctggtctctgtgtcaagtctggacctgtagttccccccaactacagtgaggggactttgccttattcttataatctgtgcattgcacatacgggtacaaaagagtttaatttcctaaaatgcagtgtgcccctacattccaatgaagacatggtttgcagtgtttctcctggagccttaattccacctcatggtggggaggatttgacttcacatcctgagactctgacttcggtgagtttctcttttttgtgtgtgatttatctaatagtctactagtttctcatattttaggcatactactttattttcatatctagaatcatatgtttaaaatccatagctttttacaatattttctcaatgttttttcaattatagttttcactatgtatttggttcataagttgctctatctttttgtaaaataatgtcaccagactgaagatattttgtctttgtcttttttttttttttttttttttgagatggagtctcgcactgttgcctaggctggagtgcagtggcgtgatctctgctcactgcaacctccgccttctgggttcaagcgattctcctgcctcagcctcccaagtagctgggattactggtgcccctcaccacagctaaattttttgtatttttagtagacatggggtttcactatgtcgaccaggctgttcagaaactcctgtcctcgtgatcctcccaccttggcctctcaaagtgctgggattacaggcgtgagccacaatattttgtcaagttctgactatcgaacagaagcagtggtcttggcatctaagaaaacaaacaagtaacctatctattcaaatttgcgaagacttagtgaatttacgatatcttatttatatatttttaaagcctaaaaatattcagaagacaggcccagtggctcacacctataatcacagcactttgataggctgaatcggaaagtatcacttgagcccaagaattgagaccagcctgggcaatatagggagaccccccatctctactaaaacaacaacaacaaaaaaaaacattagcagagtgtggtagcattcccctgtggtcccagctacttgggaggctgagctgggtggattgcttggtcctgggaggtcaaggttgcagtgagccctgatcttgccactgcactccagcctgggcgacagagtgcgaccctgtctctaaaataaataaataaatatgcaggcagggccaagtgtgctgtaatcccagcactttgggaggtggaggtggagaatctcttgagcgcaggaatttgagaccagcctgggcaacacagggagactccatcgctacagaacatttaaaaattagcagggtgtggtggcacatgcctgtggtctcagctactctggtggctgtggtgggagaatcgcttgagcccaggaagtctaggctgcagtgagctgtctaggtgacagagtgagaccctgtctcaaaaaaaaaagacatttctaagaaataaatgaaatactattgcctttgcactcagtctctgtctctgattctctgatagaagatttttgaagaaaaaagataaaatctttgaagagttctatacttggaaggcatagtgacataaacacttctgaacatcctgttctctgtgtgaaagaagtgaacttctataccctttgcatttgagggaacaattgctactgggttgatgggcacacacagttgaagatatgtgaaccactggactttggcctctgatacaaactgcctaagagaagagattatttatactggtattaatgctctgatgaaaacaggtcatttgacataaacacttacttgttaaaaacctatatcactacatctaactttgttttctaaaacttttagtacttcaaattctacgtatttcttttctcattacaatgcaaacagtttaatttgcaactgtaatatatgttcattttagtttgtgattacctgcttaatcatttaaataggtccatttaacttgtatccctgtaagataaagtatgttttacacaaaaaggttaattaaggctcagtaaaactattctagaagagtactttaaaaacctcttacacaatcctaagctaaataagtttaatgaattaagtagttacaattataaagcttcagagtgaattatctcatgagtttatttaatataatctttgtatgaatgtatactaaataaaattggcctattcaaatcacaattttaaattataagacttttctgaatttacctagacactaatatgacctaaaataagtattatttaccttttattaaagtgtgtacatttctgttgggaaaacgtgttgcaaatatatatttaaccaaacattatcttgaaatatttacaatattttcactccactttatcacacctcccctaagaaacctacatatagtaaattatttaaagataggagtggagaaaccaaagaatctatgtaaaatataataatccaacagaatagtttactttccattgcatgtatcacttgggtgcagtaacttcttaggactctgagcgccgctgttcacctactaggagagaaaacgcagccagagctcaatccggattctcagggcttcaactacacaagccccacaaaccggctgctgggctgcagggaagctcactccagaatttaaagtgcccaggctacagagacaccctgaagccacagaaagacaaaggaaccggttgaaacacacaacgtgtccagtgaggactttgcagaattctgtaaccagactacaatggccgctcaaaggaatcgctcaaaggaatcaaaggattgcagcgggctggtcctgctctgccttttcttcgggattccatgggaggctggagcccggcagatctcctactcaattcctgaggaattagagaaaggctctttcgtgggcaacatctccaaggacttgggtctggcgccccgggagctggcggagcgcggagtccgcatagtctccagaggtaggacgcagcttttctctctgaacccgcgcagcggcagcttgatcaccgcgggcaggatagaccgggaggagctctgcgctcagagcgcgcggtgcgtggtgagttttaatatccttgtggaagacagggtgaaactttttgggatagaaatagaagtaactgatatcaatgacaatgctccaaaattccaagcagaaaatctagacgtaaaaattaatgaaaatgtcgctgcgggaatgcgttttcctctcccggaagctattgatccggatgtgggcgtgaactccctgcagagctatcagctcagccccaataagcacttctccctaagagttcagagccgtgccaatggcgtcaagtacccggagctggtactggagcactccctagatcgcgaggaagaggccattcaccacctggtcctcaccgcctccgacgggggtgaccctctccgatctggcactgtccttgtcagtgtgactgtcttcgatgcaaatgacaacgcgccggtcttcaccttgccagaataccgagtgagtgttcctgagaatttgcctgtgggcactcagctgctgacagtcacagccaccgacagggacgaaggtgccaatggagaagtgacatattcattccgaaaattacctgacacgcaattgttgaagttccaactaaacaaatatactggagaaataaaaatatcagaaaatctagattatgaagaaaccggtttctatgaaatagaaatacaagcagaagatggaggagcatatcttgcaactgcaaaagtgttgattacagtagaagatgtaaatgacaacagtccagagctgaccatcacgtctctatttagtccagtgactgaagattcacctctgggaacagtcgtagcccttttaaatgtgcatgatttagactctgagcagaatggacaggtaacctgttccattttggcgtatctaccatttaaattagaaaagtccattgacagttattacagattggtgatacacagagcccttgacagggaacaggtatcctcttacaatatcacagtgacagccacagatgggggaagtcctcctctatcaacggaagctcactttatgctacaagtggcagatatcaatgacaacccacctaccttctctcaagtctcctactttacctatatcccagagaacaacgccaggggtgcctccatcttctcagtgacagcgctggacccggacagcaaagagaatgcccagattatttactccctggctgaagacaccatccagggggtacctctgtcctcatacatatccatcaactcagacactggcgtcctgtatgcactcagatccttcgactatgagcagtttcatgagctacagatgcaggtgacagccagcgacagcggggatcctccactcagcagcaacgtgtcgttgagcctgtttgtgctggaccagaacgacaatgcgcccgagatcctgtaccccgccctccccacagacggttccacaggcgtggagctggcgccccgctccgcagagcccggctacctggtgaccaaggtggtggcggtggacagagactccggccagaacgcctggctgtcctaccgtctgctcaaggccagcgagccgggactcttcgcggtgggggagcacacgggcgaggtgcgcacggcgcgagccctgctggacagagacgcgctcaagcaaagcctcgtagtggccgtccaggaccacggccagccccctctctccgccactgtcacgctcaccgtggccgtggccgacagcatcccccaagtcctggcggacctcggcagcttcgagtctccagctaactctgaaacctcagacctcactctgtacctggtggtagcggtggccgcggtctcctgcgtcttcctggccttcgtcatcgtgctgctggcgcacaggctgcggcgctggcacaagtcacgcctgctgcaggcttcaggaggcggcttgacaggtgtgtccggctcgcactttgtgggcgtggacggggttcgggctttcctgcagacctattcccacgaggtctctctcaccgcggactcgcgaaagagtcacctgatcttcccccagcccaattatgcggacacgctcatcagccaggagagctgtgagaaaaacgatcctttgtctttgttagatgattcgaagtttcctatagaggataccccattggttccagtgagttttattttcatttttacttttgttaaaaaaaaaaagattggtttttactttgaagtttgcggcatgatggtggaaagtgtaaatgctaaaacactgatgagtagaatttgatgtttattaaggttttttttttttttttttttttttttttttttactttctggtaaaattcacctagtctcaatcaaggcctatatatcataaggctttgttatgattagctttgcagaaccttgtagtttatagtgttgttgagtacaatattgacaattcctaagacagacttccatacagaagtgcctgtcaatttatatttcctcctgggtggtcacatattgaaactccagccccttaagcaaccctcttgttctgaaggcaggtctggtaagaataggtaagtatcagaaagaaatcacctctggaaacacaacccaaatccaagaatactcaatgcagttcttcccaaggagaagggcaataggcctttttcaaactacattttatatatttttcaatctatactttgtggtgatagttgcagttgaatatactaagtttttcattaatattgaattaacaatttatttataacaatgtatgcttagatttttccagccctatttataactgataacactgcagtatcctttttgcatacaattctctaatttcacactgctatgtggaagatatagcattttaatttaactttcattgctcaatagggatcctgaggaggctatagagggtgaaattaagaatatttgggattctgcttttgtcttttttgttaaattttctagtgactaaggctgaaagtaaatatgggttgggaagacagataaatttgtacatgttcccgagaacaggagcaagagatatatgacaaagctatttcagtggctctttaatgtataaggaggcaaacacctgaaactctgaaaactctgaaattgagaggcaaaataaacttagagtcaagaaagaaatgccatttctgcagatcagaatataaacaccaaccacagctgtaaaaaagaaaagaatatatgcaacgaagggaaattatataaacaaaggatcattggaggtactgatgagttcatttagttcaatgaaaatagtgacgtattaggtagatctcttaattttattactagtattctactaaatgtggtagtataaagtcaaaaagcattccgaagtttctcaagacccttataattccatgatttttttcaggtcagtcaacatttgttgaatgataggtctgtggaaggaaagcacactctttagggtcatagttattaactattaaaccattgaaactattattttatatttgtgttaatgagagtcaaaattattgtgcattcatctcaaataattctattattttgaaaaatacaggttttttttttaaaaaaaactgctcttgacattgtagctattgtgagaaaatattttgattataattatttaaaagcaatacaggacaccctggatgatggtaatgactagggcaatggttgcattccagtacttaagtatgaaataaggaattattactttctgggtgaatataggctagaattgaagacaaaaaaatttgttgcttatcttcagtacttccagcttcatagataattactcttaaaaggaacaagaatgactgcctctggatggaggaattggatagcaatgggccgtgggataggagacctataaaccttcatgctatattattttgtgcctttttaaattttgaagaaaaaatattcatttattcaagatatatgtaaattcagtaaataaaaagatatgatagttatgaccaagtggaaatatatttcctgatgtaaaaggaatcactgaggaaaaagattaaaatattttggctgtcaactcgtagtttaaaaaaaattccttgaaagaggtagagaaaagtcaagttgcagtcccacacagagcctctgggcgccgccgtcggccagtgcagagcaagcgctgacgccggggatccctcagcctctagcctgggattccctgcgcagccaacaacagaaaagaaaaccagctcccacacagaggctcccggctgcgcagaccttgcccagcacaccagattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtactatttcctttgctgctgcctttgttctaccccacgctgtgtgagccgatccgctactcgattccggaggagctggccaagggctcggtggtggggaacctcgctaaggatctagggcttagtgtcctggatgtgtcggctcgcgagctgcgagtgagcgcggagaagctgcacttcagcgtagacgcgcagagcggggacttacttgtgaaggaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaattccggaaagatgaaataaacttagaaatcagtgaatccgtcagcctggggatgggaacaattcttgagtctgcagaagatcctgatattagtatgaattcgctgagcaaataccaactaagtcctaacgagtatttctcattggtggagaaagacaatcctgatggtggcaaatatccagaattagtattgcagaagactctggaccgagaaacgcagagcgctcaccacttggtactgaccgccttagatggtggggaccctccccgaagcggtactgctcagataagaatcctggtaatagatgccaatgacaaccccccagtgttcagccaggacgtgtacagggttagccttcgggaagacgtgcctccaggcacctccatcctgagagtgaaggccactgaccaggacgagggcatcaactcagagatcacttattccttctttggtgtggctgacaaagctcagcacgtgttctctctggattacactacaggaaacattctaactcagcagcctttggattttgaagaagtagaaagatatacgataaacatagaagcaaaagaccgaggatctctctcaacacggtgtaaagtaattgtagaagttgtagacgaaaacgacaacagcccagaaataatcatcacgtcactctctgatcagattatggaggattcccctccaggagtggttgttgccctcttcaaaacacgggaccaagactcaggggaaaatggggaagtcaggtgtagcttaagtagaggtgttccatttaagattcattcttcttctaataattactacaagctagtaacagatgaggccctggatcgggagcagaccccagagtacaacgtcaccatcgcagccacagacaggggcaagcctccgttatcctccagcaaaaccataaccctgcacattactgacgtcaatgacaacgcgccggttttcggacagtcagcctacctggtccacgtgccagaaaacaaccagccgggtgcctccatagcgcaagtcagtgcctctgacccagacttcgggctcaacggccgtgtctcctactctctcattgccagcgacctggagtcacgaacgctgtcgtcctacgtgtccgtgagcgcgcagagcggggtggtgttcgcgcagcgcgccttcgaccacgagcagctgcgcaccttcgagctcacgctgcaggcccgcgaccagggctcgcccgcgctcagcgccaatgtgagcctgcgcgtgttggtgggcgaccgtaacgacaacgcaccgcgggtgctgtaccctgcgctgggtcccgacggctccgcgctcttcgacacagtgccgcgggccgcgcagccaggctacctggtgaccaaggtggtggccgtggacgcggactcggggcacaatgcctggctgtcctaccacgtggtgcaggccagtgagcccgggctcttcagcctggggctgcgaacaggcgaggtgcgcatggtgcgtgctttgggtgacaaggactcggtccgccagcgcctgctagtcgctgtaagagatggaggacagccacccctttcagccactgccacgctgcacctggtgttcgcagatagcttgcaagaggtactgccggatttcagcgaccatcccacaccctctgactcccaggctgagatgcagttttacctggtggtggccttggccttgatttctgtgctctttctcctcgcggtgattctagctattgctctacgcctgcgacagtctttcagccctactgcaggagactgctttgagtcagttctctgctccaagtccggacctgtgggtccccccaactacagtgagggaacgttgccctatgcctataatttttgtgtgcctggggatcaaatgaatccagaatttaattttttcacatctgttgatcattgtccagccacacaagataacctcaacaaagatagcatgctactggctagcattttaactcccagcgttgaagcagataagaagattcttaaacaggtaagtatttaaaaatgtatttaatcctttttatattacaatatgccaatatattccaatatagtggtattattttaagattctagataacttcttcatagagttcgcaaaatataggtcaaatttatggttatcattattaaaacaaaagtttaaattaaatgcctcagtcttcctactattcaaagacattttaaagcaaactacatgggtaatctccggtgacatttttatgaagtaaaatacctttcggttaaaaatataaaatacaggtatatttttacggcatggtattttaattgaaaccctgatgctactcaatttttctcaagtatttcatcttcatttactcaataaaggaaccttgtaagaattatagttaggcatcctacctgatgattttatcgggaccgtattatttccacttccagaaatgtcgttcctttcagtcggttaaaatcaattggaaccaactacaacctacaagttttcagctccagtaatattttgaaaactttttaaaaattaagcaagcccttttaataattactcctttcgcaggtgttcttggtaaagttttaacgtcacataatgtaagtattgtgtatcatcgtttttaagctctacaaatacgtgtgattcacaaaggtgagcgtaatcatttcttctggaatttcttagtcgttgcaataataagaatgggctctaggcgccgctgctcaccaatcagggaatgggaagctgcgcgccattgagtccctccctcccccgcctctaccacacaaagcggaatgagatggatactcacagatcctgacactggagacttagaagtattttccttcgctttctgatatattttggatgtagtcggcctaggacttcatagatacataagccgattcacaaccaaccagctcgagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccccgggagctggcgaagcgcggagtccgcatcgtctccagagggaagacacagcttttcgctgtgaatccgcgaagcggcagcttgatcacggcaggcaggatagaccgggaggagctctgtgagacggtgtcctcctgttttttaaatatggaacttctcgtggaagacaccttgaagatttacggagtggaggtggaaataatagatattaatgataacgcccccagcttccaggaggacgaagtggagataaaagtcagtgagcacgcaattcctggggcgcgatttgctcttcctaatgctagggatccagatgtgggcgtgaactccctccagagctaccagctcagccctaataattacttttccttgcaactgcggggcagaacggatggggccaagaatccagagctagtactggagggaagcctggaccgagagaaagaggctgctcacctgctcctcctcacagctttagatggaggcgatcccatccgaaagggcgcagttcccattcgtgtggtggtcctcgatgtaaatgatcacatcccaatgtttacacagtccgtatatcgcgtgagtgttccagaaaacatcagctccggaactcgggtgctgatggttaatgcaacggatccagacgagggaatcaacggggaagtaatgtattcatttcggaacatggaaagcaaggcttctgaaatattccaattggattcacaaactggagaagttcaagtacgggggtctctggattttgaaaaatatagattctatgagatggaaattcaaggccaagatggtggaggtctctttaccaccacgacgatgttgatcactgttgtggatgtgaatgataacgctccagaaataactatcacctcttctattaattcaattctggaaaactctcctccaggtacagtgattgctcttctaaatgtgcaagatcaagattctggagaaaatggtcaagtctcctgttttattcctaaccacctgccttttaaattagaaaagacttatggaaattattacaaattgataacaagcagagtgctggacagggagttggtccagagctacaatataacgttgacagccacagaccagggaagcccgcctttgtctgcagaaactcatgtctggctgaatgtggcagatgacaacgataaccctcccgtttttcctcactcctcttactctgcctacattcccgaaaacaaccccaggggtgcctccatcttctcagtgaccgccctcgacccggacagcaaacagaatgccctggtcacttactctctgacggatgacactgtccagggggtgcctctgtcctcctatgtctctattaactccaacactggtgttctctatgccctacaatccttcgactatgagcagtttcgagacttagaactgagagtgatagcacgtgacagcggggacccgcccctcagcagcaacgtgtcgctgagcctgttcgtgctggaccagaacgacaatgcgcccgagatcctgtaccctgccctccccacagacggctccactggcgtggagctggcgccccgctctgcggaacctggctacctggtgaccaaggtggttgcggtggacaaagattcaggccagaacgcctggctgtcctatcgcctgcttaaggccagcgagccgggactcttcgcggtgggggagcacacgggcgaggtgcgtacagcgcgggcactgctggacagagacgcgctcaagcagagcctcgtggtggccgtccaggaccacggccagccccctctctcggccaccgtcacgctcaccgtggctgtggccgacagcatccccgaagtcctggcggacctcggcagcctcgagtctctggctaactctgaaacctcagacctctcgctgtacttggtggtggcggtggccgcagtctcctgcatcttcctggtctttgtcatcgtgctgctggcactcaggctgtggcgctggcataagtcacgcctgctgcaggcttctgaaggcgggttggcaggtatgcccacgtcacattttgtaggcgtggacggggtacaggctttcctgcaaacctattcccacgaggtctctctcattgcggactcgcagaagagtcacctgattttcccccagcccaactatggggacacgctcatcagccaggagagctgtgagaaaagcgagccactcttgatagctgaagactcagctatcattttaggcaaatgtgacccgacaagtaatcaggtgagatttatttctctgcctcctaattgttggtgtcttggcacaagtcttttaaggagatgttttttgagcctgttatgaaaactgtttggggggggggtggggcggcatatatttagttcatatatatttagagcaatacatgtgagttttactttgcctttcatgagattacgataatctttcagaacgtttttgtgaaagtcatttttcaatcttggcatattttcttttgatttcaaaggggccattcaactatgctggtttggtttgaagtaagttgaattttagtattatttttctattatcagtgtatgaggctctcaatttattatatatagatacaaattaatgattcacaaacactttttatttccatttcaattttgctgtgccttcactgatttgtagttatattccaccattatttgctattactgctaatgttcaaattttgatcctgttgatttaatagcatgctccctctagctctccttctcatctatctatctatacacatgcacacacacttatacacgtaagcttttctctgagcaattttattttgattcttggtggctggtaatatgcttagatcctgttgactatttcaactttgtctcatttcttcatcctatcaacacagacatattgactggcttttaactactggatttccttgggagataaaatttagatcacattttttcttaagctctagatgtcttttccattactatggtgaagttacattgactgttctgaggaaataattgaattattgaactggtattatttccttttattcttttactttggtgtctgtgtttgtatgtatggaaggttttttaatgtagtaaatccatatatagaaataacttgattttgattcagtgcttctcaaaaacctattttcaaatgtgctaaagatgtctacagatttattcaaatagagtagtttgtgaatatataaatagattgaaggtatttggactttaattaaactgatttagctagtatccttctggctatttttttgttcattttcagtgtagttgggagtcatagattccttctttctttctttataaggtcattcttatggcaaatagtacattcagttcttttattcagaccaacttgttattgaagcttgatagttgcctgacatacatgttatctgaagcaatgtctaggaaagccaaatgaggaaaggagacttatctagggtttttgatcacaggaatcatttccataatcaattcagtcaacactctcacatcacttctaggtatttgccccaaattacttggatatttatgttccctttcaagtttagttttctcatttaggaatttaccttatgtcattagttgtaaactgactatctagggctcggacaaaaataatttcaactgtaggaaaggcaagtcttccaacagatgcctacatttttcttgaagtcaagaaaaatgttcaggtattttgagcatctagggataggatttatacttgtggaattccaaactgagaaaaatgatgtaaggcattgtactttgactggaattagttaaataaaaaggatatgaggtatttggctgggaaaaggagattgttccatattataaaacctcatctaaactaacttcccaagatcgtggagaacaaaaaggaagggttggctttgaaatgtgatattaagagggttatgttgattcggaggtagtgataaagttctgttaaggtataacatatagtcccattaaatagaggataaaaataaaacaccatcacatttcatgttattaattcctatggcaacctactaggctatacctttatattctctttatgatgaaacatgaaacaataatccttttcagaaacctcttttataagtgataagaagggtttggctaactttattctgaatatgccctatatagctttcagtgctcctccagttttctctgataaaactaggaggaaaattatctgcacatcagattgaaaataatactgcatatcatttcatagtggtcaaaattttcccataccacttgatggggatgttttcccacaaggtttttgttctacaacaggagagaagactttgcctagttcttccaatatgtgcattgcttctgcttagaaaaaaacaaacttttaaattctctttgctgggttaatgactgttctatagattcccatctctaaggaatcttctttggtagtaaacactggaaaacagtcactacgaaaactcataaaatgtctagtttcctatacattagtccaacacatcagtctaattctgaatcccattgaattagcaaaggcttccggctgcagttttctaaatagactcagagccctgctgttggccaatgtgctgcaagaactggagcctgggatctaccaggacgatattctgttcagtcacagaagcaagtcggagagtggccaagacttgggctttctgctcctgcaaatctgattccatacggattggggtgccctcaaactgggagcattgagttttctatgtatggaagtaaatattttaaaagcactttgtgaaacattttctcttaacgtcggagactgcagcaacgcatgggaaggatgggaaacagggtgaagcagagaagcaggacccggcagtggcaagcactcttccctttcctgctgcctttgttctgcggggcaccctcggagcagatccgctactctattccagaagaaacggtccagggctccgtggtggggaaccttgcggaggacatgcggctgcatgttcaggatttattgacctgaaaccttagagttagtgcagagaaacaatactttaccgtgaacacggagaatgggaacatacttgtgagtgacagaatagatcgagagtcactgtcttcaaaatcctctgtgtcatacccttagagattgtagcagagaatcctctaaatgtttttcacataaatgtgatgatagaagatataaatgataacccacctcattttccccaaaatagcattgttttacaaatcaatgaactagcaattccaggcattcggtttggcctggaatctgctatagatgcagatgtagggcctcactctctccagagttaccagctcagttctaatgaacatttctctctgatgatggacaagactaaaggcaagaacgctccagaattagtgctggagaagcccctgggccaggagcaacagagctctcatctcctggtcctggaagcaatggacatgggtgacccagtcccaactggcactgctgcaattcaaattgaggtcactgatgccaacgataatgccccagtttttagccaggatgtatacaaagtcagccttagagagaatgtgcccccaggcacctctgtactaaaggtgacagccactgaccaggatgagggtgtcaatgcggagatcacctactctttcaaatccctacgagatgatattggaaatatgtttgtgctagaccatcaaaatggggaaattaaatccaaagacttaatagacttcgaatttcgtagcagttataccatgagagtagaagctaaggatggtggaggcatgaccagcgaatgtaaaattatactagaaatcctagatgagaatgacaatgccccagacgtggtttttacttcagtgtccagttctgtaactgaggacgcagaaccctggacggtgatcactctgttcaaaacacatgataaagattcgagagaaaatggggaggttacatgcctcataaacgaaagagttccttttagaatcgaatcttccgccaataatgactataagcttgtaacagatgggaccctggattgggagcggatcccggagtacaacgtcaccatcactgccactgacaagggcaagcctccgctctcatccagcacaagcctcaccctacgcattggtgaagtcaacgacaatgctccggttttccaccaagtctcctacgtggtccacgtggccgaaaacaaccttcccggagcctccatcccacaagtcagcgcctctgacctggacctagggctgaatggccaagtctcctactccatcgttaccactgacttggagctgcgggcactgtcgtcctacgtgtccgtgagcgcacagagcggggtggtggtcgcgcagcgtgccttcgaccacgagcagctgtgcgccttcgagctcacgatgcaggcccacgaccagggctcgcccgcgctcagcgccaacatgagccggcgcatgttggtgggcgacctcaatgacaatgtgccgcgggtgctgtaccccgcgctggggcccgatggctccgcactcttcgatatagtgccacgcgccgcagagtccggctacctggtgaccaaggtggtggcggtggacgcagattcgggacacaacgcttggctgtcctaccacgtgctgcaggccatcgagcccgggcttttcagcctggggctgcacacgggaacctgctggttgctgtgcgtgacggaggacagccgccgctctctgcgccgctacgcttcacctagtcttcgcagacagcctgcaggaggcactgccagacttcagtgacagtcctgtgccctctgattcccaagcaaagctgcagatttacctggtcgtggccttggccttgatttctatgctcttcttcctcgcagtgattttggcggtcgccttgcacctgcgatgctcttccagcccctctgcctggggttgctttcaccctggtctctgttctaagactagaccaggggtttttcccaactacaatgagggaactttgctttattcctgcaatctgtatgttccctcggattctagaaaaagaagatttaattttctcaccatgacaccagaaacagtccccccacaagatctttctaatgaagtttctctggtagcaagcttcactgaagagaataacaagataagctctaactctgttgctcctactcacgtgagttccaatgaatgtctttcatttacaaatggatgaggtttaattttcaaaccaatattttggcaagaaaatcttaaacatattatatctactattgcttcaggtttgtttgcccactcttaatatttcctgttcctttctgtgtgggccagtaacttcattattagctttcatgtatttttgaaacattttcaccatttttacgggagactttttttttttttggacggagtctcgctctgtggtccaggctggagtgcagtggcatgatctcggctcactgcaagctctgccttccgggttctggccattctcccgcctcagcctcccgggtagctgggactacaggcgcccgccaccacgcccggctaattttttgcatttttagtacagacggggtttcaccgtgttagccaggatggtctcgatttcctgacctcgtgatctgcccgcctcggcctcccaaagtgctgggattataggcgtgagccactgcacccggcccggagacattgtttatacacacacacacacacacacacacacacacacacacgtgtgaaaagtgggtattatgatactgctgtcattgagatattttaattgaggaataaatttttttcctgtgatgtttcttgggacatcaatatttgagtatataaggctttttctttaatccattaactataaattttgaagaaaatgcatgagaaaatggagaaaatgtgttttttttttaaaaaaaattgagattaaggtctcattatgttgcccaggctggactcaaactcttgggctacagtaatcctcccacctcaatctccagagtagctgagactacagttgcctgaaactgtgcctggcagagaaaaaagcttaaaaaaataagaacatggtaatgatttgataatattcagttacatttacttttgattcttgtaattcaagtaaactcaattttatgtctgatattttctcacagctacctatatatttcttcccaatttaaaatatattattttattttatgcctagcaaatatctttacagtataaatatttacgctcatgaaagtacgtagccagttatttcttagggagaattttttccctatattttgatgggcttccaaaagtattaccagtaattctcagtaattacaattaggtcagttacccaggaaaaggtaagtctgtaacattctttggactaccaattttcttttactaagtttcctgaacaataaatatttttgaaatataatgtattaatagaattctggagtacttccattatttccagtcaatgcaagttggaatgcttctactttatgctaaaaatattaatgtttctttttcacttgggttcttgttaagtgtgattctgataatgtatacaatcacatatcatttttaggtttccataatatcatgaaaatttgatttttaagcgttacatgtcaacaacctggtaaagtaatccttccattcaggatcattcaaggaatctatttaaaaatattttccccaaattatagctgaatcagaaagtttaaattattatattatatgatttgtcaaaaagagaaactcctagggagacatctccataataggtgtgttgggggaacagtaatctcaaagcagatgcactaacattataagattaaaatcattgtttatagaaacttccaattcatttaaaagctcattggggaaaaaaaagctcattgggaaaaaaaaaaaaagctcactaaagtttctattaaagcgaatacggtagatttccatccccttttgaagaacagtaggtggagctatttaagatataaaaacgaaatatcctttctgggagttcaagattgtgcagtaattggttaggactctgagcgccgctgttcaccaatcggggagagaaaagcggagatcctgctcgccttgcacgcgcctgaagcacaaagcagatagctaggaatgaaccatccctgggagtatgtggaaacaacggaggagctctgacttcccaactgtcccattctatgggcgaaggaactgctcctgacttcagtggttaagggcagaattgaaaataattctggaggaagataagaatgattcctgcgcgactgcaccgggactacaaagggcttgtcctgctgggaatcctcctggggactctgtgggagaccggatgcacccagatacgctattcagttccggaagagctggagaaaggctctagggtgggcgacatctccagggacctggggctggagccccgggagctcgcggagcgcggagtccgcatcatccccagaggtaggacgcagcttttcgccctgaatccgcgcagcggcagcttggtcacggcgggcaggatagaccgggaggagctctgtatgggggccatcaagtgtcaattaaatctagacattctgatggaggataaagtgaaaatatatggagtagaagtagaagtaagggacattaacgacaatgcgccttactttcgtgaaagtgaattagaaataaaaattagtgaaaatgcagccactgagatgcggttccctctaccccacgcctgggatccggatatcgggaagaactctctgcagagctacgagctcagcccgaacactcacttctccctcatcgtgcaaaatggagccgacggtagtaagtaccccgaattggtgctgaaacgcgccctggaccgcgaagaaaaggctgctcaccacctggtccttacggcctccgacgggggcgacccggtgcgcacaggcaccgcgcgcatccgcgtgatggttctggatgcgaacgacaacgcaccagcgtttgctcagcccgagtaccgcgcgagcgttccggagaatctggccttgggcacgcagctgcttgtagtcaacgctaccgaccctgacgaaggagtcaatgcggaagtgaggtattccttccggtatgtggacgacaaggcggcccaagttttcaaactagattgtaattcagggacaatatcaacaataggggagttggaccacgaggagtcaggattctaccagatggaagtgcaagcaatggataatgcaggatattctgcgcgagccaaagtcctgatcactgttctggacgtgaacgacaatgccccagaagtggtcctcacctctctcgccagctcggttcccgaaaactctcccagagggacattaattgcccttttaaatgtaaatgaccaagattctgaggaaaacggacaggtgatctgtttcatccaaggaaatctgccctttaaattagaaaaatcttacggaaattactatagtttagtcacagacatagtcttggatagggaacaggttcctagctacaacatcacagtgaccgccactgaccggggaaccccgcccctatccacggaaactcatatctcgctgaacgtggcagacaccaacgacaacccgccggtcttccctcaggcctcctattccgcttatatcccagagaacaatcccagaggagtttccctcgtctctgtgaccgcccacgaccccgactgtgaagagaacgcccagatcacttattccctggctgagaacaccatccaaggggcaagcctatcgtcctacgtgtccatcaactccgacactggggtactgtatgcgctgagctccttcgactacgagcagttccgagacttgcaagtgaaagtgatggcgcgggacaacgggcacccgcccctcagcagcaacgtgtcgttgagcctgttcgtgctggaccagaacgacaatgcgcccgagatcctgtaccccgccctccccacggacggttccactggcgtggagctggctccccgctccgcagagcccggctacctggtgaccaaggtggtggcggtggacagagactccggccagaacgcctggctgtcctaccgtctgctcaaggccagcgagccgggactcttctcggtgggtctgcacacgggcgaggtgcgcacggcgcgagccctgctggacagagacgcgctcaagcagagcctcgtagtggccgtccaggaccacggccagccccctctctccgccactgtcacgctcaccgtggccgtggccgacagcatcccccaagtcctggcggacctcggcagcctcgagtctccagctaactctgaaacctcagacctcactctgtacctggtggtagcggtggccgcggtctcctgcgtcttcctggccttcgtcatcttgctgctggcgctcaggctgcggcgctggcacaagtcacgcctgctgcaggcttcaggaggcggcttgacaggagcgccggcgtcgcactttgtgggcgtggacggggtgcaggctttcctgcagacctattcccacgaggtttccctcaccacggactcgcggaagagtcacctgatcttcccccagcccaactatgcagacatgctcgtcagccaggagagctttgaaaaaagcgagccccttttgctgtcaggtgattcggtattttctaaagacagtcatgggttaattgaggtgagtttatatcaaatcttctttcttttttttttttaattgctctgtctcccaagctggaatgcagcggtacgatcatagctcactgcagcctcaaactcctaggctcaagcaattatcccacctttgcctccggtgtaacagggactacaggtgcaagccacctactgtctgcctatctatctatctatctatctatctatctatctatctatctatctattactttcttgtacagacaggagtctcactatgttgagcaggctgatctgaaacttgggctcaggctagcctcctgcttctccctcccaaactgctgggattacaggcgtgaaccacagtgccccgcccttatcagatattcttttctggctgggcgcggtggctcacgcctgtaatcccagtactttgggaggccgaggcgggtggatcacctgaggttgggagtttgagaccagcctgaccaacatggagaaaccccgtctatactaaaaaaatacaaaattagccgggcgtggtggtgcatgtctgtaatcccagctacttgggaggctgagtcaggagaattgctttaacctgggaggtggaggttgcaatgagctgagattgtgccattgcactccagcctgggcaacaagagtgaaactctatctcaaaaaaaaaaaaaaaaaactttatcctctagtttcatccattgatgacacttgctttaatcacttattacaatcacctccaaatgaagattttataattccattgtttcttctacagttgttaattggctttctaccttgaagaagagttttatattctctatatatgtttgtttctatgattctggaagcatggttttctattttattcaatggcctgtaatctgttaatatcaattatttattttgatgctgaaattgtcccaggattggcctttgggactccctttaggctgatttctatgtcctttctgttacagcaagcttgggattatatccaagatttgtaattccaatgtacttacttctgtcagtgtaaacaaagtacgatttctggactagatgacttgggcattgtgggggaggtggaaattagaggtattctctgtttttcctgtaggatcttgcatttcttcctcttgctgcttgtctctttgtgtcgggaacaggccccccaaaatctggccataaactggccccaaaactggccataaacaaaatctctgcagcactgtgacatgttcatgatggccgtaatgcccatgctggaaggtagtgggtttaccggaatgagggcaaggaacacctggcccgcccagggcagaaaactgcttaaaggtgttcttaaaccacaaacaatagcatgagtgatctgtgccttaaggacatgcccctgctgcagataactacctcaatccatccctttatttccgcccatctcttcgtttcccataagggatacttttagttaatctaatatctatagaaatgatgctaatgactggcttgctgttaataaatatgtgggtaaatctctgttcagggctctcagctctgaaggctatgagacccctgattccccacttcacacttctaaaaaaaaaaaaatttttttttctgagcttggagaaatatatcccttagtacacttggcatttataaagcagacatcaataaatttatatatatgtgacagataccaacaacaatccagtccccttccctcataccttatttatgtacatatattttatataatagatataatttattaacaatttataaaattactttgttaatactctatatcattttctagctgaatttatcaatgataatgctcttttcccacttttatttttttcccattgaccatgcagcagttttgtgtagaccgtctgataacaactgatctgtttatctaggggggagaaatctaattcaatggaaaatataaataaaattgtgataaacttttgtaaatagagtggcttttaactacacttgagatggctagcaaattcataaagtgaatttactttctttcaaagttcagtaattctttctggccattagggatatgtccatttatactttctcagtatcccaagtcatttcatggttttaaatcattcatgaacttccaaatatagtgaatttatttcttctgcatttaaaattttatcacttaaatatacaatataccgtattgccatgacgaaaaatggtaaagactatttttcacttctgttatgcatttcattaatacgatatctgtatgtgtttccaagttagacatttcttttgcccatttcctacactaatgatactaatgatgactttgtggaatattcagaattaacaaaatgtgttttgagtgctttttttagtactggggcaaatttgcagtaatatcgcctgctttttacattaaattccccataacttttacaactatgggaaaatttctgaaacgtgcacagattccaagtgttttctgagaactttatgcttattgtagagtggttacagacactgaatgctaaagtgtattactctttgaaaagcattgcttgatttcttttggtgaattctgtaaaggtgcagggaaacataacgtcccaattattttttctttcttctttgtttgctgcctatctactttgaaagatacaatagttaaaacccagaaaagagattggaaaccccttagagaatgaaagacatccaagggctctaaaatgcggcagttgctgcttctgagaccaaaaaagggggcaaaatatagagtgtgtggttctacttgtgtgattttttgaaagaaagtatttgaatttatctaaaaatactaaatttgtatttacattagttttcaaatagaatttaataagtacagtgttctataggtaatattgagagaaatagaggacaatgaaacctctctcctccatcatcttgtatgaactaccaaaatgtttatcatatggacagttctcatatatagtcaaatagaaagaaagacataataggaaaacaaatgacttgggaaactaagctaacatggtctaattattctgacctctgctcacctaacttgatttaggaacaaatcattgagagttagagcatgaatagtcaagactgttagaccatatctcaaatatcagtgacttcaatcaactatgtttccagtttaagctgaataggctttattaaatagttgttgaatgaatggataaacaaataatgtactctggggattacctgataccaggattctgaattttcagatgtatcatagaaggatagcagctttgcaattaggtaaattgttaactgtgtcacctttagcaagttatttaatctctttgagcttcagcaaagtaggaataatcatatctaatttgaaaggtcgtggtgatggctagggctaacaaaaatctgattcacaacatgcaattaattaacagtagccatttttagtggttgaccaaaaaaaggatttatattttcaatgccagcacactcgatgttctgttgggaaaaataataatgatttttgtgtgcttctccatatggtataatggaatgatttgtggatggaaataaaactgttctaaaatttttgtgacagctggtttaaaaatcttaagtgcctaggcacattcttgattgagaagccacagttttaggccataaaagatgggggaaagatttttatatgagacaattttgtgagtgttactttttctttgtctgaaccatagtgaaatctaaacaaggatcttgtgaaacttattttaaagaagcagtttacttcaatgggatcttagataatttcaccagaaaatggatcaccgaaaccagaaggctggtgatcattatttggtttgggccatataagaattgaaactaacggcttagctttaggatttttaggacacttgttgataatttaggattcataattaacatatgtgttgattgttttctgagactaactgggcaatgggtttggatgtgtttacatttattctgattccagtcataaaattatgtcaaggactttccttgtctttttatgtgtatgacagatgtgtatgtatccatttcatctaacaagttaaagcgttcagctataatttaaaatttgtagcttcactgttttatagtacctaaaattggaatgtaatcagtcagaagacattcatccactgctttcattccagaagtattatgctttttgaagcagcaatagcataggaatgttgaggagactatactatacttttatagcatatttaatctcgtagatcacttttcaatgaattataaggctgatgacaaatgagcaaattgtatcagttttctttatgacatgtaacagagtatagctgtgatcatgaattggatagttctggtgtaaaaatctgctttatccccatataagatgtcaggttcagaaaagcaaacacatagtttcgaagagatgttgatcaaactgatgaggctaaatctcaagaaagagacacagttaccctctaatgttacactttgagttcacctttttttttttttttgagacagagtctcaatctgtcgccaagctggagtgcagtggcactatcttggctcactgcaacctctgcctcctgggttcatgctattctcctgccttagcctcccgagtagctgggactacaggcacacgccaccacacccagctaatttttgtatttttagtagagatggggtttcaccatattggccagaatggtcttgatctcttgatcttgggatgcacccaccccacctcagcctcccaaatagctgagattacaggtgtgagccaccatgcccgaccactttgagttcacttttaagaaaccatacttaatggaaaattaccagtaacagggcatactgtttaggatgcattcctaaaatattaatggcaaaagatagccagcctatggcaaagctaattggaaaaaatattttataaaggatgagacttctggataccatatgggaagggctctggttcaggaaaatgtttttaaaaaactgtcattgaagagaccatagaatcaaacaaaataatttaatctgtatgtaaaagaagttggtaccaccataatttttcttatacatgtcatataaggatctactctgtgtattgtcattgagggcagatataatttcttagttcatcattaactctctgaagtatttcacacagtagtttgtacaccttctaagtactcaatacaatgcttgagttcaattattggaaagtggtctcttggagaaaaaagaatcatagtgcaaaaccaattattttacatggacttttcctctatatctaagccctaataagaggcagctgtctgatatacatacatacatacatacatatatatatatatatatatatatatatatatatatatatatatacacacacacacacacatatatgtatatatatatttggagtaggggatggagtcttgctctgtcacccaggctggagtgcaagtggtgtgatctcagctcactgcaacctctgcctcctgggttcaagcgattctcctgcctcagcctctccagtagctgggattacaggcgcctgtcaccatgcccagctaattttttaaaatatttttagtagagacagagtttcatcaagttggccaggctgctcttgaactcctgacctcaggtgatccacctgccttggcctcccaaagtgctgggattataggcatgagccaccgcaccctgccaactgtctgacttatcttaaaaggctaaggacctggtttgtttgtcaaattttgaaaatagatgcctcagttcataagatttccatattgtgtggcaggcgcctgtaatcccagctactcaggaggctgaggcaagagaatcacttgaacccgggagacagaggttgcagtgagctgagatcacgccactgcactccagcctgggcgacatagtgagactctgacaaaaaaaaaaaaaaatccatatgtgaaaattcttagaagcttcctatacaatttcagctgaagattcagccaacagttcattctgagactgtgttccatggaaaaagtaaagcccaggcatggaagtgggaatggaaagaaagattctaagcctacaaatactcaaacatcaagaagaaataaaaataagtcatcacttcgacttcatgtgctaacatcactgaggttataaattcccaggaatattttattgcgggagcaagactgcactgctgcctttcagcttgcaaattccagtgagaaacgtctttctctctgctctcaactaactctacagaacgctgtcctctcatttcttcaggctgcagttctagagtagggactcagagtgccactgttggccagtctggaaacagagataaatgagccaatccccagacattccggcttggtggcttttctaatttcatggaatgcaaatccaagagcagacccacaacattcctattatggctcctagttctacaaattataagcaggaacggaacggatttacaggcaatgagttcagctccttcttggctggagattctataatccaagaagagtttgaaaaggggcttatttgggctggagcagcagcaactctaactgtggaaaaggtggggaatggtgctggactgacagtctgggtagaaccaaggcgactactgcctcctttcctgctatttctatcctgctgggcattctctatgatgcagatccgttattcagtcctagaggagctggccaagagtttggtggtgggaaaccttgccaaggatctgggactcagtgtcgaggacatgcccacttgaaagcttcgggttaatgctgaggaataatacttcattctaagtggggaaagtggagacttacttgtgaatgactgaatggatcaggagcagatacgccccccaattatagcttgggccataacgctttgaaatagttgaaggccaggcatggtggctcacacctgtaatcccagcactttgggaggccgaggcgagcagattacgaggtcaggagttcgagaccagcctgaccaacatagtgaaaccctgtctctactaaaaatacaaaaattactgggcatggtggtgcaggcctataatcctagctactcggggggccgaggcaggagaatcgcttgaacccgagaggcaatcgcaccactgcactccagcctgggtgacagagcaaggcgccatctcaaaaaaaatgaacaaacggtagttgaaaattctttaaatgtttttcacattaatatggagattcaggatatgaagaatcatgcaccacggttcagcaggaatgttattaagttacgtatctctgagtttacccagctggaacaagatttgcaacagaacctgcagaagatcctgatgttgagagaaattccttacaaaattatcaccttagcagcaactctatatttctctttgaagtaaaagtgaccaacagtggaaagacatatgttgatcctgtgttagagaagctgcttgactaggaaaagcagagctcccatcccttagtgctagcagccttagacggccccccaacaaagcagcatcactcaactcctgatcctattggttgaagccaatgacaaccctgtgttcatctaggatgtgtacagcgtcggccttcaggaagatgtgcatccgggcactcctgtgctgagagtgagggccaccaaccaggactagagtgtcaaggcagagatcacatatggcttcacaacccagagtacccatatctagtttggccttgatcaaatagtggagaaatgaaaactttaagtacattggacttttaaagatttttaatttccatggttttggtagcaagtgacagagagggactcattgtccagtgtacagttgagaccgaatttctagaagataatgacaatatcctagaggcgatttttacttctaattccacaatgattcccaaagattctgcaccttggacagtaatcactgtccaggatttaaatcacaagatctttaaatcacaagatctggattcgggagaaaacgaggtcacatgtctgatataagaaaatgcaccttgagaaaaatcttcctccaataattaactacatgcttgtaacaaatggggccgtggaccaggaacagacccaaggtataacatcagcatcactgccactgacagaggcaaaccaaccctctcgtccagcccaagcatcaccctactcattggcgatgccaacgacaatgctctggttttctaccaggcctcctacgtcgtccacgtggccaagaacaatcttcccaaagcctccatagtgtgcaagtagacacctccaacctagacttgggacccaacagccaagttccctattccatcgtggccagtgacctggagccacaggcgctgtgattctaggtgtccttgagcgcacagtgcgccttcgaccaagagcagccgcgagccttcaagctcacgctgcaggcccgcgaccaggactagctcgcgctcggcgtcaacgtgagcctgcgcgtgttggtggacgacctgaatgacaacgcaccgcgggtgctgtaccccagctctggagcgcaatggcttcgcgctcttggatatggtgctgcacgccgcggagcctggctacctggtcaccaaggtggtggctgtagacgcagatgtgagacacaatgcgtggctgtcctaccacgtgctgcaggccagcaagcccaggctcttcagcctggaatgcgcaccgacgaggtgctgacagctcgcacgatgggccacaggaaagcgactcgccagcgcctactggtcgcggtgcactgcggtggacagccgctcctctcgctaccgccacgtcaccaccactaccgcccctcgtcgccgacagcctgcaggagactctgccagacctcagcgatcactctgcaaagctacagcctgaatccaaaattaatttatatctggtgattgccttagctttaatttcctttttattcttcctgattgcattgtttgtgctggttttaaagtgccgaagaccccaaaatgatcctgtctgagtctttcccacggatgtctatcccgcgctaagccccaggtttctgggtaactgtagctctatgatgccatattcctaccaggtgtgtgcttctcctacgaatccagggctgagtgaacttcttttttgaatccctacccctcaggactcaatagcagtttcactgcagaaagccccttggggaaggggatgattgtgattattctaattgcttgggcagaatccactctccaaggtgaaaaattcttgatgaaactaagttcagtcacaagcaggttttcttctagcattaaatattttcagagatctcagtaaaaagcatttctagcagcaagaccaaaggcctaagatgagaaatatttggcatggtgagcttgagggacagtagtcaggcagacaagagtatcagacatgccagagcatttggggcctgtaggtaaggagcatgttttgattatatatatttgtatgtgtttgattatattttataattttactttgatattcaaattgtactgatccaaaaataagggagggacaaatcttggccattgtagtatgagagatgtaaatttacaactcagaatccctgcttatcacttctccttcagcacacaactgtttcattttctatttaagaaacttcctctcactgcaaaaagacattctggctgataaagttagcctataatttcagtaaatctaagaatatgactaatggaagttgccagacctaaactttgaaaattattgttccactgaagagcgtcttatgactgagtgttccagtctccttctcaagctgaaccttgcttttcaaaccagattaagaacactatcataagttatactgcattttatttccctacccatgtccactgcatcattctctatagtacaaagagcttgtctcgccaggcgcatctataatcttagcactttggggcgccaaggcgggtggatcacttgagcccaggagtttgagaccagcctggacagcatggcaaaaacccatctctacaaaaaaaaaaaacaaaaattaacaaggtttagtggtccatgcctgtggtctcagctacttgggaggctgaggtgtgaggatcacctgagtctggggagattgaagctgcagtgagctgtggttgcgctcctgtactccagtctgggtgacagaattagaccctgtcccaaaacaaacaaacaaataaagagcttctctccttatgacttatttaaagcttgggaaattgttccaattcaaatgctttaaatggacttgagctaaaacagaatgtggtatatgaaatgttcttataatcaggtgattgtaaaaattgatccagataatgttagcatagcattttactgaactagtagtttacaaacacttcaaaaattatagaataacatttgcatataaaattcctcatacatttccctatcagtgaattggaagcttacaatatacaatattaccaaaaagacaaaaaaaatgaaaaggaaacagttacctttggaaaacataattaggtaaaatgggtaatatggaaagtctgaaaactgaaaaaattactgataagtcaagagaaaaggaatattagtaggaaaattcataaaagtgtgtctgactactcacagcaggtttccttattggtatgtattctgtggtccatctaagctatgttaattttattttaaatgctacctgggtattggcttctaaaaggaattcagtaaatcagataatttggcatcttcaatctagattctgatgctcacctgaaaagtctgctaaggattggaaaccaagaaaagtgaagtatctcaacagatatgtgtcacttgtgtgtactggattttttttttttttttttttttttttttttttttttgagatggagtttcactcttgttgcccaggctggagtgcaatggcatgctctcggctcactgcaacctccgcctcccaggttcaagtgattctcctgcctcagcctccctagtagctaggattacaggcatgtgccaccacgcccagctaattttgtatttttagtagagacggggtttctccatgttggtcaggctagtcttgaactcccaacctcaggtgatcttccctccttggcctcccaaagtgctgggattacaggcatgagtcactgcgcccggtcgcgtactggatttatattgtgtaatactttgctctagcagtatagtaggtgagacagtgactgtgtctagtgagcaaaaggcacttatttgacacttttgactcttcctttctacttaccttatttaaaattgatttttgcatgtggcatgatgcaccagttcattgaggtaggggttgaagttatttcccatttttttcaataccatttattaaaaatattttcctctttctgttgaatttgcttggtgcctttgttgaaagtcatttcactgatatatgtagttctatttctatattcttgatcatgtttcatttgtctattcttttactaatagcacactgtctcaattattgtagctttatagtaagtcttgctacaaagtcttactacaggacaaagcttgtaggatttttgaatgggatggcattgcatctatacctttatcagggaaagagggaaggagggaggaggatcatcttaacaatattgacacttcaaatccatgaacatggtatatatttccatttaattaggtctttaatttctctcagctatgttgtatagttttcagtgtagagaggtcatgtatatttctcattaaattgtccctacatatttgatgttttctaatgttattgtaaatagtatttttaaaattgtatcttctaattgttcatttctagtttacagaaaaatgaaaaactatgtttttatgtattctatatgcttttgaaaagtaagaggtgcaaagtgctctattcttacactatattgtgtgagaatataagtcgaaaccactctgcataagttcaggcttccattctcttcagtttgtaggttgagagaacccatccagaaacagtaaacattggtgtctgcccaagtctggtcctgggtggttcattcattcatttacataacaaatatttattaactgtctgctatatgcaaggcactgacctatggactaaggatgcagcaatgaacaaggcatatatgattcctgagttaatgggccctattctaatacatgatattttacaggtctgataaaagccaacaaggagaaatacaaaagcactaagagaaagcttatagtagggaagcttcgcctaatctgaaggtcaaggaaggctttctttttttcggaaagtgatatttagagagatgaatagattaataggatgagtagaagttatctaggtaacaaggaaagtaaaaaagaaattgtcaggcagaggaaatagcatgtgtaaagatctttttaaaaaataaaaggtgtgactcaagcaatttaaaagggctagggaggctagaaacagaaaataaatagatgaaactaataaggcagggagagccttgtaaatcacacttaaaattctggattttgttctaaatacccttgtacttaggagctattaaaatattttaaacaaggcagtgacaagatatttgaattattaagcttactctggctgctatatggagaattgatttatgagggttataaatagaaataggaagataagataggagactatggcaatattcctggtaagaaatggaagaagagctggcttggattaaaggggaggcagtggatgtagaaataaatggatgaattatagatatatttaggaaatgggttcaataagacttaataatggaataggtggaatataaatttcatgagggcagggggtgttttgtttattattatattcctaggtgtctgaaaatattgttgtgttgcctggcaagtggtagatcttcagtgaaatattattaactgaataaatacaatggataaatggggagcagggattaagagtgattcctgggtttccacattaaggaactggatggacaaagctaccatttgatgagaatggaagactaaagaatgatagatttaagagaaatcgagttgagttccagccatgttcatttgaaggatctgagaaacagtgcagatattcagtgtgtgattagacatatggtcatcattcttttttttttttgagatggagtctcgctctgtcacccaggctggagtgcagtggccctatctctgctcactgcaatctctgcctcccaggttcaagtgattcttctgcctcagcctcctgagtagctgggactacaggcgtgcaccaccacgcctggctaatttttgtatttttagtacaagacagcatttcaccatattggccaggctggtctcgaactctgatctgcccgcctcggcctcccaaagtgtggggattacaggcgtgagccaccgcgcccagccggttaccattcttttactctgagttcttccattgtgatcatctagtcagatgggtagatccttataaggctgagcataataagcttcctgatagctctacactggtatgttttggggttcatggctgagctacttttgtgttttatttatcttcctgatctctttttcactgtaagaaacatccagcacccagggaaatttgctgtctaattcatactccactcttcagactagtcctagtgttcagttttgttttgttttttttctgtgtctggaattctattaaaatgtgtcaggctgttttaatttttgttgtttaattttctttcacatgattatatgtgctccatggatttttttgtttgtttgttttttgtttttgtttttgtttaagcggggtcttgctcttgtcgcccaggctggagtgcaatggcttgatctcggctcactgcaacctccgcctcccgggttcaagtgattcttctgtctcagcctcccaagtagctgggactacaggcacatgccaccacacccggctaatttttgtatttttagtagagacgggtttcatcatattggtcaggctggtctcaaactcctgaccctggtgatctgcccacctcggcctcccaaagtgctgggattacaggcgtgagccaccgcacccggaggaaatttttaacctcagtttttcttcaccatctgtaaaactgcatagaaggaatgtttaggataaaagatgcataacaatcataacaaaattgttgggttttaatgttatgagtacacttggaggattctatgtccacacataccttaaacatcctatagagtccttagcattttaaagttgaaaccaacagtatgaatgatggtagaattttcccccccaggaagttagaactgttccatatcttgatagagggatgggttataaggatgtacacattttccaaaactcattgaacttaagagtcttgcatgtgactgtatataaattatactttaattgaaaataaatttaagaaaataaaattggctgggcgtggtggctcacgcctgtaatcccagtgctttgggaggccgaggtgggtgaatcatctgaggtcaggagttcgagaccagcctggccaacatggtgaaactctgtctccactaaaaatacaaaaattagctgggcatggtggcggacacctataatcccagctactcgggaggctgaggcatgagaatcgcttgaacccaggaggtggaggttgcagtgagccaagatcatgccattgctctccagcctgggcaacatgaacgaaatgccatcttaaaaaaaaaaaattaaaagaaaagaaaattagcctcccccaccctcactatacctcagactcacccctgaaagatcactactattcatccctggttatgtacacttacaaacattttctgtgtgtatgcgaatgtatgtgtggggttttctttgcacaacaggatcattttacagtatatatactgttgtgcaacttgctctttccacttaatatctcaaggaatcttttctttgaatctttatagccatgtacctcaatcttagtagttttctttattttatttttgaataggaaatacatttacatggttttaaaaatcaaaacaatatactatgtatatattgagaagtctgacttccatccctatcctactcctattccacccttgcttcctcctgtcccctgtaggtaaacattttataactttattaagcatcctgtcagcatttcttatgcaaatatgtacatatatttttatttccccattttttttacaaaaagataaaatactatacaccactttatatcttcctttcttcacattatatcctttaaaaatatttccatattggccgggcgcggtggctcacgcctgtaatcgcagcactttgggaggccgaggcgggaggatcacgaggtcaggagatcgagaccatcctggctaacacggtgaaaccccgtctgtactaaaaatacaaaaaaaaaaattagccaggcgtgatggcgggcgcctgtagtcccagctactctggaggctgaggcaggagaatggcgtgaacctgggaggcggagcttgcagtgagccgagatcgtgccactgcactccagcctgggcgacagagcaagactgcaactcaaaaaaacaaacaaacaaacaaaaaagaacttccatattaatatatagaaagctgttttttttaacagttgcttagcattcctttggattattaaccagtctcataaatgagcgctattgaatagccctgtacctacatcagtttttacatatgcagtatatctttgggatgaattcccagaaatggaattgaaattgctgggtcaaagaggaaataggtgtaattttcttaggtattttcacaagaagtgttaattctaactttctgttttgaaatgatttcaaattttcaaaggagttgcaagaattgtacaaagaactgtatctccttcacccggatgcaccgggtgaattatatgtattatataattgtatctgtaggccaggtgcagtggctcactcctgtaatcccagcactttgggaggctgaggcaggtggattacttgaggccaggagttcaagaccagcctggccaacatgataaaactccatctctactaaaaatacaaaaattagccaggcctggtaccccatgcctaagggtgaggcatgagaaatgcttgaacctgggaggcggaggttgcagtgagccgagatcgcaccactgcactccagcctgggcgacagagcaagactctgtctcaaaaaaaaaaaaaaaaaaagtaaaaaagttttttaaaaagatgtatctatatatacatatttacatacacacccaagtgtgtatgtatatatgtttgtgtgtatgtacacaaacacattatttttatatgatatgatttttttatgacatgattatttttatgacatttgagagtaagttgtagaaattatgtttctttattcctaaatacctcattgtgtatttcctaacaaggacattcttttatataattaaattttaataataaaaatcagaaaatttaacatcaatgcaatataattatttagcctatagtccatatttaaattctaccataccttatagtatattttactatacctcatagtaattttttttagtccaaaatatcacacattgcatttagttgccatgtctctttttttttttttttttttgagacagggtctcactctttcgcccaggctggaatgcagtggtatgatcttggctcactgcaacctccgcctcccaggttcaaatgattctcctgccttagcctcctgagtagctgggactacaggcatgtgccaccacactcccaccacacccagctaatttttgtatttttagtagagacaaggtttcactatgttggccaggctagtcttgaactcctgacctcaagtgatctgcccacctcagctaagtgctgggattacaggcgtgagccaccatgtgtggcctagttgccatgtctctttaatctactttaatctgaaacagttcctcagccttgtttgtttatatgaaactgacatttgtaaagactagaagccatttgtcttgtataatgcctttaatttatatttgttttatgtttcctcgtgattttatatatagagtttgtttgtttgtttgtctgtttgtttgttttgagatggagtctcattcttgtcacccaggctggaatgcagtggcgcagtctcggctcactgcaacttctgcctcccaggttcaagcaattctcctgcctcagcctcctgagtagctgggattacagatgcctgccaccatgcctggctaatttttgtacttttagtagaaacggggttttgccatgttgcccaggatggtctccaactcctgacctcaggtgatccgcccgccttggcctcccaaagtgccgggattacaggcatgagccaccgtgcccggacctcatgattgtatttatttatttatttaatattattattattatttttttttttttgagatggggtcttgctctgtcacccaggctggtgtgcagtggtgcgatatcggctcactgcaaccgctgcctcccagattcaagcaattctcctacctcagcctcccaagtagctgggattacaggcatgtgccaccacacccggctaatttttttgtattttttttagtagagacgaggtttcaccatattggccaggctggtctcgaactcctgaccttgtgatccacccaccttgacctcccaaagtgttgggattacaggcgtgagccaccacacccagccttatgattgtatttagactagacatttttttggtagtatattatttagccattgctgtgtaacaaattatcccaaaacttagtggcttaaaagaagcatttattatctcataaattttgtggatcaggactgggtatagctttgctgagtgcctctgcctcaaagtcttacaaggcagcaattaaagtgtcacctaaggctattgtcttatctgaagggtcaacagaggatggatccgcttctaatctctctcacatagttaatggcaaaattaagttccttgtggattgttagactaagggttccagttccttgctggttgttagcttgaggtctacctcagttccttgccatgtggacctccatagggcaaccagcttctgttagagcaagtaaaggagagtgccagagagggcaaatgtgatgaaagccacaatctttttataaacctaattttgaaagtgacatacaaggctaggcatggtggctcaaacctgtaattccagcactctgagaggccaaggagggtggactgcttgagcccaggagttcaagaccagcctgggtaacatgacaaaaccctgcctctactaaaaatacaaaaattagctggtctggtggtgcatgcctatagtcccagctactcaggaggctgaggccagagaattgcttgaacccaggaggcggaggttacagtgagccgagatcacaccactccactccagcctaggccacagaatgaaaccctgtcaagaaagaaaggaaggaacaagggagggagggaggaaggaagggaggtagggaggcagggaaagaccgagaaagtgacataccatcatttttgctgtagtttgttcattagaagcaaaatcacttggtccagcccacactctggggagatgattttctaactccatttgtaataacttattctacttttattagttggcattatacagtaagaaagagctttcttttctcttcttatttattcatatatggctcatgtgttttttccaatgagttatattctattactaacattttttattttgacctcaaattgttttagatgttaccaataagaacctcttcaagctggttcttgtgtccttttgccataactctctcattttcttgaaccctttcttactttctgatataagaaaatattagagactcatactttccttgttccagttctgagatgaaccatttatccaaaagccttgcttcattttagtagggaatagtatttagaaactaagatctgggtgtgaggtatgctcactgctaatgggctgtcactgtttctaggccttgtcagcagacggagctaggaaaaacacacataaacacacccatatttatatttgtacacacactccctcaaaatcgtgagttcatattgatacctccagttctggttcttcctagccttccccctttccatctttgtatttttattttccaacagtaagaaccctggctcccagtgctatgaatatatttactcatttgctccatccactgcactccagcctaggccacagaatgaaaccctgtcaagaaagaaaggaaggaatgagggagggagggagagaggaagagagagaaggaagaaggaagggagggagggaaaactgagaaagtaacataccatcatttttgctgtagtttgttcataagaagcaaaatcacttggtccagcccacactctggggagatgattttctaactccatttgtaataatttattccacttttattagttggcattatacagtaagaaagagctgctgaagatttgcttgcaattggttgtctttaaactgagggtatattgtcaaagtactgtgctgaaaagttacctgtagtatagttatgtgattcattaaaataaagtttgtttctattatgtgcagttttagagttttgccacactctggttgattagtatattttctgttgcttttttgttttgttttgttttgttttgtttttgagatagggtctcgctatgtcacccaggctggagtccagtggtacaatcacagctcactgcagcctcaacctcgtgcacttaagcgatcctcccacctcagcctcccaaatagctggggctgcaagtgcacaccaccatgactggctaattttttaattatttatttatttatttatttattttagagatggggtctcactatgtttccccaggctgaccctgaactcctggggtcaagtgatcctcctgccttagcctccaagtgctggtattacaggcataagccaccacacctagcctagtattcttttttgaatatgtaaaacattaacataaagtcaaaactattaaaaaaaggtgtactcagaaaattgtcattcctcccctataccttctgcctcattcacaccacactctgtagataatcgatttcattagtttgtggtttatcctcactgtgtttctttttgcaaaacgcaaaaacaaaacctatacatatttatattttcttatgtcctcttctttcttacacaaaaggtaacacactatgtaggtagtcctggctttgaacagtttcactataaaaatatttgttactacagcttaaataacataagtctcctaaaaataattcaaattttagttaccatggtatattaactttgagtagttccataaaggacaaacttggctgctagcccttcagtccacagagcactttgaaaataacagatgagcaaaataatgtggccaatcacatgacttctttcaaagtatgtcagtgatcagtcactgtgtgcctataatttagttcatgcacagacagcaaagcatgtagttgtgttgccttccagtgataaacccacataacattttagaaaaatgtattaagaattggccagcaaagataaaagtgcagcaaagaaacaaaagtgataatgttttcagtgaaatttgaattgaacataaatggagttatagaagaaatagctgaccatgggaatgttcacactgctactttcaagaatctctagaagggcagctaaaggagcttagtgaaggtgaatttattgacatgaatgagaaaagtaattgtgatgaaaaggatgaagatgtcccagagaaagtaatgccagcaaaaacttcacattaaaggaactctcagatatttcaaagcattgaaacctccaagaataaataaaatgttggaagttgatccaaacttagaaaggagtatggcaacttgtcaagatgaagaaaaggtgcttattcctttttatttatttatttagagacagagtttcactcttgttgcccaggctggagtgcaatggcatgatctcagctcaccgcaacctccacctcctggattcaggcagttctcctgcctcagcctcccaagtagctgagattacaggcatgtgccaccacgcccggctaattttgtatttttagtagagacagggtttctccatgttggtcaggctggtctcgaacccccaacctcaggtgatctgcccacctcggcctcccaaaacactgggattacaggcatgagccaccatgctccacctgcttattccatattatatgttataggatgaaaagaggccaaactaatcttgacatgttttttacaaggaaataatcctccatggttctaatttttttttttttttttttttttttttttgagacagagtcgcgctctgtcacccaggctggagtgcagtggcacgatcttggctcactgctagcaccgcctcccgggttcacgccattctcctgcctcagcctcccgagtagctgggactacaggcgccggccaccacgcctggctaattttttaaaaaatatttttagtagagacggggtttcaccgtgttagccaggatggtctcgatctcctgacctcgtgatccgcccgcctcggcctcccaaagtgctgggattacaggcttgagccactgcgcccggtgggtctaatgttttaaattacactgtgttaaataaatattagtttgttggttttttttttagtttttttatttctctacaaatttacaaccaataagagtttttaatgctttgacaaaaaatgttaaaggtcatagtacaatcgcatttcttcccattgattattaacatcactttacatagtttcatcttgcattagcaattttgtgtgtgtgtttgtggttttaaggagcggagagtttaataggcaagaaggaagggagaagacagaaggaaggagctcccccttacagagacagagggagcggggctccaaaagaggaggtccccatctaccgcggataccagccaggtatatatgcagaggctggtggaggtgatgtctgatttgcatagggctcaggggattggtttgaccaggcatatcattcacgtagcccgagaaaaagctggccctcccaccccagccttttaatatgcaaacgtagggcgccatggatgttctaaacacgtggagatatgtggggggcagccatgtggccaggaacttgtggggcaagggcaagaaggctgtgggaatcgccaagttgaatggacctagtttctaatggcctgcatttgcatatcaaaggttgctggcctggctcctagagccggggctttaaaagaaacttttccggagatgctttaaaaaatgaaaacttcccaaggaccccttttcctgtctatctgcataaaataatttcttttattatttatttatttatttatttatttatttatttatttatttatttatttattttgagacggagtctcgctctgtcgcccaggctggagtgcagtggcgcgatctcagctcactgcaagctccgcctctcgggttcatgccattctcctgcctcagcctcccgagtagctgggactacaggcgcccaccaccacgtccggctaattttttgtattttcagtagagacgggatttcaccgtgttagccaggatggtctccatctcctgacctcctgatccgcccgcctcggcctcctaaagtgctgggattacagaataatttcttaataactcctaccacattcctccctgtggcgatatcaaactaactgctgttaggaggctttgggcgaccattgcttctggctacttcctgctgaaaaggggcgtctaatggagaacagcagctagggctcctcctggggttgatctaagggtcctcggaagaatggcgtccatgtgtggttcagtttacagcaccgtttggagtttgattgcttctaggcgagaagaaacaattcaagttatagtattgagtatacagagtccaaatatcaatacaagacatataagcaagagagtgcttaataaaggggttaaccaattccataaagaagactggaagtaattaaagagggattgtagccactcggggctgaagcccacattttccctgagcctgtcaataattttgatttgatttttaagtccctgtagatttgcctcttctttactacaggtgttaatcccaaagaagcatgtttcatttaaaaatgcattactggccaggcgtggtggctcgcgcctgtaatcccagcactttgggaggctgaggcgggagcatcatgaggtcaggagtttgagaccagcctggcctacatggcaaaaccccatctctactaaaaatacaaaaaattagccatcgtggtagtgggcgcctgtaatcccagctaattgggaggctgaggcaggagaatcgcttgaacccgggaggcagaggttgcagtgagccgagatcgcaccactgcactccagcctgggcaacagagcaaaactccatctcaaaacaaaacaaacaaacaaacaaacaaaaactgcattactaaatccaataaaaagtcctagtagactcagtgatagtaaaactttcatgcttcctttttgccagtaactattatccctgctataaggatactaattaagcaaaatacgacagcaatggaaactctgtccaatatttcagttagaaggtgctaccatggataaccctattgcaaatagtagagtgaggaaagcagttcccacaaatgtggtgtggtaggtaatttccatctaaaattttacttgccaacatatagaattcccctctgtgggcctacgaagttccttggttttattttcccaaacaaagaaacctccgggttacaggtaccttacttactttcattacctggcacaatttgcaaaataattgcccagaactagcatattgattcacattttcacattacccatccctttttcccccccaccaagctgcagaagatcaccacttgattcacaggaataagcagggccagggttagtctaaaatgtaggcaaaaagcttaaaaacaattaatgagactagggtttaatgacaaatgtatgataagctttggagcaaaatttttctctccagtcctcatttttggtaaaaactaattatgaatgaactttaatcttatacttggcctgattatttgcatgaagtgcagcaagaatggttatttctacataggacttttggattggctttgatgaaacactgttccacaaggaatttcagattagacttttaaagctgagcccagacatgggtttgtatcctctaatacctgtgagttgggttatcctctcctcttgaggtcccaagataaactcagagcttccagacctgttagaaagtgacattcttcactgaccacaggttaggaaccctgtgtggggactgtgtagacaaggtgtgaggccagttctccccaaggggcttttattggctctgcatgtcaagcttgattccttaaagggaaacacaccctttcagttaaagccttggcaaaataaccggtttttccaattgtgttctgttgacaaagaaaaatggattcttgctgcactgatgcgaacaactatattgccgtaagttaagagtacttacagatagtctccaaattttagaggaaccaggcagagaaaaatgaacatgctccaaattttgttcacagtagtataccttacttgattattaaaggccataaatagtttaaaataagtttcctttcccagtccatgcaccaaaatgatacggctctgatgagtggaggaacaacagggttcctggtcctcatgctggtttagataaaatgacacagacacatgtggagtggttttaaggagtggagagtttaataagcaagaaggaagggagaagagagaaggaagacgctcccccttgcagagacggagcgggggttccaaagctgaaagaggaggtcccccacattaacaatttttaaaataccgtacaactgcagaaaatgaggactgcctgtacatactgtttgacactttgtttttttttttaacttatcaactttattttgtttgtttgttttggttttgggtttttgtttgtttgtttgttttggagacgagtctcactctgtcagccaggctggagtgcagtggcacaatcccagctcactgcaacctccacctctcgggttcaagcaattctactgcctcagcctcccgagtagctgggattacaggtattcgccaccacatccagctattggttttggtttttgagacagggtcttgctgtgtcacacaggctggagtgcagtggtgtgatctcagctcactgcaacctctgcctcccaggctcaagtgatcctcccacctcagccttccaagtagctgggactacaggcatgcacaccatgcgcagctaattttttctattttttgtggagacggggtctcactatgttgcttaggttggtcacaaattcacagcctcaagcagtcctcctgcctcaccctcccaaagtgctgggattacaggcatgagccaccacatccagccttaccagctatattgaagtataatttatataacataaaatttgccttttaaaattatacagtgcaatgcattttgacaattgtttacatctgtgtaaccaccatgcaatcaaaatatagaacatttctataaccttcaaaagttccctcatgcccctttgcaatcaattcactacttctccagctccaggcaacaactggtctgcttcctgtcactataaattagtgttgcctctttcagaatttcatctaaatggaatcctataacatatactattttgtatccatcttcttttactccaaagttcttgaaattcattcatgttcctgtgtgtatcagcagcgtgttccatttgattgttgagcagtattgcattgtgtggatatatcacaatgtgttcattcattcaactgttggtggacatttgagttgtgtccagtttagtgctattctgaattaaagtgatgtgaacaatcatgtacaagtatttttgtaggcatattttttttatttctcttggataaataccccaaaacagaattgttttgggggtcatatgaaatgggaagtatatgcttaactttataagaagctgccaaactatttttcaaaatggtaatatcactttacattttcatgagcaatgcataaagcgttccgcttgctacattttctcaccaatgcttcctattgtcaattttttaaattttagcaattctagtgggtgtgtgatactatctcattgaagtttcaactgtttttccctgttgactagagacactgagcaacttttcatgtgttgtctatttgtatatcttcttgaagcattcgttcatctttaactgagctgaacgccttcttaaaattgagctatgggagttttaaaatatatccttgtagctgggcgtgatggcaggtgcctgtaatcccagctactcaggaggctgagacaggagaatcgcttgaacccaggaggcggaggttgcagtgagccgagactgcaccactgcactccagcctgggcaacagagtgagacttcatctaaaaaataataattatacatgtaattatatatgatttttatatatgtaatatatatattcttgatgtgagctctttgtcacatacatattttgtggatattttatcccagactatgacttgtcttttcattttcttagttgtgtcttttgaagagcagaagatgtaattttgataaagcccaatttattttttcttttatagtttgtatttcttatgtcctattcaaaaactccttgcctactgaaaacttatgatgattttctcctatattttcttttagaagttttatagttttaccatttataatttggtctatgaatccttttgagttgatgtttatgtatggtgtatggtgtgaggtaacaatgaagattcatatttttttccaaaggaatatccaattgtctctttggaaaaatatgctgagaaggctatcttttccccaccaaataatcttagcaccttaatcaaaaatcatttggccatggacatatgtaggtgtgggttttttctgggctctctgtgttagatggatagatagacagatacagatatataactgtgtttacacatatgtaactgtaaacacagttatatatctatatatccaccaacagttgaatgagaataaactattgttataagcatatatacacattgtatatatatgtgtacatatacatattgcatatgtatgtatacatatatacacacaaagtatatatatgtatgtatacatatatacacacttaaagtaatggcctccagttcgatccaagttgctgcaaaggacattatttcatgccttttcgtggctgagtaatattccatggtgtatatatatatatgtgtgtgtgtatatatatgtattatgtatatatatatgtgtgtgtgtgtgtgtgtgtatatatatatatgtgtatatatatataccacattttctttatccactcattagtcgatggggacttaggttggtttcacatttttgcaattgtgaattgtgctgctataaacatatgtgtccaagtgtctttttcatataattacttattttcctttgggtagatacccaatagtgggattgctggattgaatggtagatctgttttttgctctttagagaatctccatactgttttccatagaggttgtactaatttatattcccagcagcaatgtgtaagtgttctcttttccccacatccacaccaacatctattgttttttgactttttaataatggccattcttgcaggaccaaggtggtagctcgttgtggttttaatttgcattttcctgatgattagcgatgttgagcattttttcatatgtttgtgggccatttgtataccttcttttgagaaatggctatttgtgtcctttgcctactttttaatgggattgtgttttatttttcttggtgatttgttagttccttgtagattctggatactagtcctttgtcagatgtgtactttgcaaagataatattttggatgttatatttccattataatttagttcaaagtattttctaatacaccttgcaatttcttctttgacccatggattattttaaagtttgttattttgtttgtttattttgagacagagtttcactttttttgcccaggctggagtgcagtggcacaatcccggctcccagattcaagcgattctcctgcctcagcctcccaagtagctgggattacaggtgcccaccaccacacccagctaatttttttttcttttttttttgagacagagttttgctcttgttgcccaggctggagtgcaatggcacgatctcggctcactgcaacctctgcctcctgggttccagcaattctcctgcctcaacctcctgagtagctgggattccaggcatatgccaccacgccaggctaattttgtatttttaatagagacggggtttcttcatgttggtcaggcgggtcttgaactcccgacctcaggtgatctgcccgccttggcctcccaaaatgctgggattacaggcatgagccactgcacccagtccaattttttgtatttttagtagagatggggtttcatcatgttggccaggctggtcttgaactcctgacctcaggtgatccgcctgcctcggcctcccaaagtgcagggattacaggtatgagccaccatgaccagcctaaagtgtattgtttagtcaccaaatatgtaagtattacccaaatatatttgtcactgatttctaatttaattgtattgtgatccaaaaatatacattgtatagtttctattcttttaaattcgttaacatttcttttatggcacagaatatggtctatcttggtgagtgttgcttacacacaactgtgtaactgaaaactgtgtattctgcttctcgtggttgttgtatcctataattgtcaactagatcaagttagtaagagtgttgttcagtgatcttttcttcttcagtgtttactgtatttgctaatcccatccagtgaagtttccatttcatatattgtatttttcacttttagaagttccatttgactctttcatttccatcctcaattatcttcatatttttctttaaatttttgagcacatttataatggaggttttaaagtccttgtctgctaattttgtcacctctgtaattcctatgatgattttcttcctggcttggggtcataatttgttgcttatttgcatgtctaataatgtttttattggacagcagacattgtaaatgttatatttttgagtgtttggattttgtctttctttaagaactattgcagtttgttttggaaggctattatgttttttgcagatcaggttgatcttttcaaggcttgtttttaagctttgttaggacaggtctgtagtaacttttgccttgggctaatttagacctaccacttaattctgacttttttgattaatctgagtgttcagcagggtctctttattatggctaaatgaaattcaaacattttccagccctatgtgaccatcaagaattcagctaatagctccctggcagttcttcgcccagctgcagaaaagtgtcagtgcactctatgtatgctcagattattatttagccaaagacttggggatccatattaatattcctggagttctttgtgtagctccattctctttagtactctatcccataaattctggctgcctcaatctcctaatctccccaaactctaatatctattcctcaactcagcaaaaccatggtgttattcttggatttcccctttcctgccccacagtctgaaagttgtctccaggcaaaaaaaatggagatcctagtttgcggatcctcatttccttctccttttttttttttttttttttttttttttgagatggagtctcgctctgtcacccaggctggagtgacgtggcgtgatctcggcttactagaaactccggctcccgggttcatgccattctcctgcctcagcctcccgagtagctgggactacaggtgcctgccaccatgcccggctaattttttgtattttgtttagtagagacggggtttcaccgtgttagccaggatggtctggatgacctcgtgatctgctcacctcggcctccaaaagtgctgggattacaggcatgagccaccgcgcccggcctgcttctcttctcttatgggttagaatcctgcactgtcttttgaacaaatgtctaaaagcttttatcacacattttgatccacttcccagttgttatagtggtatatctggtttcacatgactgaaaggaaaagttttcaccttgctttttgtactaataatatatcctggaaatcattctatataaatttatagaaatcttcatttttaaaatagcttcataaaactccattgtaaaaaccaggtgcagtggctcatgcttgtaatcccacactttgggaggccaaggcgggtggatcacctgaggtcaggagttcaaggccagcctggccaacatggtgaaactccgtctctactaaaaatacaaaaattagctgggtgtggtggtgggcgcctgtagtcccagctacttggaaggctgaggcaggagaattgcttgatttcaggaggcggagattgcagtgagctgagattgcgccactgcactccagcctgggctacagagcgagactccgtctaaaaaaaaaaaaaagcaaaaaaaaaaactccattgtatgtgcacatatcattatctgttcaacccatctatgacttgtcatttaggtagtttccatccaatatttttgcaatataaaaaatgctaatgaagaacctgagatatatatatatctatatatatagatatatatgtttgttgttgttgttgttatttttgaagtatgtacgtataataaattcctaatagtgtgattgctgcatcataaggtaaaggcatatgtagttttgttaaatatagctattccccatcttgcattcctacaaatagatgagaatgtccattgtcccatagtctcctttgcagagtatattgtcaagctttttaattgttgccaacctgatgggtaaaaagatatctccaaataattttaattaaaatttctcttattatgaatgaggttaaatagtttttcatatgtttaaaagccagtttatatctttttgtttttttagagacaggaatcttgttctgttgcccaggccaaattgcagtgatgcagtcatagctcactgtagcctcgcactcctgggctcaagcaatcctcctaccttagcctcccaagtagctaggactacagatggatgccaccatgtccagctaatttttttatttttttgtagagatgtgaggtctcactatgttgcccaggcttgtcttgaactactggcttcaagtgatcctcccacctcagcctcccaaagtgctaagattacagccatgaaccaccacaaatgaccctatatatttttttgaattgtctgttcatgtcttattttcatttttctagtagttttttttttaagtgttttagcctaaatttgtaaaaagtttaggggatatatgaagggactctaaatgtttatgaagaaatttaattaaaagataaaaataaaaatataagctttatttttcaacatgagctccatcaagttcaaggcacttttgtaagcaatgatactagccatttagttcacccctaaagaactgagagtcctgggaatttagccatgtcaatgcagtattttttatattggttactgaagaaaaaatgggtgccctttaaagttgtaagattaggaacaaaaacaagtcagaagaagccaaatcagcactgaaaggtgggcacttaatgattacccaagaaaactctcaccaaattgcccttgcttcatgagaggaatgagcgggagcattgtcgtggtcaggaaggattctggggaagttttcccaggcattttttctgctgaagctttggtaactttctcaaaacactctcataataatcagatcttatcactctttggccctccaggaagtcaaccagcaaaatgctttgaacatcccaaaaaagcgcttgccatgacatttgctcttgaccagtctgcttttgcattggtcaaatgccaccacttccacctcttgtgctttgttttcaggatcagactggtaaagtcatgtttcatctcttgttacagtttttttttttttaagaaacccttcaggatcttgatcacatttgtttaaaatttcaactgaggctgggcccagtggctcatgcctgtaatcccagcactttgggaggccgaggcgggcaaatcacgaggtcaggatttcgagtccatcctggctaacatggtgaaaccccatctctactaaaaatacaaaaaattagccgggcatggtggcaggcacctgtagtcccagctactcgggagggtgaggcaggagaacggcatgaacccaggagacggagcttgcagtgagctgatatcatgccactgcactccagcctgggcaacagagtgagactccagctcaaaaaaaaaatcaagtgaaaactctggtcttaaactgcagctgatctattttatttttattttttttcagacacagccttgctctgttacccaggctggagtgcagtggcaccatcatggctcaatgcagccttggcctcgtgagctcaagcaatcttcccacctcaggctcccaagtagctgggactacaggcacatgctaccatgcctggataatttttttgcagctaatctagatgtaatggttttggcacccatctaatggaaagtttgctcaactttaatttttcagtcagaattgtgtaagctgaaccgagatgtctatggtgttggctattgtttctgctgttaattgtaggtcttctttaattagagcacagacaagatcattttttttcctcccaaattgatgtagatggtcttttgctgtgggcttcatcttcaacattgtctcatcccttcttaaaacaagctagctacttgtaaactgccgttttctttggagcattgtctccataaacttttcacaaaacatcagtgatttcaccgttcttccactcaagcttcatcataaatttgatgtctgttcttgtttccattttagcagaattcatgttactctgataggggctcttttcaaactgttatcttattcttcttagtgcctcaaactagatcctattcagacatggtataacaagttagtatgggtttattttggtgcaagaaatattttgaaatccacacatttttttcataatatgcattttccatgaagtttttgaaaactccttgtattaggaatattagtcctttgtccagtaaacagactgcaaatattttctcacagctcatcatttaccttttggcatttttttgcaatgcaatttttttccctttgtttttgttttttgtgtaatgaatcaatgttttcttttttttttttttttagaccaagtctcactctgtcacacaggctggagtacaatggtgcaatctcagctcactgcaacctctgcctcccaggttcaagtgattctcatctctcagcctcccaagtagctgggattacaggcacatgccaccatgcctggctaatttttgtatttttagtagagatggggtttcaccatgttggccaggctggtctcgaactcttgacctcaagtgatccactcacctcggcctcccacagtgctgggattagagacgtaagccactgcccccggccaaatcaacgttttcttatattgcatttaggttttaagtcatagttagaaagcctttccccacacctaggttatagaaacattcattacttttttcttccagtgctagtacttgcatggtttttggtttccacatttagatccctgatctaattggagtttattcttttgtgtgctgagatatggatctgattatatcttttttcccaaatggctatccagttgtcccaatgccatttattaagcacttcatctttgtcccagtgatttgagatagcatctttatcatgtaccaaacttctatagtgccagaagatttttattttttttagacagggtctggctctgttgcccaggctggagtgtagtggcacaatcccagctcgctgcaacctccgcctcacatgctcaagtgcccgcacctcagcctctcaagtagctgggactacaggcacatgccaccacaccaggctgatttttatatttttttgtagaatgagatttcaccatgttgcccaggctggtctcaaactcctgagctcaagaaatccgcccacctcagcctcccaaaatgctaggattacaagcatgagccaccacacccggctgccagaaaattttaatgatcagaaaaccacaattctttcttcctctgttatatgttgaagtaaaatacttcatttagaaaactaagccgggcacagtggctcacacctgtaatcccagcactttgggaggttgaggcaggcagatcacctgaggttaggagtttgagaccagcctggccaacatggtgaaaccctgtctctgctaaaaatagaaaaatttgctgggcatggtggcgggtgcctgtaattccagctacttgggaggatgaggtaggagaattgcctgaacctgggaggcagaggttgtggtgagccgagaccacgccattgcaccccagcctgggcaacaagagcaacggtaaactccatctcaaaaaaaaaaaaaaaaaaagaaagaaaaaagaaataactcagccatacaaggctacccatttggtgagaactaataataagttagatagcaaggtaatagcaaaatgtgggtgcaaaattaaagcaagttatttctgaggagaatgtaggtctcatggaagattttcatgtggacaaatttagtaaattttttgcaggtagtttcctgacatatttaacatttgtgatatagtaaacaataagaaggtactaaaggctgggcgcggtggctcacgcctgtaatcccagcactttgggaggccgaggtgggcggatcacaaggtcaggagatcaagaccatcctggctaacacggtgaaaccccgtctctactaaaaatataaaaagttagctgggcgtggtggcgggtgcctgtagtcccagctactcgggaggctgaggcaggagaatggcgtgaacccgggaggcggaacttgcagtgagccaagatcaagccactgcactccagcctgggcaacagagcgagactccatctcaaaaataataataataataataaggtactaatatgatccagactagaagagaatagcactaaaatgggagatggggtaaacctgtggttttttttaccttaggcttttgacttccaaaattattgtttttgctgggtgcggtgggtcactcctgtaatcccagcactttgggaggccaaggtgggaggattgcttgagcctaggagtttgagaccattctaggcaacaaagcaagaacctgtctctaaaaaaatttaaaaattagccagaaatggtggcacatgtctgtagtcccagctacttgggaggctgaggcaagaggattgcttgagccttttgaagttgaggcttcagtgagccatgatcaccccactgcactccagcttgggcaacagagcaagaccccatctcaaaaaataaaacaaaatagactgggcacgatggctcacgcctgtaatcccaccactttgggaggctgaggtggatggatcatgaggtaaagagatcgagaccatcctggccaacatggtgaaaccccgtttctactaaaaatataaaacttagctgggcgtggtggtgcacacctgtagtctcagctactcgggaggctgaggcaggagaatcgcttgaacccgggaggtggaggttgcagtgagccaagattgtgccactgcactccagcctggcgacagagtgagactctgtctctaaataaataaataaataaaacaaaataagtaaaataaaataaatgtttgtagttccaaaatattttgatgacataatttcttcttgttctaataaaactacatatgcattggtcctatgacctagtaatcacactattaggaatttatcataaatacacacctcaaaaattacaaaaatacatatataccagcttatttattacagcgttatttgtaattgcaaaaacattgtagatagaatggaggtcacataaaacttattcttaagattcagaccgggtgcaatggctcacgcctgtaatctcggcactttgggaagccgaggcaggcagaccacccgaggtcaggagtttgagaccagcctggccagcatggtgaaaccccatctgtaccaaaaatacaaaaattagctggtcgtcgtggcacgcctgtaatcccagctactcgggatgctgaggcgcgagaactgtttgaaccccggaggcagagactgtagtgatctgagatcatgccactacattccagtctgagcaacagagcaagacttcgtctcaaaaaaaaagatcatagatcatcttatcaaatcaaagtatgcaaaatattcaagtaaacttcagataaatatgaaggctaaaccattcagcttcttcaccaaacccttgaatgtcccacctgtctaaatggagatacatgtttgtttgatttattggttaactgtttttattccatttttcctcaaatgatcccataatttgaccttaggaagctgttcaaatagacacattaggttgaatggaaagactactcgatgatatttaggattttaagaggattttatgtattttttccttgtgtgcaataatttaatagcatcttgaataggattttctgatattactaaccctctgggaataatattaggtaattagacagttagctaatattaaaatatgtatcaggtaatatttattgagagtttcctctgtgccaagcaggatcaacttcataggcaggcgacctgtgcggggacacagggcttcatgcttagataggcccccttgctttgaaggcccctaccctttggttagggctctgctgttaccatcttgaaattcttaataatttttattttatttttttgagtcagggtcttgctctgtcgccctggctggagtgcagtggactcactacagtcttgaattcctgggctcaagcaatcctcccacttcagccttctgagtagttaggacgacaaacacacgccaccatgctcagataagttttttgtttgtttgtttttttgtttttgtttttgttttttgtagagatgggactgtccctatgttgctcaggctggtctcaaattcctggcctcaagtgatcctcccacctcagcctcccaaagtgctgggactacaggcatgagccactgtgcctggtcaatcatttttattaacaagcccaagccctcttttttttttttttttttttgagacagggtctccctctgttgtccaggctagagtgcagtggtgcgatcttaccttcactgcaacctctgcctcctgggttcaagtgattctcctggctcagcctccctagtagctggaattacaggcacccacccccatgcctggcaatttttttgtatttttagtagagatggggtttcaccatgttggcaaggctggtctcaaactcctgacctcaagtgatccacccaactcggcctcccaaagtgctgggattacaggtatgatccactgcgcccggcctccaagccccctatttttattttgcactgaccctacaagttacgtagctaggcttagttatgtttttagcaaggaaagtgtataatctcatgtaccttttgaaagattactcaggtctctgcatgtgaaatggaatttagggaatgcaagagagggagtaaaaataacagcgaggaagctatgatagcatttaaggttgctttgactcaggggtagcagtagatagggtaagtaattgatagtttcaaaatatattttgggagtagtaagcattggtatggattagtaatatactggatgtggggatgcagaaaaaaatattaaaaattacttctgaaattctggctggaatagaagtgccacttaccaggtaaggaaggttggagacataacatatttgagggtgtggtcaaaagatgagtttgacattatgctatgtcatataaaagacatataaaagactacctattttataattcctttttaataaaatattcagaaaaagcaaaactgtggttgcctgaggctgaagctaggaagattgactacagacaagcatgagggaaattttgggggtgatgagagttttctaaaactggattgtggggttggttgcattactgtataaatttattaaaaatccctgcatcgtataggggcactatattgtatgtagaaagctgtgaaaagattttaaaaatgattgacatgtctgtggttatatcaatgagtactattattattcccattttatacataaagaaaataaaagagaagttaaaaataaaagtttcatggttacatagctactaggtgtaatatccagtattggaatttgaatctttttgacactaagaccttactctcgatcatataatacattcactttctattttaaagttatattatagccgggcgcagtggctcacacctgtaatcccagcactttgggaagccgaggcaggcagatcacgaggttgggagatcgagaccatcctggctaacacggtgaaaccccgtctccactaaaaatagaaaaaattagccaggcgtggtggcacgcacctgtatcccagctactagggaggctgaggcaggagaatcgcttgaacccagaaggcagagcttgcagtgagacgagatcgtgccactgcactccagcctgggtgacagagtgagacaccatctcaagaaaaaaaaaattatattataaatgctgcatctcattggtcagaagctctcttgaaattataaaacaaagaagaaaaaagataaagactgggaaattgtgttgaatcagtatataaatcctgtatactggtccttccatttcccctagaaataagtgatacaggccaggcgctgtggctcacacctgtaatcccagcactttgggaggcggaggctggcagatcacctgaggttgggagttcaagatcagcctgaccaacatggagaaacccccgtctctactaaaaatagaaaattagctgggcatggtggcacatgcctgtattcccagctactcgggaggctgaggcaggagaattgcttgaacccaagaggaggaggttgtggtgagccaagattatgccattgcactccagcctggggaacaagagtgaaactcaaaaaaaaaaaaaaaaagaaagaaaaagaaaaagaaagaaggaaggaaggaaggaaagaaagaaagaagtgatacaacaagttacagcatctttgtttattatccactgtgagttgtattaccacactttacttggctctttggcaaactatattatctcttcagatcactagggctaggaaggcccactggtaacttgaaggagtaaatgtatcttctaaaaaatgcttacttccagggagattggatccacacaagtgaatacatatatagtccttagtgtatgctatgattattttactatgtcagtagcataaagattgctatattaataagcattaagtgcctgctgtgctagacagtgaggatgcaagtggccaccaaaatagcatggtccctgccctcctggagcttctttttttcttcttcagtgggggaagcagatactttgcttatgcaaaaataattataaaatttaaagttgtgccaagttcaatggaaaaaatataaggtgttctgagagagcataacaaaggatcctggttttaactggggcctaatggaagacctctattaggaaataacatttaaactaagaccagacagacctgtagaaattagcaaagcaaagggagggaggaaaaagcagctttcctggcaaaggaacaatttgtgtgaaggccctgagacagggaagggctggggttctgaccaccctccaagtggtgcaatggaatatagtgagagagggagaagacatgagaacttggatactatgcaaaggatttggtattttaattcaagagcagtatgatgctactgaggagcagctggacaattgtgtgatccaattaaaattttaggaagatgaacctcgctattgtggagaatgcatacacaagggttctgttggttcatgaagaggtcttaagaaaactatgagctgggtgcagtagctcaggcctgtagtcccatctacttagaagtctgaggcgggaggatcccttgagcccaaggagctggaagttacagtgagctatgattattccactgtactccagcctggatgacagagcgagatcctgcctcagaaacaaaaaccaaaaaacaaacaacaacaaaaacaacaacaacgaaaatctcagaaaactacaggccttattatcaagaaaatgacaggccttattattgagaaaactacttacatttttaaaagctgattttcaaaaaccagattgtgaattaagtgatgctgaataggggaaaaaaagactgataaaccagtgtatctctgaataacccactagatcagtgcttgtcaaactttaatgtgttttcaaatcaccctgatgttttgttaaaatgtaagtcatgtctcagtaggtctagaggagggcatttctgcatttctaacaagctccccggtgatgcctagaccattggtcctcacactttgagtagcaagtgattgggctatactctttattctaaattctaaatgtattctatcttctaatgcctatcagccctcttgctggtctggctaattatcaaacttgagcatttaaaactgggggttttcagagattaattgaagtgttaaagacatggaaatataggtcacatatggcttttcatctcttccggaaatatcctatatatccttacttcttttctacctacctaacctatgtgcctaccccttcacttatgttcaaggttctattatacttcaaaaggactctatgcaatcaaagtgatgtccaagacaaatatacagaaatagtatgaggctctaacactttacatctaatggagtggtttgcatcattaattgaggcttactctgtgccaggcactttacctgccttcttcatttaataggataggagcaggaactcttagaggttcatttcttgttcaaggatatacatctcatctctggcttatatcacagtggactcttttattcactatcctaatcattataattttgtttggtgacaacaattctaaatgcagaaaagttaaggctctttattctgtgactaaaggctttgtattttctaaagatttgtggagctttgctgccattatttcaataattttataaagatcctaggtggtaaataggcctggctttttttctttttgaaatcttctccgtcttcttcttcattagcagtgcaacttcttgtggcatatggtacccaagatcttgggaaaaggattgatcaagtaaagggaaacgatagagagagtgtgctctacaactgagatcatgctccttgtgaaagacagggtagggaaatttcttattgctccctggttcttaagaaatgagagctaacaatgacatccagttttaaaagaaataaaatctgaattgtacttttaaattttataagccagagttaaaccaatagattgtaactcctgctaatttgatagtagctccagataatgaggaagtgacagggaatgctaatttcatttggtaagagataaaactgaaattattaatgtctccacggaaatgctaaatgcctccttacaagtagggtccggctaattgtctgtcttccaacaagccagatttgttggtgtttttccagacaatgttgtgtagttttcggtttggttcgatcccctttcttgtgatcaaagaaagtgattcaaatgtttaatgagtcttgatttggattggagacttgcagaacggctagcctcacagccccaaggctggctttccctaaggtaggtttcctatgcaccgatactggcaaggcgctttggctggaaactctggaaggaagccaaaggaaagtgaagttcctggcgctagcgcgtgtcctgctcagagagcccggcgctagctcattcttcgtgcagttattggctgggactctgtgtgccgctgtcggccaatgaagacgctggagatcgggcccctgcccgtcccctttctgcgccccgggatgaggcagagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattgcaaagtgttggtggaggttgtggatgtgaatgacaacgccccggagatcacagtcacctccgtgtacagcccagtacccgaggatgcccctctggggactgtcatcgctttgctcagtgtgactgacctggatgctggcgagaacgggctggtgacctgcgaagttccaccgggtctccctttcagccttacttcttccctcaagaattacttcactttgaaaaccagtgcagacctggatcgggagactgtgccagaatacaacctcagcatcaccgcccgagacgccggaaccccttccctctcagcccttacaatagtgcgtgttcaagtgtccgacatcaatgacaaccctccacaatcttctcaatcttcctacgacgtttacattgaagaaaacaacctccccggggctccaatactaaacctaagtgtctgggaccccgacgccccgcagaatgctcggctttctttctttctcttggagcaaggagctgaaaccgggctagtgggtcgctatttcacaataaatcgtgacaatggcatagtgtcatccttagtgcccctagactatgaggatcggcgggaatttgaattaacagctcatatcagcgatgggggcaccccggtcctagccaccaacatcagcgtgaacatatttgtcactgatcgcaatgacaatgccccccaggtcctatatcctcggccaggtgggagctcggtggagatgctgcctcgaggtacctcagctggccacctagtgtcacgggtggtaggctgggacgcggatgcagggcacaatgcctggctctcctacagtctcttgggatcccctaaccagagcctttttgccatagggctgcacactggtcaaatcagtactgcccgtccagtccaagacacagattcacccaggcagactctcacggtcttgatcaaagacaatggggagccttcgctctccaccactgctaccctcactgtgtcagtaaccgaggactctcctgaagcccgagccgagttcccctctggctctgccccccgggagcagaaaaaaaatctcaccttttatctacttctttctctaatcctggtttctgtggggtttgtggtcacagtgttcggagtaatcatattcaaagtttacaagtggaagcagtctagagacctataccgagccccggtgagctcactgtaccgaacaccagggccctccttgcacgcggacgccgtgcggggaggcctgatgtcgccgcacctttaccatcaggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacaggtaaggtttagcaagtcatgcttgaccctgttagtgcttttttattcctacatcatattgaggaaggaatggagctgtttttttagtgatgaagatgttttcctggtgatgcattcacactttcaactggcccttcctagatcaaagttagtgcctttgtgagatggtggcctgccagagtgtggtttgtggtcccatttcagggggaagatacttgactcatctgtggacctaattcacatcctcagcactcttttgctatcacaactaaccaatcttgctaagggatggttaagctaaaacacaagatctcagcgatcagagtttagcttggtatcatttacattaggaataagctgctggatacctctaaccagtggcagcttctaggaatacaaaaactacctcattcctccacctttcaagtgattgtgacatttgtattaaaactaatagctttttgataattttcctttgtttatacagatcgtgtacctcattctcagataattttttatgaatgaaatgaaattccaggcatcctttaaattttatttcaagcattctactggaaatgatgtgcaccctgcttacaaaatatttttaccttataacagtaatgcatgtttgctagaaaattcagaaaatacagaaaagtatttaaaaaattaaaactataatctccaaacccaaagataaccatttttaattataaaagtaataatttatttcaaaaataaatctaggcaacccaagaaaacataaagtagccagactcagtggtgtgcacctgtagttcttgctgctcagtgcctgaggtgggaggattgcttgagcccaggagttctgggctgtggtgcactatgctgatcaattgatcaatccactgtctgcactaagttcagcatgaatacagtgacctcttgggagggcaggaccatcaggttgcctaaagaggggtgaactggcccaggttggaagtggagaaggtcaaaactgctgtgctatccagtagtgggatgacatctgtgaatagccactgcactccagcctaggcaatatagggaaaccatgtctctttaacaataacaacaacaacaacaacaatcccagaaactacaaaaggagagtctttttggtgcctccagtgttagtccctgtccttccagccttatttttcttaagtatatgcacaatgtgaaaggtagataaattcatatccttagacaggtaaagcattcattaattcagggtggtatgcaaggatactatccaaggcatggtatccatgcaaggtgactgcaaggcctttgccctggagagaaccctatacatactctcaactgtaggagaaacactgttattttgttactcagtgcatcattgctatcaactcttggatttggcagttagtcaaatgaggttctaccatttaccaactaggagtctgtggccaagttactcaatctcctttctaagcctcttcctcatatgcaaaaagggaataataagtgttttataagattcatgcatgatataatgtatgcaaagtgtttagcatggtgcctggcatatcataactgttaaacaattattagccagctcctagcattttgggaggctgaggcaggcggattgcttgaggccagcagttcaagaccagcctgagcgacatagtgagatcctgtctctacaaaaaaaaaaaaaaatgtgttttcattagctgggtgtgttggcatgcacctgtggtaccagctacttgggaggctgaagtgggagaattgcttgagcctgggaggttgaagctacagtcagctgtgattgcaccactacacttcaaccatggcaatagagtgagaccctgtctcaaaaaaaaaaattatcagctattactataattatttttattagttcctcactcacctaaaatctcaaacacaccttagaaatacacatatgagaacaaccaaaaatgacaaagtagaagcacatatgaaaaggctaagaaagcatgaaagccagcaagaaataactgccgctcttctggtcagcctggaaagcaactggcattttccctagaacaatgttttcaaacttggttgcacattaaaatcacctagagaccttttaaaaattctgaaacccaggccacaccccgacaaatgaaagcacagtctctgggggtgggacataggcatcattttttgaaggtccccacttgatcctaatgtgcagacaaatttgaaaaccacagctttgggaggctgaggtgggtggatcataagatcaggagtttgagaccagcctggccaatatggtgaaaccccgtctctactaaaaatgcaaacattagctgggcatggtggcgcatacctgtagtcccagctactctagaggctgaggcggaagcatcagtgagggagaatcagtgaacccaggatgtggaagtttcagtgagcccagatcacaccactgcactccagcctgggcgacagagcgagactccacctcaaaaacaaaaagaaagaaagaaaaaagaaaagcagtactctggaacctaccaatccatcatttagcatatttgtgaagtaaagtgttattctggtatttgcagaaccagaatccagctttattgggccaggcccaatttttttaaaaaacatggtaaggtctcccagccttaaagtattacatagcatagctctaaaagatcactgtaggaagacataaaatggtatttcagtcatctaagggaaaaaccttcctaaagcactagcccctggacaactattatttaaacatctacagctgttcaatagatattgggttctttttggagggatgtgacaaaattcttgtataattagattgtgatgatgattgtatcagtttagtacatgtaaatacactgaaaaccattggattatacactttaaatatgtgatttgcatggtatgtgaattatgtctcagtaaaaatctagagatggggctgggctcagtggctcacgcctgtaatcccagtacttagggaggctgaggccagcggatcacctgaggccaggagttcaagaccggcctggccaacatggtgaaacttcatctctactaataatacaaaaatcaggccgggcctggtggctcacgcctgtaatcccagcactttgggaggcggaggcgggcggatcacgaggtcaggagtccaagaccagcctggccaacatggtgaaaccccgtctctactaaaaatacaaaaattcaccaggcgtggtggctgaggcaggagaatcgcttgatggtggaggttgcagtgagccgagatcgcgccactgcactccagcctgggtgaaagagcgaaactccatctcaaaaaaaaaaaaaaaaaaaaaatcagccagatgtggtggcaggtgcctgtagtcacagctacttgggaggttgaagcaggagaatcgctttatctcaggaagcagaggttgcagtgagccaagatcatgctgttgcattccagcctgggcaacaagaacaaaactcactccatctcaaaaaaaaaaaaaaaatatctagagatgggagaatcatatggctggcataaaaaggtcaagtcaaagatatgtaagattaaggctttacgatgctccagttctagtaaaacagaccaggtacttgttttggtgtgaaattgccaatataagtatagtactgtacatattagttgtttagcttaggtaagtcttttaatctctttaaactccagtttcctcatctataaaataaagagaatatctactttgcaaacttgttgtgagagtgaaaagtaatgcatataaagtccctgtatggagcaagtactcaataactatttgttgaactaaaaatgataatactgatattcaccatttattagcatccctatgtgccagacactgtaaacaattaaaagttatcattctggtacccagagtacagtatgagacagacatgcaaaaaaaaaaaaaaaaaaagataatggagatctgcatagcataagatgcagtgggaccaaacgggaaaaaacacctaaatgagcctggagaaaggaagaaatgatagaggtggtgatgcttgagctatgatctaaaggttgagtagtagcttgtcagacagtaaaggggaaaggacagggcagggaggggccattgcaagaaattccatgcagagggattatggtatttcattatcactgaaccttaaactgtgtgtgtggccgggtacggtggctcatgcctgtaatcctagcactttgggaggccaaggtgggcagatcacttgaggtcaggagtttgaaaccagcctggccaacatggtgaaacctcatctctattaaaaatacaaaaaattagccaggtgtggttgtgggtgcctgtaattccagctacttgagcagctacttgagaggtcgaggcaggagaattgcttgaacccgggaggcagaggttgcaatgagctggtgtcaggccactgcactccagcatgggcaacagagagagactccatctcaaaaaaaaagtgtgcgtgtaaaacagacagtctttgtaggagatgaggtgaagcaagtaggcaggagttagatcctgagttacctttgggccaagccaaggagtttttattttattccatatagatgacagtcactgcagaaatttgaactgatatgcatatatcatgaggtttttttgttttagaaatattattctgtcagtcataagtgaagggactggggacattgggactggaggcaaagagatcttatctctttgcaatagtttgaaagctattgcaatatttgaagagaagattgataaatgcttgaaccagcacagtggcagtacagatggagggagctgactacaataaaatcatcaggacttgttgattgacatgatataggaagtgagggacagggatgagtcaaggctgatccccctagatcctgactaaggaagctgggtggttgacagtgccattcacagagacagtgaattctggcataaacacctaataggtcaggctggtttacacctccatcattcccatgggagaaggtatagaggggtgtgtgtttgtgtgtgtgtgtgtgtgtgtaaaagaacacagaaagccagattcctctttttgacaccagaatattggttcccaccatagtcaaaaggatattcctgaggatcgaggcttggaaaaatattggggaaggataagaactccagttgttgctgctttttttggcagccagtgtaacctaggtaaggacttggttgaattaagaaatttcatgtccagatcaggatggatttttctatttctctgagctctggtgtgtttcccactcagattgcaggtcgtaggtacctacggtgtgaattgtgttgtgtttctgtgcttgtgcaagggagtagctaggttgctgggaggtctggatgagggtgggggtggggtgagatcaagtctccagctccaagaggtcccctggggctaagtgaaaagcttgctcttttgaaatggtcttcgttggtaattaacaaaagatcaagaataccttggtgtcagataaagggaatttgtaggcacaatgctgttggtagctgatctcaatcattcaaggaagctattaaatctatgaacattagcattctgccaggtaaagagatctggtccttagcacctcccagacacactgattctttactgttttgaaacatctccctctcctggcttcctccaccccgcttccatactgtccttgaaatcaatgaatggtaatttagtgtatctagtgtatcactagcaaatgtctgaataagaaaggtttggtttccgctgtgtctcctgttacaatgagaacatgtactgcataaatttaattggctacgttaatgtgtaagccttttctgcaaagagatggatccgtttctgaatattctgcagaagggcagagttttgagtatatggcagtggttctaattagcagttgctccaatacaatcagactgagacggaagctactcatttagaatactggttgatgacaacactggcttgaacaaagtgaccactctccaatggctactctccctctcagtgggccgcaggttgctagggctcaggctgtggctgttttccccgccgaaaaggggcggggtcagtcggtgtgttaggaaaaaaaatgtatatatatatatatgttgtctgcctccccacagagataacaacccgtggaaaaacatgccgttgagcgggaggaaggcgaaaagataggctgggttttttggggggtgggggagcgtggaggatagggtgggctttttcccctccaatgctgcgacgcattaaccctgctgctgttgggacgttctctgctcagcctattggctgagcccgggagccgctgtctgccaatcgggtggtgaaaggcagacaaatctaccccgccaccagcaaaaacggcgcgtaacccttgcggcgccggccgaaccgcgccagagctggcgcggggaaagggagataggtgtctccagctgctgtggctgtttggggcgggtcggcttcatccgcgtctcaggagcaagtagagaattagcgggcggcagcaatgctccgcaaggtgagaagctggacagaaatctggcggtgggctacccttttgttcctcttttaccacctgggttacgtttgtgggcagatccgctacccggtcccagaggagtcacaggaagggacttttgtagggaatgtcgctcaagatttcctgctggatacggacagtctgtcagctcgcaggctgcaggtcgctggagaggtgaaccaaagacacttccgtgtggatttggacagcggagccctgctcatcaagaacccaatcgaccgagaggcactgtgtgggctcagtgccagctgcatcgtgcccctggagtttgtcaccgaaggtcctttggaaatgtaccgagcagaggtagagatcgtagatgtgaatgatcacgccccccgttttccgcggcagcagctggacttggaaattggggaggcagctcctccaggacagcgtttcccgttggaaaaggctcaggatgcagatgtggggagcaattcgattagcagctataggctgagctccaatgaacactttgcactggatgtgaagaagcgcagcgacggcagcctggtcccagagctgctcctggagaagcctttggatcgagagaagcaatcggactaccgcctggtgctgactgctgtcgatggagggaacccgccgagatctggcaccgcagagctccgggtatccgtgctggacgtaaacgacaacgccccagccttccagcaatccagctacaggattagtgtgttggagagcgcaccagcgggcatggtgctcatccagctcaatgcctcagacccggacctgggtcccagtggtaacgtcaccttttatttcagtggtcatacccctgatcgtgtaagaaacctctttagcctgcaccccactactggaaagcttactcttttggggcccctagactttgagagtgagaattactatgaatttgatgtgcgggctcgcgatgggggttctccagccatggagcaacattgcagccttcgagtggatctgctggacgtaaatgacaatgccccttacatcacagtgacctcagagcttggaaccctccccgagagtgcagaacctggcactgtggtggcacttatcagtgtgcaggatccagactcagggtcaaacggagatgtgagcctccgcattcctgaccacttgccatttgccctcaagtctgccttcaggaaccagttctccctggtgactgctggacccttggatcgagaggccaaatctagctatgacatcatggtcactgcttctgatgctgggaaccctcctctcagtacccacagaactattttcctcaatatttcagatgtgaatgataatccaccctctttctttcagaggtcacatgaggtgtttgttcctgagaacaatcgcccaggggacctgctttgctcccttgcagcctctgacccagactctggcttgaatgcgcttatctcctactcactcctggagcccaggaatcgagatgtatcagcttcctctttcatctctctgaacccccagacaggagctgttcatgctactcgatcctttgactatgagcaaacccagacactgcagtttgaggtgcaggcccgggatcggggcaacccaccccttagcagcactgtaacagttcgtctatttgtgctggacctcaatgacaatgctccagctgtgctccgtcctcgggcccggcctggttccttatgtccccaagcactgcctccatcagttggtgctggccacctaatcacaaaggtgactgctgtggacttggattcaggttacaatgcttgggtttcctatcagctcctggaggccccagatcccagcctgtttgcagtctctcgatatgctggggaggtgcggacggctgttcctatcccagctgacctcccaccacagaagctggtcattgtggtaaaggatagtggtagtccaccactctctacctctgttactctcttagtgtccttagaggaagacactcatccagttgtcccagatcttcgagaatcttcagctccaagggaaggagaatctcgtctaaccctctacttggctgtgtccctagtggcaatttgctttgtctcctttggctcattcgtggcactactctctaagtgtcttcgtggggcagcctgtggagtcacatgctttcctgctggcacctgtgcctgtctcaccagatctcgaaggagggaggggcttcccccttccaatgggatcctccgaatccagctagggtcagatgaccctatcaagtttgttgatgtgggaggccactctcatggctgtacacccttggcttctgcacccactcggagtgatagcttcatgatggtgaagtcacccagtgcacctatggcaggggagcctgttcgcccaagctgcccaccctctgatcttctctatgggctagaggtgagacctttgcaggctcaacaaatgcttgagggttattctgatccaggcatatggctaggccatgtcctagagagtactggcctctcagtaagtgcccatagtgatgtcaccatttttgtaagaggtaactatgtggtagacgctgtgctttgtaactgtttcgtgaattaaccagagttgtcacagtttagcattgggggcgggtcatgcctatatctgagtaagaaatgaaagtaattggtgatcaagagccaggctgttgtggaagcatgatgatggaatgtgggagcacaggaggctacagtgcacagggtacagtgcaccaggcagtcacttggacaaaggtggctgttttctctactcttcctgaaagaggggatcagattctgaagtaccttaactctaggttaccatttcccaagggattgaggggaaataaaatctttgtctcccagtatctagtacactgtgaagggacctctctatttgaaacatagagacagcagaaagaggagagaactaaaggaatagagaggcacgcatcagagtggtggcatagatcttttggtctgggtcttaggactcatatcaagtccctactggggatttgaactagatgcggtaaattggaaggttggggcgggttggtcatcacctttggaaaaaacagtaagtgaaatcacttatgtcagaaaactggtttacagttggctgattcatagaaacagccaccctgtgcatctttaagttgagttctcctgaatttggtgaaaccatgaaacctagaagccaagccatccatgcttggcctctgaccaccctcctgggtgacctgattcagccccagaaatgttcccctacccaaaaactgtaacactcattccacatttggggtctggggtgtcagaaaagctaagtcccatgtcagctgacattgagatttccgcaaagcattgctggagagtcagggcaagactttacaaggttcttactaatcttttctctcaccttagcagcattcagcaggatgggggagggtgggggaatacatgggctttgcctctcccagaaggacaagattttgctggttcaagcaaagtggtggaagcttctgaagtcatgcaggaagttgctgggacagaacgctgaggagttttgtatcactttgtcttccctgttgagtaccatctgagctgtcaaactttgctgccaagggggctgaatcaacctgcagcacgaagtgagtggggaggtaggaagcttctgtgacacagatttgcagcctgtgttcccaaggtttccaggattgaggaaactccataattggttgagagcacacagactttttggccaatcagactcagagctgaggtgggagatctgctcttccagcccgcctctcctcctccagctccccagctccactcaaattcagctcccctcccccctgcccacccccgccactcggtgactaagaactgctgcaagcaggcaaacctccgagcagtttttaagaggctggaaggagacataagagacttcagctgctgcattccaagccctgggtctaccttggagacaggacagcacagacttactctccacaaagggacttctgggtcatggggcccaagacactcccacagctcgctgggaaatggcaagtgctgtgcatgttgtccttgtgctgctggggctgggtgtctgggcagcttcgttactcagtggtggaggagtctgagccggggacgctggtggggaatgttgctcaggatctgggcttaaagatgacagatctgttgagccggcggctgcaattgggctctgaggagaatgggcgctatttttccctgagcttgatgagtggtgccctggcagtgaatcaaaagattgaccgagaaagcctatgtggagccagcaccagctgcctgctgccagtgcaggtggtgactgaacaccccctggagctaatccgtgtagaggtagagatcctggatctcaatgacaactctcctagctttgccacccctgagcgagagatgcgcatctcagaatcagcagcatctggggcacgattcccactggacagtgcccaggatccggatgtgggcaccaatactgtgagcttttacactctaagccccaacagccacttctctctgaatgtgaagaccctaaaagatgggaagccattcccagagctggtgctagagcagcagctggatcgtgaagcccaggcaagacatcagctggtgcttactgctgtggatggggggaccccagcccgctcagggaccacccttatctctgtcatcgtgctggacatcaatgataatgctccaaccttccaatcctcagttctacgtgtgggaatcccagagaatgcacccattggtactctgctgctccgcctcaatgccactgatccagacgagggcaccaacggccaactagactattcttttggagaccacacatctgaggcagtgcggaacctctttggcctagaccctagcagtggggcaatccatgtgttgggtcccatagactttgaggagtcacgtttctatgaaattcatgcaagagcccgtgaccagggacagcctgccatggagggccactgtgtgattcaagtggatgtgggggatgtcaatgacaatgccccagaggtgctattggcctctttggccaaccctgtcctagagagcacaccagtgggcacagtagtggggttgtttaatgtgcgagaccgggactcaggtagaaatggtgaagtgagccttgatatctctccggacctgccatttcagattaagccttctgagaaccactactcgctgctaaccagccagcctttggaccgggaggccacatcccactatatcatcgagctgctggccagcgatgctggttcaccttccctacacaaacatctcaccatcaggctcaacatttcagatgtcaatgacaatgcaccccgcttcaaccagcagctttacactgcttacatcctagaaaaccggcctccgggctcccttctttgcactgtggctgcctcagatccagacactggggataatgcccgcctcacctactccattgtaggaaatcaggttcagggagccccagcctcctcctttgtgtatgtcaacccagaggatggacggatctttgcccagcgtacctttgactatgaattgctgcagatgctgcagattgtggtgggggttcgagactccggctctcccccattgcatgccaacacatctctgcatgtgtttgtcctagacgagaatgataatgccccagctgtgctgcacccacggccagactgggaacactcagccccccagcgtctccctcgctctgctcctcctggctccttggtcaccaaggtgacagccgtggatgctgatgcaggccacaatgcgtggctctcctactcactgttgccacagtccacagccccaggactgttcctcgtgtctacacacactggtgaggtgcgcacagcccgggccttactggaggatgactctgacacccagcaggtggtggtcctggtgagggacaatggtgacccttcactctcctccacagccacagtgctgctggttctggaggatgaggaccctgaggaaatgcccaaatccagtgacttcctcatacaccctcctgagcgttcagaccttaccctttacctcattgtggctctagcgaccgtcagtctcttatccctagtcaccttcacctttctgtcagctaagtgccttcagggaaacgcagacggggacgggggtggagggcagtgctgcaggcgccaggactcaccctccccggacttctataagcagtccagccccaacctgcaggtgagctcggacggcacgctcaagtacatggaggtgacgctgcggcccacagactcgcagagccactgctacaggacgtgcttttcaccggcctcggacggcagtgacttcacttttctaagacccctcagcgttcagcagcccacagctctggcgctggagcctgacgccatccggtcccgctctaatacgctgcgggagcggagccaggtgaggggctcggcgccgccccgggcgacccctgggggcggcactggagaagccgcccgtcctcataagggattgaacttgcatccactcctctccggccggcttggtcgctggctgcgctccacccgattctcgggatcattggaccgtttgcgcgaaaccagagtggccgattaagggatggggctccgagcaccgggggtggtggcgactgtgggcgaggggaggtgggaccgacccccacccctacactcaaaaaaggccggggcctccttcgagcttccggtgaatttcgggcgatttccgcgggtgtcgggggtcccgggaggaggcagtcacagatccacccctgcagccagcctcctaggcgccggctccggcacgcttcgccggtctgtagatttcctcttcgatttctccccagctcccagcatctgtgacttcactgttaccctccctatccccgcatcacccaaccgcacctgtctgcgggacttaggtgtgcgcgcggggctcatgcgtgtcctccctgctggccacccccacggcccacacaagttgcacgggctcgccacgccccgccaacacgtgcgcggacgcacgcacgcactcctcgcacgtgggcttacgcgaataccagctttcactgccactcgctcgcggccagattcacaggcctgttccggtccactcgcagctcccctctgccgctccctccgccgggctcaggagtactcgtagctgattgtgcgcgcctgagggtcccagatcgcggccgcccaggaccaggcgaggactccggagcctcctctcacctctcccacctgcgccccgggctgggccgggtcgcctggggggcggcctgagcgaggcgcggggccaggagcgctggagcgactgccgctctaagtgccgggcgggcaggactctacgatccttgggccagaggtccggatggtcccgggactccgtctcaagggtcggcgacccctcaacccagaagcctcgagcaggcggacaggcagagctgcccagtggccgaggcgcggcagggctccgcgttgggcgagtgagtgagcctctataggacagcaggactgggactccagtggcaccagcggccccttcctcccgcaggaagtgaaagcctcgagcgccctggctctcaacccccagagatacaggcttttggcgccgtcgtgatcacaatgtgcccagcgatctagggtcagagatttggaggtgaccaaactatctgacactctaacaagtcctgtctcctctggcagatggaaagctataggctctgccagatgccagggtgcccttatgtgtgaggaaactacaatagtaaaaaacacaagtttctccaactccaggagcttttattcaaaatatatcaatgcctaactctgctcctaggactgtattttgaaacacccccaggtgattttgatagctgattgagagaaacttactatataactcctttgagaacctcatctcatttgctcttcccaccattgctgttggctaggtactaacatgcctctcttataacagcttcacagaggtcaagtgacttgctcaagttcacagagcaagtaagagagattctaacccctgtctaactccagaatgtgtgcttttaatttcttggcacttggaactttaaaagcttgaggacaggagaggggagttgcctctgctgggattttgcttctgctgggatggggcaagggtggggttccttcccttttaggaccttacatgtggggaaagtcttctgtggctcctcatttctgagcagtccccgcagcgcaaacttggccagttatccttttggagattgagttcccccagctccgtttcctcctatcacaatcactgcatttccatgtagattctgctgtgtctaagaatacagtggctgagggctggccatccctgtgcccttctccatggcagccccagaatggtgctggtgactcccgatacacctggaatgctaggtttctgggttctgctcatatcactgccacctgtgagccttgagtgagccactggcagttccggagcttccttctccctggagtaatctgagatactcacactctctgcttctgggagcaagtatgagtattaattaccagcccaccccagaaccagtgaggaggtggctctaggagtgctccatgagagtgtgtgatgggataacacaccccctggaaagaccagaagggactcaggaatgaagtggctggccagagccccacaccttcagctaggtgggagatggctacacatcagccccttgggagccctggagacttagttggccctgcttggaggctgtgggagctggatccctccccgctgcatcccttccatttttctccgtctcagacagagcagccttgttctcttctccttagtcacagaccattgtctggcacggagttctaggggtgagaagtgtcccgggacttggatgccccgcaaaggcccaatctggcatgactcctaaattaataatgtatttagctgtgggaagagattcttgcaagccaagggcccagagaagatgtccctgtgaatgtgtcactgcacaacctggcaccaaaagggttaccaagaacagcagccatcttgctgcagaggatgctttgttcccagctgaggagttgaataaattcattctagggctggtagaattctcattgaaaagcctcctttgccactttagggggctttgtctgcacctcttcccccagttccacagaagatgccttcagtccttgaattttggctcaggagttctgactctgggggcagggaggaaggggccatttctttaggaaaggagtctcagcttgctcactgtggtcagatgaaatgtgatttatctcttggtttctggtacctcagacctctgagacctgaggtgtattttgtctttggagatgagtccacccctgccccctcttagtccgttttcttctctgtgcccactcccctccttctctcccggcccatccctaggggctcgggtgacattctaacttctcacgggtactcagcccctttccctctgttttctccacagcaagccccgcccaacacggactggcgtttctctcaggcccagagacccggcaccagcgggtaggtgactgattctccagcccaccctcttctctgcggcattttctcagggatgacgtgggaggagatgggggagggcccagcatttgctacagatggcttctccctcagtttgagatcccagggaggtcttggtgtgcggggggctggcacacagaccccggaaggaagaggcgactgccctgactgttcaggaagctcaattcacatgcttgccccttccctcctcgccacgaccggcaccttttcctatcccctgagggcactgtggaaccaaaggatggtcttaagctggtctctgggtgaaagcgaggctttctatgcccatgtactgcctaaccccctcccctgagttgagctgggctccattatgacctggggctcaggcagaaaagcatttgaccggaggaggcggtccgcactcagcgcctcctccagagcctccagagccgaggctgactgcagcctggggagagtggaggcagcacagctggaggtggaactgaggaaggactgggcggggcatggagcaggcccccttctccggcccctcctcccactgtcctctgcccctacttgtcctgctctctgtctgtggggtctccgtgtctctgcccctttttcttgagtttccgtctttgccactttctcttacctctcagtccttccctcagtctctatctcgctttgcaatctctgcctctccctctcttctccatctctgtcttagcttccgtcttgattgctgcacctcagcctcagtccctttcatttgtctacttgcattgatctgtgccgcccactgtgcctgccatggcataagtgctcaataaatgtggagtgagtaactacacgggacccttagtctctttctccttctctatctctgcctccctgtccttgtcctggacctcttttctgtttctcctttcaccgtttcctagcgccttgtgttcttctatccccagcctctatgtttctctgtctctcactatttctgctttcctctctgttctttgtctctctttgtctctgtctctgtatatctttctttgtctctgtctctggtctctgtgcctgttgtctttttctgcctctttctctgttactctttctttatctctctttttcttttatcttgtcttttttctctgagcctctgtctctgtctctcatttttttgtgcttgtgggcaagccagcacacacaaccccccacccaccacccaccaacaccccgctctcttccttccctgcccctcacacactgagcctttgatcgcagctctccaccagacaccctcccatccaagcagccccagctgctcatttcaatctggtatgaattcctgctgagacaggaaccccctgcgggctgaaggggagggaaacttcagcagaaagaccttcagttggtctgagcagagtgggataggctctgcgccaggcctcccagttagaagtcaggagcctggaggagtctcagagcccagggagagaagcaggagcttgggccaccttaccctacctcctcaatggttgagtacttgctgtccacatttgccaagttgctacagatgctgagcttccaagagttatctttcccccatcctgcaaccaaccaaacccttgttgccacaaggacccaggagcccttggtgtatggcagagattccagcttctgggcatgcacagtcctgtcacccattttaggaacgcaaagcgcttcttagaaggcccctaaaaagcagcagatcaaaaggcttgggctgcccttgcccttcctttgaccccagctgttgtccttctccctgctggccttgccaaccttctcataagttatccattaagtcattaatgtattcattcgttcatttattcaacaaatatttatcgagcatctactatgagcagggccctgtgctaaacattgggctataggagtgaacaagtagatgtgatcccagaactcataggcttccagaccagcagaggagactgaaaatttgcaacaagtaacacttaaaaaaaaaaaaaaaggctgggcactgtggttcacgcctgtaatcccagcactttgggaggccaaggtgggtagatcacttgaggtcaggggtttgagaccagcctggcagccaacatggtgaaaccccatctcgattaaaaatacaaaaattagccaggcgtggtggcaggcacctgtaatcccagcgacttaggaggctgaggcagaactgcttgaacccggaaggcagaggttgcagtgagctgagatcacgaaaaaaaaataatctagccacaaatcacagtaagttctgagaggcagagaacaatgtgagtgtaatgggggggggaagatcagagaaggcttctaggaggaggtgacattgagaagttctaggccatttatgttccctctacctaccaccaccccaggccatacactggctttgaagcagaattcaccattgaacctggaagccccaccaactgcctctcatgtgtcctctggggtgagcaccttacccctgcctcaactcccattccatcaaatgagaggcttagtggcctggaatacatgtgggagctcttggagatatggaggagaaggtgcggaacctctctctctctcctctctctgcttccttagttaacttgtggaggatgcaacaaaccttttttttttttttttttagacagagtcttgctctgttgcccaagctggagtgcagtggtgcgatcttggctcactgcaacctctgcctgccaggttcaagcgattctcctgcctcagcctcccgagtagctgggacagcaggtgtgcaccaccacacccagctcatttttgtatttttagtagagatgggtttcgccacgttggccaggctggtttcaaactccccgacctcaactgatccacctgcttcagcttcccaaagtgctagaattacaggtgtgatcgcccccggccacaacaaacatttttgattcagcggctccaaagtgaaataagcgttaggatctagtccagtaacttcaacttctctccttcattcattcaacaaatggtcagtgagcactttctgttggccaggcagtgttctcgatgtgggaggcccctgccctcaaggagtttacagtgcactgaaggagacaaatattgaccaaataattacaaaaataaatgtgagactgaaactgtcataagtgctaggtagaattgtatctggtggtgtgggcgtataatagggatttgatttagggagcaggaggacatcctggaaatgaagttgtgctgagatctgaaagacaaatacaaattaaccagctaaagaaaagaaggaagagcattccagatggtcaggcataccagcttcaaagcagggctggtgttgagttcttcagtaaacttggttcaagatcaagccagctctgggtcacactgcctacacagaaggaagagcattccaaatgggaaaagcctatgcaaaagccttgtggtgaggcctcctgggatcaagggaatggcagggagttttctctttgctggcactggagtgaggggatgaagaggagaggttccttttatccagtctaaccctggttccagccttctgttgatgccctgcctcactccctccccaccatcttgcccactgccctccagcctggtctggtcagacacaccagcttcaaagcagggctagtattgagttcttcagtaaacttggttcaagttcaagtcagcactgggtcacactgcctagacagaaggaagaagacctggccaggtgtggtggctcacgcctgtaatcccagcactttgggaggctgaggtgggtggatcacctgaggtcaggagtttgagaccagcctggccaacatgatgaaaccccatctctagtaaaaatacaaaatattagccaggtgtggtggtgcacacctgtagtcccagctactcaggaggctgaggcaggggaatcgcttgaacccaggaggcggaggttgcagtgagctgagatcacaccactgcactccagtctgggtgacagagcgagactccatcaggaaagaaagaaagaaaaagagagagagggagggagggagggaaggaaggaaggaaggaaggaaggaaggaaggaaggaaggaaggaaggaagaaaagaaagaaaaagggagaaaaaatgaagaagacttacattctgaagttcctgcttggcacatgcttctcctccccaccactatcccttctcaggtcatcctttgggtgtctgatcccaatagctgttgtctcaagctctgagcccagcaaaccatttcccccttcttaggctgtaacccaggccctgccctgcagctgtccccagcctctgcacaaagagtctccatttggtccctagactgttctctgatggctccacactaccatccctcctctgagagacagtatccctgctctctctcagtttgggcagtcattcaacaaacaaatagcaacttaatttttttccacttataaaatagtacatgctcattatagaaacatgaaaaatagaaaaaaaattaaaaggaaaaccacccatcattttacaatctagggagaaccaccaccaactacagtttaatatgaaacatttcaaatatgtacaaaagtagagagaatggtgtcatgaacctgtatgataccactatccagcttcaactaatgccttatcttgtttcacctatatccctacccttatcctgtccttggattcttttgaagcaaatctcagacatcatataatttcatcttggtctccaccatctttaacagatgacttttttttttttttttttttttggagacagagtctcactctcttgcccaggctgtggcacaatctcagctcactgcagccttcgcctcccgggttcaagcaattctcatgcttcagcctcctaagtagctaggattacaggtgtgcaccaccacacacagctaatattttgtattttcagtacaaacagggtttcgccatgttggccaggctggtcttgaactcctggcctcaagtgatccaccctcctcggcctcccaaaatgttgggattacaggtgtgagccaccttgcccggccagatgattctttcataaggtccacattttatatttgagtgagtgtctcttaagtatcttaatgctcttttaatgtaaaagacttcccctccatcttccatttttgcaatttatttgttgaatccctgccttttcatatatatctttctaaacttttctttgtgtaatcaaagaacatgcatgagcttcatttttatttttatttatttatttatttatttatttatttatttatttattgatacgtagccttgctctgtcacccaggctggactgcagtggcgcaatctcggctcactgcaagctccgcctcccaggttcacgccatgctcctgcctcagcctccagaatagctgggactacaggcgcccactaccacgcccggctaattattttgtatttttagtagagacggggtttcaccgtgttagccaggatggtctcgatctcctgacctcgtgatccgcccgcctcggcctcccaaagtgctgggattacaggcgtgagccaccgcgcctggccgagcttcattttaaaaaaatctcattcacctaaataagttgttcacaaacttgtcacactttcatgtgacactttattcacatattaagaactgttattcccagtcatacggtacatttcctactagttttttaaaaatagcaactgaggccatactgtccaacagaattatagcttttttcttctttgcagtgtatcatgagaatttccccatgtctttcaaaattcttcccaagtcatttgcagagtaactcctcttatgaatatacatattattttacagaataagtcctcatatgaatatacatattatttttctaatgctaatgggcttttgctacattagaaaacatacacattcatttacaattttttttttttgagacagtctcgctctgtctccaggctggggtgcagtggcgccatctcggctcactgcaagctccacctcctgggttcaagcaattctcctgcctcagcctcctgagtagctgggactacaggcacgcgccaccacgcccagctaatttttgtatttttagtagagacggggtttcaccatgttgaccaggatggtctcaatctcttgacctcgtgatccgcctgcctcagcctccctaagtgctgggattacaggtgggagccaccatccccagcctcatttacattttaacacaattaaattcagggtgttgtcagggtgacttcctagatttctcagttttttgagcatgatgtagggagtattttattatagtccagtctatgggatattcccttatacacacacacacacacacacacacacacacacacacacacaccccaaactcaatagggcaagaaccatattcatcatctcttaaatcctaggtcctgtcacaggccactgcttggaaaatagttgactaaatgtagtccatttcttccatttttacttttcactattccccaaatcctggaagagtccctcatatctgctgctggggctccaaggcctccaagctgaagcccagtacgttgttgtgcataagatcataggccctggaatcatattaggctggctttcaggttgcaactctaccagttccagctgtgtgactctggtatagtctctcaacctctctgagccctgttttcatctgttggaaaatatagataatcacaacacttatctgcagggtgattccgaggataaaaaagacaaatatattacccagtcagcttagaataggaagctctcagtaaatggttaaaaaagaggtctctctccctctgctcatctcttacccagcttcacataattggcagcccacccacctgtttggccctcaaccttcaaccatttcccaggacgcctccttacactcctgatcatcatggttccaaccccactgttccactcagctttgttccctcaacaccactgctccctgtgacaggtcatcctcctaacctctggcatctggtcccgttgtctccctgacaacccgcatgctctcctccctgcaacccccgccgcttgcctgctctccctactttattcccattagcccccttcacctggggctgagaacacctggccttgaccctgcaccctcagccaggcccacagagctcagtcgggccggaagtaaggaccccagatattcagttgaggaatttaacattaatacaataatatagaatccaccagcagattttcataaatgttctgtgtgttcttttatccttttttttaatccaggattttatcaaggagcatagattgcatttggttgtcacgtctttcctctcctttaatctggagccagctcccagtctttttatttttttaatgacatggatatttttaaagagtccaggccagttgtactttaaaatgtccccgaacctggatttgctggctattctctgatggttagattcagattacacaccttggtaggaatacttcccgcagcatcacactgggactcatctaacgtcggcctgtcccactatcagtgatgccgagtttgttcgtgtggtaaaaacagtgtcccagatctctccattataaaaatatatttttataaagatattttaaaatatttgtgaaaatataagtaatctgtggatgatactttgagataggcagcaacccttcatgcaattttagtattccctgatgatccttgcctgtatctgtttttacatcagtgattacaaagcggtgatgttctgtcattccttctacatgtatttgctggtattcttctgaaaattacctggatgatttcttcagatttaaattcactgtcttttccttggggaagcctggactggctgagctgcctaaccctgactctctgtcttttttttttttttgacagggagtctagctctgttgccaggctggagtgcagtggcaaccttcacctcctgggttcaagcgattctcctgcctcagcctcccaagtagctgggattacaggcgtgtgccaccatgcccggttaattttttttttttaatatctattttagttgagacagggtttcaccatgttggtcagaatggtctcgatctcctgacctcgtggtctgcccgcccctgcctctcttcataccctctggtagcccctgacacagcccatggcaagtatcacaattgcaattactctattgtgtaattatttaaaatcagcctctcagtgcccaccatgagcaccgtaaagatggacagtttctatcatactcacagccacaaccccagcacctggctctgtgtctggtacatagaaattgctcaagaaagaattgttggaggggcgcggtggctcacgcctgtaattccagcactttgggaagcggaggcaggtggatcatgaggtcaggagttcgaaaccaacctggccaatatggtgaaaccccatctctactaaaaatacaaaaattcgctgggcatggtggcatgtgtgcacttgtcgtcccagctgctcaagaggctgaggcaggagaatcacttgaacctgggaggcagaggttgcagtgagccgagatcgcgccactgtactccagcctgggtgacagagcgagactccagctcaaaaaaaaaaaaaaaagaaaaaagaaaagaaataattattgaatcaatggaaacagaattacaactcttcccacttttgggaaggagaattgagattcctgctttccccttcaaccctagctttatgtttgttgtgatggtatagaggtcacacatggcagccttgtgtctgttcttaggctgagttcatctacttagggacggggaatcccagattgggcaaaaccaaaagcagggacagaccttggaaaaattgtaaagcagttcttggttgtgctcacccaccatgacaaaatatgcacacacacaacgcaacacacacacagacattttcatgccttcaaggcctaccctacagcctttcccatggtgccaaacccttcttcttaccttacagtcacttaactgtctctgctggtctcttcccactcatttaggcaacaaatatttattgaaaaacttctctgagccagatggtgccaaacagttacctaaagggcagactgtgtgtgtgccagggctgtttcccgccaacactcccctgcaaattgaaataatttcatccttggaaattcaaaaaaatcatgaaaattgtcactgtgggaaaattccaagtagagctgaaccttctaagaagcagagagttcttcttatggtttagtatttttttaaattatgaatcatttcatgttttttcaacactcggagtttctaaaagtctcacttaggtccaagtgctaggctttgtgctaggtgcttcagtaggaagcaggtggagtcgctgcctcacagaagccagtgtggtggaggaacagacaggcactacaacagctgcagtgtgactagtgccatgtggggcagccgctgggatgggagtacagtggaggcacctgcccagtctgagtggatctcctctgatatattttattcgtgtcatcatggcaaatgttgggggactggcattctagggaacaccatctgcccaggattcacagcaagagggaacttgagggataggaaagtgcaccttggaaaaggtttgatgatagagtgtttgagggcggggggtgggggttcttgtaaaataggaggggcaggttcttctatggccgtggattttactctgagggcttaggaagccattgaattttagaaatttcttctccctgctccagggtctcttggggcctcctacatctccccctaggtacctcctaggtccccactttttctctagctctggaacattctcttccatttcccaccttcacagtcctctggagaaggtctgatctccctcactatgacaggaagccaggctctctcatggtgggtgggggaatgcactatgttcaatgcattggaccagcctggccaacatggtgaaaccccgtctgtactaaaaatacaaaaattagcctggcacagtggcaggtgcctgtcatcccagctacttgggagactgaggcaggagaatcgcttgaacccaggaggtggatgttgcaatgagccaagatcgcgccactgcactccagcctggatgacagagtaagaccctgtctaaaacaaaaagaaaaaagcatcggaggcagcaaagagctggtttgagggactgacttgtgggattctggcttctgaaggattgtagaagtgcctcctaccttgctgagagaaacaggtcttgggcatggggtagggttagggtactaggtttgggagccctgggagaggacaggaggggcatgagctgtgccggcctgggagtctgtgctcaccatcctactctctccccagctcccaaaatggcgatgacaccggcacctggcccaacaaccagtttgacacagagatgctgcaagccatgatcttggcgtccgccagtggtaagtggtgtcagtgtgtgtatggaagagtgggagacctggggttctggggtgcatctcacagccaccatgcccacggactggatgtcaaacctgtgtagtttctccagatctttcggcaggtctgaaaggacccacaattccaaacataaagcctggaattgtggctaaggaacagcagaggggttgggggtcctgggatgcctggaggagagcgaacaaggaaaagactcatggagggaatagtggttacaagtctagctctggaatgggacagtgtagctcaggtcctagctctgctactatccttgggacttggatcgacttgctcaatctctctaaacctcagtttcctcagcctagaaagtggggacagggaccccaaagggttgttgtagagattaaatgagatgataccacaaagcatagagttctgggcctggcgcttggaagccctcaagcaatgaaagtgggtgtagaaatccccagccgagagaacacctcctctttatgcgaggctcctcttttgctgcccctaactccagagtaggattctggttttcccataaggttgactaagggcttcctttgtaatagagattcggctagtggtggttgtccctgaagagtcactagggcccagagcaggagaagaagaatatcatttgtccttaagagcacagcctaagctgggcgtggtggctcacgcctgtaatcccagcactttgggaagctgaggcaggaggatcatgaggtcaggagttcgaaaccggcctggccaacatagtgaaaccctgtctctactaaaaatacaaaaattagctgggcatggtggtgcgtgcctgtagtcccagctacttgggaggctgaggcaggagaatcgcttgaacctgggaggtggctgtggtgagcagaaaatcgcaccactgcactccagcctgggcaacagtctcgctctgtctcaaaaaaaaaaaaaaaaaaaaagagcacaggctttagaggcaggccaatctggattcaaatcctggcacctggcaccaccacttagcaatgagtccttaggtaagttattaaaccccctcggtttcacttactattaatgggcacagtattaacggatctcattgtggtgttaccagggccaaatgcaagtccctcagcacaggattggcagagagtaagggcacaatatattattatctttgctgacccaaacccgttttttactgggtagaaagcagaattagaataatgcctattaataaagactagcttctggagcagcaaatcctgggcttataaggaggctggcagaggatcaaggcattgccctatatcatgaactgatagccctgccctccagcatgtctggaggactggtgggtagagaaccaggtgaaatcacaagaagcactgtcatcacacctgggcacatactaaacaaactttaggggcctcctgtcaatgaatcctctcaatagctctgcaaggcaggtctgatttctcacactcgacagatgagagaaccgagaaggcacttgccccagggtcctcagttttgagctgccaagctgaggttctaacctggctcaactcctaagtttatgctctttctactatagggaccatggctgcctttggatccagcctcggcttctctattacctgagcaggatgagaggctgtcctcttcctcgagctctgctttattcttccagatcagggttgccagataaaatacaggatgcccagttacagttgaatgtcagataaacagcaagtactatttcagcataagtcagtctcaaatgttgcatgagacataatgtactaaaaaaaaaaatgctcattgtttacctgaaattcaaatttaactgggagccctgtacttttatttactaaatctggcaactctaccccagatgtctgtgaggttaagtggggccaggcctacagctgacggaaggacagagagagaggtggcagggactgctggcctcctgaggcagagctgtcccaggtctggtggggctatgattccagagaggccagagactgagtatgaaagtggcaggcggctgggtctgaggagatgccaagttggcctcttgagggaaataaacaggtatatttagctgttgtggccttgcgccctgaggccaggaagcagctttttagcctaaatccagatgttaaaaacagaaatgaaatcagtatttatggccccaaaccctccaagcaagtcatgcagctcgttcccctgtcaaggcctcccacctttggcccacacagggcctgaccctcgtctaagcctgcgccctggggaacggaccctgggggtggaggtggtgggtcaggccctgctctcactttcacacccgcttcctagccctgaaaccagagaggttcctgaagtccagcccagccaggcctgtggggctgctgagaggggttaagtaagagggagagtaaaaaccgacacttgggaggaggcttttaaaataaacatctgcggggagggatgctctcaaggaggctgcggtttgcagctcagccagctgtgttccagctaatcagcctccttgggctactctggagttgctgccttggccctgggatggggtaggttaagaggacagagggaggtcagggagctgggggctgagtttccctgagtagaggctggcacaggagagaaggcatcacccccacctcgtccaggccagaagatgtccagcttcttgaggctctcctaagtctgcctctcctgggaccaagagaaaatcccggtccttgaccaaggtgggccttggggggagtggggtgtagagggaggggcactggagaactgactctacagaaagtcaaagctggcaatccaacttcttcccctcagatttatagatgggaaaacaggcttgagccacgcagagacttgaccaagctcacacagttccttagtggcagagcagagcaaatattctctttcttttacattctggatttccatatcttctctccctcctggtccagcccaacctcagggcaccccccacgaggtgggcgggggatggctttgtcacttgcacccactcggggtgctactcagagatcttgggtgcacataggacgtgggtgggccgagcttctagctactccgtcaggcccttcctgtcattctgtctctgcctcccttctccctgcttctccgtgttcctcctcattcttttctgtgtgcagggagactacaccccccaccccgctctttctctggcgcctctgaggtcccccctctagcccctaaatcactctggaatcctggctctttgaagccagatctgggcccccctcccctaccccttccattcccaggctgggaaaggctgaagaggctgacggctggaggggagggggcggggcggtggcggatctggcttccttttggagttaattagggaaaacagagaaatgtcagcggaatgaaagggctgggggtgggggccagctggggtaggagaggaggaagtgggcagctgctccctcccactcaacccctctcccccgcccccagaaagctctcagctccggggatttgcgacatgaaatgggggctgtagaaacctgagcgctggtgcgtgaagagaaaaaccgaggcgcatcccggctctcccctcccgtgtgccctcctcctcttatgccggcttgaaaatatttcctgtctctctatttctcaatccctggttgatgtcccaggattactcagcctctccggctttagtcactctcgctacccgctcccagggtccagggtggaggcagagggaggctgggagagaagctctactgccagctgggcctgggctggcctgggcatccctgaggttttaactgtctcctaaccacagaggatctcagggcctccagcagcgagccccaatgagtcaaactcttgtttcctcctctcccacccccgacccagtcagggcaggtgaggggtagaggtgatggcatgctggatgtgacggtgttgatgatgtattgcacaggatgaagcaccatctcatttagtcctcacagcagccttcacagtgcgtacaaatcagctggcaattccgagaggctgcattctaaacaagttcctgggtgatgctgagccagggccagagtgtggacttctctgggccccagtttcttcttctgtacagtgggacgttggactggaggtgctgtctgatgtcacctagctgtggcactctgagcctgtgcctaaagtgtccctgagatgtctagtccccgagatcatcatctcctcagcttcatagagccgagctcttctccatcttctctctacctcccattcactcagaacagggataaggtccaagctgctggtggtgatggtgactgactgtcccttccagcatgcgcttaggtacacttgggcctgaatgcccctctaacaaatgctaccgggtatggccttggtccttctaacacttggttccctcatctgtaaaatgagggtcataccacatagctggctgggctgttatgtagaggttaaaagtgattgtgcatgtgaagcatccagcagagtgcctggcacacagtaggtgctcaaatgctgttttgaaatacaaaaattagctgggctagtggtgtgcacctgtaatctcagctactcaggaggttgaggcaggagaatcacttgagcccaggaggcagaggttgcagtgagccgggatcgcgccactgcactccaggctgggcgacagagcaggactccatcttaaaaaaaaaaaaaaaaaaatgctgttttgaaatggaggcttggaagagcactcttcacccccaccccacacacttactaacggaactaccgaatctctactcgtgccaggccttgcttggcaaaggctaggggcatgtaaagccatggtttcatggctgctgccctccaggagcccatggtctagtgtgggagtcagaggctcccttgagaaagccagggcaaggaactgagagcccgtgtcacagccctgagagaaataccagcgaatgtgttttgagcacttacatctaccaggcactattttacgtacctgacatacattttcttatttagcattcactaaaaccagaagaggtggttaccattatcatccccattttgcagatgagaaaactgaagtggcataaggaggttaggtagacttgcccaggatcacagtgagtaaggaaaggagctaggaatcaaacctagactttctcactccagagcctcttaacctctaccctcaactcttgtgaagagagactaccttggtgacccctatattcccagtgctcagcgtggtcaaggcccagggtgctgtataggcattcattaactgctggggatataagacagtgactgttgaggaccctaagtttagctcccacctgatcttcctctgtctctgcagaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctgaacgtttctgtataagcgatggaagctcctggcatgtgtgcatgaagtgatgagctgaggtgggtgctggaagaagggcggaatcgggaggccactctgtgtcattgcgcgtctagatgtttccgaattgcgtgtgtgtgtgtgactgtgcaatatggttgtgtatgcttgcaatgccgttgtgcctatgagac

SEQ ID NO: 14861 - DNA, 171130 bp, Human
atatgcttcttgaagaagtgactgacttatcatctgctctataataaagctgtagagtggtaataaacaggtttctccttttttttatctttctcatacgtgggaaccatactgtattttaatctttaaaataatatatatcctcaatatagttttgcttaaagaaaagatacaaaagattcatatcatacaattgcccagaaccaacttctttatacatctctcttctcaaggtttctactcacaatagctgctagaaatgttcccaatccctcacccaatcccagtgcccctctgatcaattttcttttcccattcctcttcctatattggcttttagtatgttggttatgtatttaataacagagaataataagcacactaatgttctatgtaactggcatcattttttatttttatttgaaaattatcatgtaccaattgagccttttattgaatgataccatatttctcaaagtgctgtgattctttccgttgcatttgatcaagaaaaaattttctgagacaaggtgttgttttggttactattacataattgtctatgagtaaaattggaactcactgtggaataatatgtcataatagctttacttgtaagtgaataataaagtataaacaggaaaattaaagcaaagttatttttagtgtgtgtagtaactccacaagaataaatgtcttatgcatagatatgtaatgcatcatgattgaaacgacaaatatattgtatttatatttctgtgcttggaaacttatggggaaagagattctggaacataaaagcttatttctactagtttcagttggttttgaaaaaacatccttacagtctagatttaaacaaaggaaacttctttcagtaccctgaaggtctgtgatttctctctcacacctaggcattgtcatgctgttctctcccacatccaggccttttcactgatccactcctctcatgtttcctgggaaagcgtttgctaacattaaaggcccaattgaaggcccccctaacccccttggcttctcccattatggtaattatctcagtacactgcaattccctgtttgcttttatatccttataatctctgtgaaggaagctactgtgtctatattgttcaccttaaatccccaaacatattgtctgatgcctaattatgtgtttgtttaatgaatattaaataacaacaaatatcgaaactaagttatcaggtcaccaagaacaaacttaaagaaatataatgtataaatatggctgatttctgtgtgtttcttttctttttttccttgtctcagctcttagagagttaagagtatagagagggaaaggtcaaagaggaggtggatatcttatcaaataaccctgataaatgtagtaagtataagaataaacacattatcaaggttcagtggtggaagaacaagtggtggtcatgtcttttaatagttgtgttggtccttacggccagttctttgttactgtgtgtttcttaaactgaacaattcaaaaaagttaactccactatgtttgaagcaatattggtggcattaaggttagtgcatggattcccaagaaagataacttgaggtgacactgtttaacatatatcgattcaattatgttcaatcaacactagtcctcttatctctgacaagaaggatttcagatcttggataattcaaaaataataatgtgtctgagaggatgcagtaaacggttaggcctcttagtgtcgctgttgaccactcaagaaggagaacgcagctggagaactagtccaccatttccttgctcctaaaatgcaaagaaccagcaaatcagactcagaagatccggggcggctgccaacctcacctcttagtcaaccagctgtttgacctgtgaattaggcccgtaaaagacttcgtttcttgagaaaataagattggagtccgtcgtaggaaactggaaccgaattcagagaaagcgattcaccgaaaaggaaatgaccaattgcctgagtttccgaaatggcagaggactggccctgctgtgcgcgctcctggggacgctgtgcgaaacaggatccggtcagatccgctactcggtgtctgaggagctagataaaggttccttcgtgggcaacatcgctaacgacctggggctagagccccgggagctggcggagcgcggagtccgcatcgtctccagaggtaggacgcagcttttctctctgaatccgcaaagcggcagcttggtcaccgcggagaggatagaccgggaggagctctgcgctcagatcccgctgtgtctggtaaaaattaacattctggttgaggataaattgaaaatttttgaagtagaaatagaaattaaagatattaatgataatgctcctaatttcccaacagaggaattggaaataaaaattggtgaactaacggttcctggaacccgatttccaattaaaactgcttttgacccagatgtaggcattaactccctgcagaactacaagcttagccccaatgactacttctctctggctgtgaatagcgtctctgagggggccaagtatccagagctggtgctggagcgggccctggaccgtgagaaaaaagaaattcaccagcttgtcctggttgcctctgatggtggcgaccctgtccactctggcaacttgcacatccaagtgatagtcctggatgcaaatgacaacccaccaatgtttactcagcctgagtaccgtgtgagtgtttgggagaacgtgcctgtgggtacccggctgctcacggtgaatgccactgaccctgacgagggattcaatgctcaagtgtcttatattctagataaaatgcctgggaaaatcgctgagattttccatcttaactcagtgagtggagaagtatcaatattaaaaagtctagattatgaggatgccatgttctatgaaattaaaattgaagcacaggatggaccaggtcttctttcaagagccaagattctagtcacggttctggatgtgaatgacaatgctccagaaattacaatcacgtctctcacaagctcagtcccagaagagggcaccgttggaagagaaattgctcttatcgacgtgcatgaccgagattctgggcagaatgggcaggttgaagtttttgtcctgggaaatctgccatttaagttagaaaaatcaatagatcaatattaccgcttagtgacggccacatccctggaccgcgaacaaatatcagaatataacattagtctgagagcctcagatgggggaagcccgccactgtccacagaaactcacatcaccctgcatgtgattgacatcaatgacaacccacccaccttccctcatttatcctactccgcctacattccagaaaacaaccccagaggagcctccatcttctcagtgacagcccaggacccagatagcaacaacaacgcccgcatcacttatgcattgaccgaggacactctccagggggcgcccctgtcctccttcgtctctatcaactccaacactggcgtcctatacgcgctgagatccttcgactacgagcaatttagagacttaaagctactggtgacagccagcgacagcgggaaccctccactcagcagcaacgtgtcgctgaacctgttcgtgctggaccagaacgacaacgcgcccgagatcctgtaccccgccctccccacagacggttccactggcgtggagctggcgcctcgctccgcagagcccggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagacgcgctcaagcagagcctcgtggtggccgtccaggaccacggccagccccctctctccgccactgtcacgctcaccgtggccgtggccgacaggatccccgacatcctggccgacctgggcagcctcgagccctccgccaaacccaacgattcggacctcactctgtacctggtggtggcggtggccgcggtctcctgcgtcttcctggccttcgtcatcgtgctgctggcgctcaggctgcggcgctggcacaagtcacgcctgctgcaggcttcgggaggcggcttggcgagtacgcccggctcgcactttgtgggcgcggacggggttcgggctttcctgcagacctattcccacgaggtctccctcactgcggactcgcggaagagccacctgattttcccccagcccaactatgcggacacgctcatcagccaggagagctgtgagaaaagcgagcctcttctgataactcaggatttacttgaaatgaaaggagattccaacctacttcaggtgagtttatttatttctttgattattaagaacaaatatgagaatgtggttattataaagctttaacacatatgtatttgagaaataaagccatgaggttgtcattagtcctttgactaaatatttgtccccctttctttctgggcctatagtaggactgcactccccggtctggttatggttgagtgggcttagggaaaaaataatacatcgtgagtgaaagtaaagtgtcacttcctagaggaatctgccactgtgagaattttcagatctctaagttactatttgaaattgtgactgctccttctacctgggtccttgagtaactatgatgagagaaacacaacactggtttgtatacctgtgataaataggcctttttcattttaaatccctgtgctttggagtttgtcattccaacctgtatagcttatcctgatacatacaagtaaaaatacatatgaataaaagatattttatgcccatgaaattaaatgatgtttgactccttccaagacaggtgacactctttttttctttctccttccttccttcctctctctttcctccttccttccttcctctctctctttcctccttccttccttccttcctctctctctttcctccttccttccttcctctctctctttcctccttccttccttcctctgtttctctctttctttctttctttctttctttctttctttctttctttcttgacagggtcttactctgtctggagtgcagtggcatgatcacggctcactgcagccttgacctcgcagactcaagtgatcctcccacctcagcctcccgagtagctgggactacaggcacgagccaccctcccagctaatttgtttttgtttttgtagagatggggcaattgctatgtttcccaggctggtctgaaattcctgagctcaagtgatctgcccacgtcagcctcccaaagtactgcgattagaggcatgagccaccatgcctggcctgttattcttttcatctcaataacataaaaattggagaacaaaaatgtagaggctgggtgcagtggctcatgctgtaatcccagcactttgggaggctgaggcaggtggatcacttgaagtcaggagttcaagaacaccctggccaacatggtgaaagcctgtctctactaaaaatacaaaaattagctgggcatggtggtgggcgcctgtaatccaagctacttgggaagctgaggcagaagaattgcttaaacccaggaggcagaagttgcagagagccaaaattgggccactgcactccagctggggcaatagagagagactccatctcaaaaaaaaaaaaaaagtagaggctggtcaaatggttttacctatagtgcctgttacatatgcctaatgtatatgcttatgtgtgtattcattttgatttcaacattttgcctgagggtggaaagctcacctagctaaattattatgagccttggagtggtatttcttgtccttgagaaggacatcaaaaacatgtaaaggaatatgtctcagcctctgcgggagatttccagacaatctcttccaacaatggaatagaagtcccttcttttgtcatgttctacaactttcttgagccagaaattgttggcttattctgcaatttatgaaattattttcactcatgaaatcatatgagagttatccaaaattagaccaaaatatgttttattagaactcaaacaaaagaatagattcctccctcaatatattaggaaaaggcacatttaaatgtatgagacaacagggccagaacacaaaagctgtaagcagagtaaggtgtattctcactgaaacatggaaatacatcacagaatttaaaaggcccatagccaggggaggacttctgagcctaggactttgagacctacttgggcaacatagcatgaccctgtctcaaaagaaaaaggcacgtaacttttaacatatcatttttagaaaaaaaaatgtttatagtattagtatcactttccctgtaaggagaaaaaaaattaattagctgtgtcaggggaaatttggatgctcaaagataatttctaagaattctatatgaaacatagcctacatatgtgtcatgaaaatacactgagagtatggaacccatacaattccacctacttgtacaggtaatggaaggtctcagacatcccattttcactaaaaaggatttatttttatttttttgaagaatgggcaagaatccactacaacagaaagggaggagaagttcatagtaaaaggaatggaaagtataaaggcatgatgcaaggaaacaagtgaaaaggtatcttaagaaaacagataataggctgtttcgaatagagtatgagtatgggtgagcactgcaaaatagtagaataaattgttgagttggatctcatttggtaatgcatttgaaataaagggatttgctttgaaccaagactggttctaagcctggaactacagaataagttccaaaattgggtgtctaagaactctgaatacctctccaatatttaccagtggtcaagtcaaactcgttttgctcattaatggtataagtcggctggagctgagaattggcattatagagaatgtttttgagacagagtcttgctctgtcacccaggatggacttcagtggcatgatctcaactcactgcaacctctgcctcctgagttaagtgattctgctgcctcaacctcccgagtagctggcgttacaggtacccgccaccatgcctggataatttttattttttttagtagagatggcttgcaccatgttggacaggctagtctcaaactcctgacctcatgtgttcttcccaccttggcctcccaaagtgctgggatcacaggtcactgcacccagcctagagtatttaatatacattcatataaaaaagaagcactggtttcataaaacaaatgtacattatatgagattccacttcataaaagcatgtatgtgtaccccaacactaaattggcccttttaacaaaatatcagactttgtcctacttaactggaaagattatctatattttataaagaagagaaataacataatagtaaggctgtgatttcctcttttttgcaaaaactatttttgaaaagtattactgaattgataacatatatatggagagatttaaaatactagataagggagcttattccaatgaatttacagaaaggtaggtattttagtcaactaaaaatataaataaaaattatcaattcacttatttggatacagcagtcatgccagagtttataaatatagtgaaatcactgaagatttttttttacccccaaaactgaaaaaaatggcagtgtaccttgtgaattttttaaatgaaaaaagaatacgaaatgatgaaggcccttatctgatgatgacaaactagaaaactgaaatgtaaaggggaaaatgtgagtatgtgtttccctccagcaaattaaagacagggtacatagattcaagaggttgcgctttgaggataaaaagctgggccctgtgcagttttccaagacaacctctgggcgccgctgtcgaccaaaaggaagtgaaggcttctcaattctgcaggagcgtcaggcagggtgccttcctgctttgtccggtgcactgagcacagacgctgctcctgttcaccctcgagcgcctaactaataagtcctaagctcaaatcacagaagtccagggtgctgccatttctttttgaaaaacatcccagaggaaagaagctccgcggagagttcctgaaatgcagagagccagagaagccgaaatgatgaaaagtcaggtactgtttcccttcctgctgtctttgttctgcggggccatctcccagcagatccgatacacgattccagaggagctagccaacggctcacgggtggggaaacttgccaaggatctggggctcagtgtccgggagttgccaactcgaaaactgcgggttagtgcagaggattatttcaacgttagtttggagagcggggatttgttagtgaacggtaggatagatcgagagaagatttgcggaaggaaacttgagtgtgcactagaattcgaaacggtcgctgaaaacccaatgaatgttttccacgtggttgttgtaatccaagatattaatgacaatgcaccacgtttcgttgcaaaaggcattgacttagaaatttgtgagtcagccttacccggggtaaaattctctctggattctgctcaagatgcagatgtggaaggcaattcactgaagttatacaccatcaaccccaatcaatacttctctctgtcaacgaaggaaagtcctgatggaagtaaatatccggtattactgctggaaaaacctctagacagggaacatcagagctctcatcgcttaatcctgactgccatggatggcggggacccgcctctaagcggcaccacccatatctggatccgagttacggatgccaatgataatgctcccgtgtttagccaggaggtatacagggttagcctccaagaaaacgtaccgtggggaacctccgtgctgcgggtgatggccacagaccaggatgagggcattaatgcagagatcacctatgccttcctcaattccccaataagtaccagcctcttcaatctcaatccaaatactggcgacatcacaaccaatggcacattggattttgaagagacaagtagatatgtgttgagtgtggaagctaaggatggaggagtacacacagctcactgtaatgttcaaatagaaattgttgacgagaatgacaatgccccagaggtgacattcatgtccttctctaaccagattccagaggattcagaccttggaactgtaatagccctcataaaagtgcgagacaaggattctgggcaaaatggcatggtgacatgctatactcaggaagaagttcctttcaaattagaatccacctcgaagaattattacaagctggtgattgctggagccctaaaccgggagcagacagcagactacaacgtcacaatcatagccaccgacaagggcaaaccagccctttcctccaggacaagcatcaccctgcacatctccgacatcaacgacaatgcacctgttttccatcaggcctcctatgtggtccacgtgtctgagaacaacccacctggcgcctccattgcacaagtaagcgcctccgacccggatttgggacccaacggcagagtctcctactctattctggccagtgacctggagccgcgggagctgttgtcctacgtgtccgtgagcccgcagagcggggtggtgttcgcgcagcgcgccttcgaccacgagcagctgcgcgccttcgagctcacactgcaggccagggaccagggctcccccgcgctcagcgccaacgtgagcctgcgcgtgttggtgggcgacctcaatgacaatgcgccacgggtgctgtaccccgcgctggggcctgatggctccgccctcttcgatatggtgccacgcgccgcagagcccggctacctggtgaccaaggtggtggcggtggacgcagactcaggacacaacgcttggctgtcctaccacgtgctgcaggccagcgagcccgggctcttcagcctggggttgcgcacgggtgaggtgcgcacagcgcgtgccttgggcgacagggacgcggcccgccagcgcctgctggtcgctgtgcgtgatggaggacagccgccactctccgccaccgccacgctgcacctaatcttcgcggatagcctgcaagaggtattgccagacctcagcgaccgccctgagccctctgacccccagacggaactgcagttttacctggttgtggccttggccttgatctcagtgctctttctcctcgcggtgattctagcgatcgccctgcgcctgcgacgttcctccagcctcgacactgagggctgctttcaaaccggtctctgctccaagtctgggcccggggttcctcccaaccacagcgaggggactttgccctattcctacaatctatgtattgcctctcattctgcaaagacagagtttaattctctcaacctgacaccggaaatggctccccctcaggatctgctgtgtgatgatccttctatggttgtatgtgccagtaatgaagatcacaaaatcgcttatgacccttctttgtcttcgcacgtgagtttctgcaaatctagttaaattttatatatggcggccgggcgcggtggctcaagcctgtaatcccagcacttaaccaggctgaggcaggtggatcacttgaggtcaggagtttgagaccagcatagccaagatggtaaaacccggtctactaaaattacaaaaattagttgggtgtggtggcacgcgcctgtagtcccagttactcaggaagctgagacaggaggatcgcttgagcccgggaggtggagattgtagtgagccaagagtgtgccactgcactccagcctgggtgatgggagggaaactgtctaaaaaaacaaacaaacaaaaattatatattgcattttcttctcattggtgtataagtaattttgattttctttcattgttctagtgatggtatctactgcgggagggggtactagatagatggagattgctttcttgattgctcagtagtcttggcaatttaattttcaatctttactgttggcatttctgtatggttggcaaatcttgctaaagagacctgtttcctagatgttaacacttagtaatagcagtgccttttcttagttgatatgcaatactatattttcaagtcattttattcttagctctttataaatgtatttagagttcttcccacccaagttaaagttcatcaattacattaattatgtaattgatgtaattatgtattaatgtaattatgtaattaatgtaatcttcatcaattacattctagtttgtctttttgcagcaacatgtatgtttaatacagccttccaattattaagactcttaacactttgtctcatcacaagtagcaaatattgtccaattttatatttgcatcactaactttgagtcaatattattcccactctataatttcagtcaatgatatttcataattttcttaaccattcctaaattatttgtttttatgctctttctattttgtctctattaaaacaaagaatgtaatgaacatttgggtttataaagcgttttccatacttcttgtttctttagtgtagatttctgaggaattagttaaatctataaacatgttgagatttttttaatgcatactgtcaaatttatttccaaacatcttatttcacctctcaatcatccgcagtttgtgcggtctttgaggattgtgaaaaacacgtttaatctactctctcaaagtctgagggtttttaaattctgtatagctaatgcccttttgtatgagtcatttctactgctaattgttaagtgaggaataagcttaagaactgatgtactgctttatctcaaattttcacagattagtaaattactgtaagtattcataagaaagaaagcgatggcacatgcaatgataatccatgttcggctaccaaaacatttccttttactggctatttctaaaatgagagctaaagtaaagttagaaattgtaaaataatactgaatgtgtcatgtgaaaaaatcactaaactattatctgcactttatagttattcagtctaacttttctttttatttcttttttatttttaagatcagagttatttacccattgttttaggctttgcatttgaactggtcattcatgaaacattgaaaggtttcataaaaattactactctatgaaaggtattgttctaaagattgagaacacattgtgaacaagatagtcatatgcatagcttgtggccaagaatctactgtacacaaaattaaggagcaaattctcttcccaaacctattatcctatttgtcaatctcatttgtacagggtaaggctaactcttgaacagtaggtgagttttttgcaagggaattgaagcattgccccaggttctagagggtcaactcctgtgaggaaacttgttactgcataaattgggactaaagccagacctccaagttcctgtcccactgtcttttcacttatctgtctcatccatttttcaagtccacctttgtctttaggagagataattatgtccctcacacaatacgctatactgagaatgggctgtggggatgaacaatgtgaaaactgaaaagaggaagaacacatcttaggaaaaaaatcgtcatattttctctaagaaaataaataacttcataaagtttattgtacaggaagacttggatcattcttgaattttcattgcaaatcaaaaacaggaatttgactttattatcttgggagaaataggaatagaaaagtgtataaaaaataaactttttttaaccaagaataaattgcagtaacaggttaagactctgggtgtcgctgttcaccaatcagggggaaaagacaaaccagaaatttaatcagaatcacaagatttctgcagcacaaagcactggctctggagctttatgaaagcttcaagcggaagccctgagagctctggctgtgaatgcactttattttggacccagaagatcctggggctcctcaggcctcgacagagggaaaaccgaagcacaggcgactccgcggcggggttgtaatggcggcgcctcctgctcgcccagaccacacccggctgctccagatctgccttctcctgggggttctggtggaaatcagggccgaacagattctctactcggtgtttgaggagcaggaagaaggctcagtggtgggcaacatcgccaaggacctggggttggcgccccgggagctggcggagcgcggagtccgcatcgtctccagaggtaggacgcagcttttcgccctgaacccgcgcagcggcaccttggtcaccgcgggtaggatagacagggaggagctctgcgacagatctccaaactgtgtgacaaacctggagattcttctagaagatacagtgaagattttgcgggtagaggtggaaataatcgatgttaatgataacccacccagttttgggacagaacagagggaaataaaagttgctgaaaatgaaaatcctggggcaagatttcctcttcctgaagcttttgatccggatgtaggtgtaaactccctgcagggttaccagctcaactcaaacggttacttttccctggacgtgcaaagtggggccgatgggattaagtacccagagctggtgctggaacgcgctctagatcgcgaggaagaggcggttcaccacctcgttctcacggccttcgatggaggtgacccggttcgctctggcactgccaggattctcataatacttgtggataccaacgataatgctcccgtgttcactcagcccgagtaccacgtaagtgttcgtgagaacgttcctgtaggcactcggctactcaccgtaaaagccactgatccagatgaaggagccaatggagacgtgacgtattctttccggaaagtaagagacaaaatatcacagctatttcagttgaattctctgagtggggatataacaatattggggggtctagattatgaggactctggattctatgacatagatgtagaagcccatgatgggcctggtctccgagctagaagcaaggtactggtgacagttctggatgaaaatgacaacgcaccagaagtcacagttacatctctcaccagctcagtccaggaatcttcttccccgggtacagtaattgcacttttcaacgtgcatgacagtgactcaggaggaaatggcctagtcacatgttctattccagataatctgccattcacacttgaaaagacctatggaaattattatcggttgttgacacacagaacactggacagggaagaagtctcagaatataacatcactgtaactgccactgaccagggaactcctccactgtctacagaaactcatatttcactgcaagtgatggacatcaatgacaacccacccactttccctcatgcttcctactctgcttacattcctgaaaacaaccccagaggagcctccatcttatctatgactgctcaagaccctgacagtggtgacaatgcccgaatcacttactccctggccgaagacaccttccagggtgcacctctgtcctcctatgtctccatcaactccaatacagggatcctatatgctctttgctccttcgactatgagcagtttagagacctgcagctgctgatgacagccagtgacagtggagaccctccactcagcagcaatgtgtcactgagcctctttgtgctggaccagaacgacaatgtccctgagatcctgtaccccaccttccctactgatggctccactggtgtggagctggcaccccgctccgcagattccggctacctggtgaccaaagtggtggcagtggacagagactcaggtcagaatgcctggctgtcctacagcctactcaagtccagcgagccgggactatttgcagtggggctgcacacaggcgaggtgcgcaccgcacgggccctgctggacagagacgcgctcaagcagaggcttgtagtggtcgtccaggaccatggccagccccctctctcggccaccgtcacactcactgtggctgtggccgacagcatcccagatgtcctggctgacttgggcagcctcaagccttcagcagacccagacgactcgggcctcacactctatctcgtggtggcagtggccgctgtctcctgcgtcttcctggcttttgtcacggtgctgctagcactcaagctgagacgctggcacaagtcacgcctgcttcacgctgaaggcagcaggttggcaggtgtgcctgcctcgcactttgtgggcgtggacggggttcgggctttcctgcagacctattcccacgaggtctccctcaccgcggactcgcggaagagtcacctgatcttctcccaacccagctatgcagacacgctcatcagccgggagagttgtgagaaaagcgagcctcttctgataactcaggatttacttgaaacaaaaggagaccctaatcttcaggtgagtcaatcttataatagatcataccacactgaaatatagacaaagagttgtgtaaatgtctctcattttatatgtaatatatcaaataaagttgcctcttttaatattttattgctttaaagaaaactggtggatgaccttccaataatgatcaacagtatttaccacacaaaaatgttgtttattacttatcctttttggtcttcattcagttgtagtttcagccagaattttctaattttacaactctgagccacctcatttccttaaatttccttttctgtgctgggtgtggtggctcacacctgtaatcctaacactttgggagtgtgaggaggacggattgcctgagctcaggagttcgagaccagtctgggcaacatggtgaaacccagtctctactaaaatacaaaaagttagctaggcgtggtggtgtgtgcccgtagtcccagctaccctggaggctgaggcatgagaattgcttgaacctgggaggcagaggttgcaatgagctgagatcatgacactgtactccagcctgggcaacagagcaagcctctgtctccaaaaagtaaaataaaataaagtaaaataaagaataaatttccttttctcttaggtgttcctgaaaagatacaagagacctgtaaaatagaaggcaattgtgtaaattcacatttacaatattctttctcatgaagctattgttggatctggactgagggttttttaatttcctattttcacactctaccatgctttgcttgaagtttacttttccttccttgaaagggtattttccattataacaggcaacgtcaatttaagaatactggcaatttgtgagtttaacttttagatataactttaacaggatattttctcaatgaactggtatatttcaaatattttcttgttgctgttctgagatgcaccagaagtgactatgtgtgattcctctggtgcactcctgtgattatgagaaatatttccaagctaatttcagtcatatataagtagattctaggagtaactttaataatttttaaattgcttatcatgacatcactattgagactttcttgatttccaaggaaaatataagtttttggagtcttttctcttgtcatcatgtgagcctctttcaaaggttgagttacttgggttctggactgatatgatttacgctgcttagtaaggtggcctcatccctattgctacaaattgctttcagatatttctgtcatcatgtggctctgggattattttatatgagggaaaatattttgtgtgtaggggatatacaacacttttgttctttgtgctttcatttaggttctgtgagaattcaaaattcatgaatgcatatgcttacacaaattagtgtaatttgataactggaagttgtagtgatagactgtggaatatgcctcaatttgacttacaaaggagagttttagtttctacatggttttgtattcatagaaagttgtggtgcaatacatagagtaagctggaatatgatatgatgcagttacctggcttggggagcagaaagcagaaataacaagtgaatgttgagagacaacttacatctgaggagagattgtttaaagtaattaagccataaaatataatttggaaatgctcaattggtctgaaactgtgtcaagcatattcaggtgttggcattaggaatatattccagaatgagagtgccacatgttttaaaggcctaggaaagcagtagataatttataacctaaaatcaaattttttaaaaaatgtgtttttgttagaatgggcagtgggtttcttttagcaaataacaattttgattaaacaaattgttgtatattcatattacggactactagataactatattatgggccactagataactataagaaataaataggaaagctctctatgtactgatatgatctttaagatataacaactaaaaaagcaatgtgcagaatatggtatgttgtatgcttacatttgtgtaaagaaggagacagaatatttataaaaatccgttgccctatacaagacatatctccggaaggatacctaagaaactttaacactcatttcccctgtgaaagcatttctcctcatctaaagcagagatgaaaggaagaacctatgctgaatgcatcttttgaatttggaactatatgaatatttcacatattttaaaacaaatgaagactttataaattaaaaaagaaaagaaaagaaaaaagttcttagcaaatattgacaagccattagtgcagtttcctgagaaaacctctgagcgtcgctgttggtcaaaagaacgaagagaagcgtttgggagcctcttagaggggaacttcctgcacaaaccaaccacacagagaaggccagtatagattcggaaacagaaaacaaaagcaggaaaagtgaccttagcccggattctgccatccccggaaggcttattcctcctatgggcaaaggagcaaagggagccagaagatgaaagcgagctcagggaggtgcgggctggtgcggtggctgcaggtactgttgcccttcctgttgtctttgttccccggggctctcccagtccagatccgctattcaattccagaggagctggccaaaaactcggtcgtaggaaacctcgccaaggatctggggctcagcgtccgggacttgccagcccggaagctgcgggttagcgcggagaaggaatatttcacagtaaacccagaaagcggagacttacttgtgagtgacagaatagaccgagaacagatatgcgggaagcagcctctgtgtgttctggatttcgatactgtcgctgaaaatccactaaatattttctacatagcagtaattgtgcaggatataaatgataataccccgctattcaaacagactaagattaatttaaaaattggcgaatccactaagccaggtacaacatttccacttgacccagccctggattcagatgttggtcctaactcactacaaagataccaccttaatgacaacgagtactttgatctcgctgagaaacagactccagatggtcgtaaatatcctgagttgattctaaaacactctctggacagagaagagcacagtttacatcaattggtcctcacagctgtggatggcggagacccacctcaaagtggcacgacccaaatccgaatcaaagtcacggatgccaacgataaccctccagtgttcagccaggacgtgtacagggtcaccctgagggaggacgtgccgccgggcttctttgtgcttcaagtgacagccaccgaccgggatgaaggcataaacgcagagatcacctactcctttcataatgtggacgaacaagtgaaacactttttcaacttaaatgaaaaaacaggagaaatcacgacaaaggatgatttggattttgagattgcaagtagttacactctgagtatcgaagcaaaagatcctggagatctagcagcccactgcagtatccaagttgaaattcttgatgacaacgattgtgcacctgaagttattgtgacttcagtatctactcccctaccggaggattcgccaccaggaacagtgatcgccttgataaaaacgagagacagagactctggagaaaatggagaagtttactgccaagtgttgggaaatgccaagtttattttgaaatcttcctcaaagaactattacaaactagtgacagacggcgctctggaccgggaggagatcccagaatacaatctcaccatcacagccaccgacgggggcaagccgcccctctcctccagcataattgtcaccctgcacatctccgacgtcaacgataatgccccagttttccaacagacttcctacatggttcacgtggcagagaacaatcctcctggcgcctctatcgctcaaatcagtgcctctgaccctgacttgggccccagtggccaagtttcctactccatcgtagcgagcgacctgaagccgcgggagattttatcctacgtgtccgtgagcgcgcagagcggggtggtgttcgcgcagcgcgccttcgatcatgagcagctgcgcgccttcgagctcacactgcaggcccgcgaccagggctcgcccgcgctcagcgccaacgtgagcctgcgcgtgttagtgggcgacctcaatgacaatgcgccacgggtgctgtaccccgcgctggggcctgatggctccgccctcttcgatatggtgccacgcgccgcagagcccggctacctggtgaccaaggtggtggcggtggacgcagactcaggacacaacgcttggctgtcctaccacgtgctgcaggccagcgagcccgggctcttcagcctggggttgcgcacgggtgaggtgcgcacagcgcgtgccttgggcgacagggacgcggcccgccagcgcctgctggtcgctgtgcgtgatggaggacagccgccactctccgctacggccacgctgcacctaatcttcgcggatagcctgcaagaggtattgccagacctcagcgaccgccgggagccctctgacccccaggcaaaactgcagttttacctggttgtggccttggccttgatctcagtgctcttcttcctcgcggtgattctggcaatctccctgcgcctgcgactctcttccaggtcagatgcttgggactgttttcagcctggtctcagctccaagcctggacctggggttctccccaattacagtgagggtacattgccctattcctacaacctgtgtgttgcctcacaatcagccaagacagagttcaattttctgaacataaccccggaattggttcccgcgcaagatctcgtctgtgacaatgcctcttgggaacaaaatacaaatcatggagccgctggggtcccttttgcctcagatactattttgaaggtgagctttaattaatttattttcacttctggttttattgtttcacctaatttgggtaggaagttccactgcgtatttctttgtctgtgagttagatttggccaatgttgtgccttaattgtcttaatcttatctaactgaattttaagtgttttctctctgaagtgtgagatttatttacccatgattgcaaacctttatcacatgagatattgcactgtatttctttttcttcctcatctttacattacttctctctgcagatttgttgctattgagactttaggcaattagtttcaccttcaggctctttgttattcaaattttagttttacttcctcttagaatcataatacttcagagtaaagagagtcttcattttagtaggctttggaaattgggaaacaaagaagaaagacttttgcataatggcatggcttgttaatcacagggcatgggtaggacattgtcccattgacttgaagaccaacactcagtaagctaaatgtcttggaatcacaaatgtatttctaaaggacaggcaatgtttgaggtctgaggtgtctgctagaaagagtgcatttaacaaatgtgagaaatcattctctaacatgcattttaacaaattgctcttaagaaaaactacacattgagaaaaatcttacaacctatgttcacatcattttctacaaaatattacttaaaactttgcttttgaatttcctaattatatagaatttttattttcttagttttctatgaaagtgttattaaataaaatgactttctgaaatgtccatttttttcaatcaagaggtttttctatttctgttgtcatataaagatgatagcagtaaatatctgtctcaacatagaaaggtcactcagtacttctcgacaagtatctgctcatgctttcctgcatggatgatgaaataaaaccccatcctccacagttactatactggttgtcactggaactacaaatatttgaacatggtaatagaaaaacataaaaatgcatagttaacccaactcaaacgctgtctgagatagtggagagactttctcaaagtcctcacaagtaacaaagatctttatttcttctgcatatgacagctaatataacttacataaatcagtaggcctgtttggaaaggtgcatggagaactgggtttgtttccttggtattcttatatgcaaataagcacgttttcctaaatttatcctaataaggagatgaaatcttgaatcctacaaaggtaagaatttgaatgtcctaatttaatggactaaatatagataagaggtaaataaaggacataggctcccccgatgacgcattaaataaaatttttgtaaggtattgagatctaataatcatattgatctcagggattgtggaagtcttgctattcagaattaaagctgaattaacggtcataaacaacgctacacagttaaacattaaggatatggcaacattattagaaataaaattataactaaacttaggagaaataaaaatggaatttgatgcagtcactggttaggactctgagtgtcgctgttgaccaaagtgggaaagaagctgccgcagaggcgacccgactctgctccctccatactaaacacacagaccagacaagctcctacgaaaagccaacgctccacgcccattttcgtcagggaatatgtacccatcggctttagataaataaggaaacagcaggctgaaccagaactaagagaaaattgggcagagagaaggcaatggcgagtccacctaggggctggggctgcggagagctgctgctgcccttcatgctcctggggacgctgtgcgagccaggatccgggcagatccgctactcgatgccggaggagctggacaaaggctccttcgtcggcaacatagccaaggaccttgggctggagccccaggagctggcggagcgcggagtccgcatcgtctccagaggtaggacgcagctttttgccctgaacccgcgaagcggcagcttggtcaccgcgggcaggatagaccgggaggagctctgcgctcagagcccactgtgtgtggtgaactttaacatcttggttgagaacaaaatgaaaatttatggagtagaagtagaaataatcgatattaatgataacttcccgcgtttccgggatgaagagttaaaagtaaaagttaatgaaaatgcggctgcagggacacggttagtgcttcccttcgcgcgggatgcggatgtgggtgtgaactctctccggagttaccagctcagctccaatctgcacttctctctggatgtggtaagcggaactgatggacaaaagtatccggagctggtgttggaacagcccctagaccgcgagaaagagactgttcacgacctcctcctcacagctttagatggcggagacccggtactctccggcaccacgcacatccgtgttacggtcctcgacgcaaacgacaatgcgcccctgttcaccccatccgagtacagcgtgagtgttccagagaacatacctgtgggcactcggctgctcatgctaaccgccacggatccagatgagggaataaacgggaaattgacctactcttttcgcaatgaagaagaaaaaatttcggagactttccaacttgattccaacctgggggaaatctcaactctacaatcactggactatgaagaatccagattctacctcatggaagtggtagctcaggatggaggcgctcttgttgccagcgctaaggtggtggtcacagtacaggacgtgaatgacaatgcccccgaagtgatcctcacctctctgaccagttcgatctctgaagactgtcttcccggaactgtaatcgcgctgtttagcgtacatgatggtgattctggagaaaatggtgagattgcatgctctattcctaggaatttgccttttaaattggagaagtcagttgataattactatcacctattaacaactagggacctggacagagaagagacttcagattataatatcactttaaccgtcatggaccatggaaccccgcccctctctacagaaagccacatccccttgaaagtagcagacgttaatgacaacccacccaatttccctcaagcctcctactccacctctgtcacagaaaacaatcccagaggtgtctctatcttctctgtgacagcccatgaccccgacagcggcgacaacgctcgagtcacctactccctggctgaagacacatttcagggggcgcccttgtcctcctatgtatccattaactctgacaccggtgtcctgtatgctctgagatccttcgactatgagcagttgagagacctacagttgtgggtgacagccagcgacagtgggaaccctccacttagcagcaacgtgtcgctgagcctgtttgtgctggaccagaacgacaatacgcctgagatcctgtaccccgccctccccacagacggttccacgggcgtggagctggcgcctcgctccgcagaacctggctacctggtgaccaaggtggtagcggtggacaaagattcaggccagaacgcctggctgtcctaccgcctgcttaaggccagcgagccaggactctttgcggttgggctgcacacgggcgaggtgcgcacagcgcgagccctgctggacagagacgcgctcaagcagagcctcgtggtggccgtcgaagaccatggccagccccctctgtcagccaccttcacggtcaccgttgccgtggccgacaggatccctgacatcctggctgacctaggcagtatcaagacccccattgaccctgaggatctggacctcacactctatcttgtggtggcagtggctgcagtctcctgcgtcttcctggccttcgtcatcgtgctgctggtgctcagactgaggcgctggcacaagtcacgcctgcttcaggctgaaggcagcaggttggcgggtgtgcccgcctcgcactttgtgggcgtggatggggttcgggctttcctgcagacctattcccacgaggtctccctcaccgcggactcgaggaagagtcacctgatctttccccagcccaactacgcagacacgctccttagtgaagagagctgtgagaaaagcgagcctcttctgatgtctgataaggtagatgcaaacaaagaagaacggcgagttcaggttagttttctctttcggtaaggatgaccagaacattttcatttgtttcctttttcatgtttctgtcatattcagaatcagctagttatgtaaatagtggaacattatttgctgtattggagattaattttttttatataattcatgctttctccatttgttttcaaattctgttttgggaagtctagctgatatctgtagacttaagtgaaacaaataccttaaaggaaagtggttaaatataatcattttacccaaatattttgttatattggaactgcagttctattaatagaaaagatgttttatttattcaaattgttagatatattgttctcttttgagtgtctgcctagacaccattagtgaatgtgttttggaaaggataatgtataggactgatattttagtctacctgaaatttgtttaaggaaataatttacagtatttacataaatcagtggaaaggtacagagaacttctgggtcataaatatcagaaaagaggccgggtgcggtggctgacgcctgtaatcccagcactttgggaggctgaggtgggcggatcacgaggtcaggagatcgagaccatcctggctaacacggtgaaaccctgttctactaaaaatacaaaaaattagccgggcgtggtggcaggcgcctgtagtcccagctactcggaaggctgaggcaggagaatggggtgaacccgggaggaggagcttgcagtaagccgagatcgcgccactgcactccagcctgggagacagaacgagactccgtctcaaaataaataaataaataaataaataaataaataaatatcagaaaagtagataaaatttatattaatgataacatgtagcattctaaagtctggaaagtttgtgttaagccatgtagttattggatatgtgggcttgttgagagaagaaatcagtgtaaaggaaccttaaggttgggcttcgttctgtgatgtaaagcctccagagagttacatactgctgcactcaataaatgtaaatatgtcacacacctggcatcttctgttatagataaaccctttacttattagaatcaatacctactgcaatgttagcgtttctttaagtgtaggtgcaattcttctttattacttgagtttaaggttgtatttgaaaaaaaaagaactcaacttaaagatggttcaaaattttaaatttcatatctaacgtatgtgctcatcttaaattaatagatttgtcttaatgaaatactggcctatgtgcctcaaattccaggaggatgtgttatgtaatgaaagaactactatatttcccttctgcatctgatttgctgaagatgattttcagatgtttcttattaaaatattcttaatccttcaaattttgtacttttaaaaccttgagcatcagcttcaaataatgactaaataaggggaaaaggtaataaaatattacaaatgggatagtaagctacattactcaaccacatgaaaggttaattgacacattaaagaacctaagaccacttgatttttattttttaaacactgttaaagagcattcaagtatatctatatctatatacatatacacacacatatatatacacacatatatatacacacatacacacacacaaacacacatacatacacacatggacattctgaccaaaatgtaaaatgtacaaactcaccgaatagtgaatgcatccaaagagtaacaagagaatctatacagtaggtgtcgacattattcactcctatgtgaaaacttgcttttccattttttttaaaagaaaatgttatatgcttcttagggtaaggtgtttgggaaaaaagtaaaggttatagatttgggtacatttcttctgagttaaatgttttgtgcaatggaaaaatatctttaaaccctctataaactactaacagactataaaatgcttgatccatacattttgaatgtatgtactgtatataccatatacttttaaatatctgaatctttagttttatatgtgttctgaagaataatttttcatactaattgaagtgttcatacaatgaacacttggcattgtgttggaaggcacttgctttggaatgttttggagcaaagtcttgagtcagttatatttttgatgtttgtataaaggtgacaatgagtgtctgtctagaattctggttactgtgagtagtttaagatgctataatgcttttccactataaggtgaattcggtgtggaactcattgcttattgctgcacacttgcctagttttagagtaacaatacattatgtaggctaaagataatttctttaggaagattttctggtttgaaaatggaattaaaactgtaagacacctgtcagaaacatggaaaatggcatgttattgaccagggaaaagtgtaaataacaaaaagttaggattatcagatggtaaactggggaccaaggaaaagtggacaggaagattacttatataattaaataatataattataaggacttacaattcactccccaatcctaataacgcatcattgttaggctacttgagaagaaacagtacatttcaggacaattgtgatgtagtatgaaaaaacatcctttgtaaaagtttttcatttgggccagggtggttcatgactataatcccagcaatttgggacgctgaggtgggaggattgcttaaagccaggtgttctagcccagcctgggcaacatagtgaaaccccacctctatagaaaaaaaaagttttcaatcatacttatttaattaaaagtagacacttggaaacaaaggaaaagagaccctcttgctttttactatacttctattttataaggtcaatcatttcctcattacctttaacttcttttggggggagataataaagataaaagagaagaaagtgaaacatagaataaaactaaaagctatgacattataacttttagaagttagaagtaaaggaaatagaatgcaataagaatacacgtgaagctgatatttcaagcctctttatactacgtcttctgccatcaccaaaaatagcttccatttgtatgattttctatgtattattttatttggccctcatttctactagagtaagcagagaagatattattatgaccattttatgaaaatggaaactaaaaacgtgacgggattgagcaagattatctctgccctttgacaagtaaaaggtacttgatttggatggataaagctcaaattaaaagaaataacagactaaagatatagtaagtatatttaatgttttttaaaagtccttttaaaatgggaagaaagtatcactatcagtacactgccgatttttctcctaactagctccttatttggagctgatttagtcaccattactgcagttctgcagcagaggcgccgggtgccgctcttggctagtgctgtgcaaaatattggctcctcccgctgcagccagctcggaagaaaagtgcactctctatcaggcttcctgcagcggagacacccattagagaacccaagcacaaagacaaagcaaatagttggtcctgctcggagaactcttgggattatttaaagatctcctctcctcggatttagaaaggcaaaggcgcagagagcgggatgggaaatagctccggatggaggggcccagcagggcagaggcgaatgctatttctcttcctgctctctttgttagaccaggctctctccgaaccgatccgctacgctattcccgaggagctggacaggggctcgctggtagggaacctcgccaaggacctggggtttggcgtgggggatttacctactaggaacctgcgggttattgcagagaagaaattctttaccgtgagccccgaaaatgggaacttacttgtgagcgaccgtatagaccgagaggagatttgtggcaagaagtcgacgtgtgttctggaatttgaaatggttgctgaaaagcctttaaacttttttcatgtaactgtgctgatccaggatattaacgacaacccaccgacctttagccaaaatatcactgagctggaaatcagcgaactggctctcactggagccacatttgccctggaatctgcgcaagatcctgatgtaggtgtcaattcgctgcagcagtactacctcagccctgatccgcacttctctttgattcagaaggagaacctggatggcagtaggtacccagagctagtactgaaagcacccctggacagggaagagcagccacatcaccacctggtcctcacagctgtggatgggggcgagccctccagaagctgtaccacccagatcagggtaattgtcgcagatgcaaatgataaccccccagtatttactcaggacatgtacagggtcaatgttgcagagaacctgcccgctggctcctccgtattaaaagtgatggccattgacatggatgagggcatcaatgccgaaatcatctatgccttcatcaatattggcaaggaagtgagacaactgttcaagctggacagtaaaacgggggaactcaccactattggagaactggactttgaagagagagatagctacacaattggggtggaagcaaaggatggtggacatcacactgcatattgtaaagtacagatagatatttcagatgaaaatgacaatgccccggagataaccctggcttctgaatcccaacatatacaagaagatgctgagctggggactgccgttgccctgatcaaaacacatgatctagattctggatttaatggagaaatcctatgccaactaaaaggaaacttcccctttaaaatcgttcaagataccaaaaacacatacaggttggtgacagatggagccctggaccgggagcagatcccagaatacaatgtgacgatcacagctaccgacaaaggcaatccaccgctctcctccagcaagaccatcactctgcacatccttgatgtcaacgacaacgttcccgttttccaccaggcctcctacaccgtgcatgtagctgagaacaatccgcctggagcctccattgcgcatgtcagagcctcggatcccgacttgggacctaatggccttgtctcctactacatcgtggccagtgacctggagccgcgggagctgtcgtcctacgtgtccgtgagcgcgcggagcggggtggtgttcgcgcagcgagccttcgaccacgagcagctgcgtgccttcgagctcactctgcaggcccgcgaccagggctcgcctacgctcagcgccaacgtgagcctgcgcgtgttggtggacgaccgcaacgacaatgcaccgctggtgctgtacccagctctggggcccgaaggctctgcgctcttcgatatggtgccgcgctctgcagagcctggctacctggtgaccaaggtggtggcggtggacgcagactcgggatacaacgcctggctgtcctaccacattgtgcaggccagcgagcccgggctgttcagcctgggcctgcgcacgggtgaggtgcgcacggcgcgtaccttgggcgacagggaggccgcccgccagcgcctgctggtcactgtgcgtgatggaggacagcagcctctttcagccaccgtcatgctgcacctaatcttcgcagatagcttgcaagagatacaacctgaccttagcgaccgccccactccctctgaccctcaggcggagctacagtttcacctagtagtggcgttggccttgatctcagtgctcttcctcctcgcggtgattctggcaatctccctgcgcctgcgatgctcctccagacccgccactgagggctactttcagcctggtgtctgcttcaagactgtacctggagttctccccacctacagcgaaaggactttgccttattcctacaatccgtgtgctgcctcacattcctcaaacaccgagtttaaatttctcaatataaaggctgaaaatgctgcaccacaagatcttctatgtgatgaagcctcttggtttgaaagtaatgacaatccagaaatgccttctaattcaggcaatttgcaaaaggtgagtttcttcaaacctttccttccataaatataattgggtttcaattcattgatttagagataaaaagaatacagattaaatattccctgattacattattttattgattttctggtgtagagtagggtgtctaggaaattctttgtagaatttcctgtagaatatctgtgttgcagttgttctttcatagaaagcctccttttgatagtcttgaaacttttcttaatcctaatacactataatctgaaacatttttaatacagtattatctcacactgtcattttcagacatatctatccagaattagacccaaatcctcacaattaagtggtttacttagttttaatgcagtcaatcctaaaatatatgaaacattatgtatatcttaacacatttttaatgtaacctgtatataatatttttacttccctttgcatgtttttaaaagtatacacagatgttgcctatgtcagggcagtttttaacttctatgctaatcaaaagaaataatggcatctaaaatggcaactcttgtaatgggcactgtaatgaattggttcaaaatgtgtttgtgtagcatatgcctgtagtcccagctactcgggaggctgaggtgggaggatcccttgatcccaggaggtagcagctgcaatgagctataattgtgcccctgcactctagcctgggagacagagcgagactttgtctccaaaaaagtgtttgtggttgttggtacccttactgaaaatgggactagcataaatggtggtgaaatgtgatgataattcaaaatttacagaagattgtaatattatttctgttccccaaggtcctaagagatattttcataaaaatgaatggtaaacttcagagaacatttaaaattattcaaaataatctcttacactcttctaaatgcttcattatcttggggagggaaatattatgagtgtcatctctgcagatttagcagaaataaaatcctctgtgtgatagtttcacaaaacgatgcagtattaagttaggactctaagcgtcgctgttgaccaacctgggcaagaaaatcaacggaaactcaagttacatcctccaacaacaaagcaaattagacgggaaagcaggaaagctgtgcagaaattctgacctgaaacgcttcgcatccggtctctgcttgttgaaggaccttcaccgctatttctgagaagagcaaaagtgatgcagatctgttcttcctcttcttaatcccagagaagttcctaataagccagtaatggcgcctccgcagaggcatccgcagcgcagcgagcaggtcctgctcctcacgctcctggggacgctgtggggggccgcggcagcgcagatccgctactctattcccgaggagctggagaaaggctccttcgtaggcaacatcgtcaaggatctgggactggagccccaggagttggcggagcacggagtccgcatcgtctccagaggtaggatgcagcttttctctctgaatccgcgaaacggcagcttggtcaccgcgggtaggatagaccgcgaggagctctgtgctcagagcccgcggtgtctggtgagttttaacatccttgtcgaggataaactgaatctttatcccgtggaagtggaaatagtggacattaatgacaatacaccccgattcttaaaggaagaattggaagtgaaaattctcgaaaacgcagctccatcctctcgttttccactaatggaggtctatgaccctgatgtgggaatgaactcccttcagggatttaagctcagtggtaatagtcacttctcagtggacgtgcaaagcgaagcccatgggcccaagtacccggagctggtgctggagggcacactggaccgggaaggagaagccgtttaccgcctggtccttactgccatggatggcggcgaccctgtccgctcaagcgtcgcccaaattctggtaacagttctagatgtgaatgacaacactccaatgtttactcagcctgtctaccgtgtaagtgttcctgaaaacctgccagtaggcacaccagtgttggcagtgactgccaccgaccaggatgaaggagtccacggggaagtaacttattcctttgtgaagattacagaaaagatctcacaaattttctgtttgaatgttttgactggagaaatttcaacttctgcaaatctagactatgaggactcgagtttttatgagctgggtgttgaagcccgggatgggccaggtcttcgagacagagcgaaagtcttaataactatcttggatgtcaatgataatgtaccagaagtggttgttacatctggaagcagaacaattgctgaaagtgcacctccaggaacagtaatcgccctttttcaagtgttcgatcgagactctggcctgaatggcctggtaacctgttccatcccgagaagtctcccatttgaattggaaaaatcagttggcaattattatcgattagtgacaaatgcagctctagaccgggaagaggtattcttgtacaacatcactgtgacagccacggacaaaggaacaccacctctgtctacagaaacaatcatctctctaaatgtggcagacaccaacgacaacccgcccaccttcccccattcatcctactcagtctatgtccttgaaaacaaccccaggggtgcctccatcttctctgtgaatgcactggaccctgacgtggaccagaacgcccaagtctcctactcactggcagaagacaccctccagggggcgcccctgtcctcctacgtgtccatcaactccgacactgggattctgtacgccctgcgctccttcgactatgagcagttgagagacctacagctgtgggtgacagccagcgacagcggggacccgcctcttagcagcaacgtgtcactgagcctgtttgtgctggaccagaatgacaatgcgcccgagatcctgtaccccgccctccccacagacggttccactggcgtggagctggcgccccgctccgcagagcccggctacctggtgaccaaggtggtggcggtggacagagactcgggccagaacgcctggctgtcctaccgcctgctcaaggccagcgagccaggacttttctcagtgggcctgcacacgggcgaggtgcgcacggcgcgcgccctgctggacagagacgcgctcaagcagagcctagtggtggccgtccaggaccacggccagccccctctctccgccactgtcacgctcaccgtggccgtggccgacaggatccccgacatcctggccgacctgggcagcctcgagccctccgccaaacccaacgattcggacctcactctgtacctggtggtggcggtggccgcggtctcctgcgtcttcctggccttcgtcatcgtgctgctggcgctcagactgcagcgctggcacaagtcacgcctgctgcaggcttcgggaggtggcttagcgagcatgcccggctcgcactttgtgggcgtggaaggggttcgggctttcctgcagacctattcccacgaggtctcactcactgcagactcgcgtaagagtcatctgattttcccccagcccaactatgccgacacgcttatcaaccaggagagctatgagaaaagcgagcctcttctgataactcaggatttacttgaaacgaaaggagaacccaggcaacttcaggtgagtttctttccgcctaagcgggaagagtaatctgatcttcccgcaacccaactaatcagacaggctcatcagctagatcggctgttatagaagcgaacctcttttggtacaggaagattcgtgattttgtaaagtggaagactcccttgttcaggtgagggtatcgtttttttttttttttttttttgagacggagtctcgctctgtcgcccaggccggactgcggactgcagtggcgcaatctcggctcactgcaagctccgcttcccgggttcacgccattctcctgcctcagcctccctagtagctgggactacaggcgcccgccaccgcgcccggctaatttttttgtatttttagtagagacggggtttcaccttgttagccaggatggtctcgatctcctgacctcatgatccacccgcctcggcctcccaaagtgctgggattacaggcgtgagccaccgcgcccggccgagggtatcgtttttattggttgacaggaaaattcaagattgtctttgattagtgcttagttttcttagccctttgcagagagtcacataattctaatgtttttcttttatatcaaaagaatgttctgaagtcttaattttgtgggggaaaataatgcatgtcctagtttttctttacctttctcttcttggcaaactatttgtgtcttggattgagtacatctcgtttcttaggttttttcctactatgtgacatttgtaaggttctttctttttctaatgtgggaaaaaaaataaccttaatttaggtcagtgttaaagatcaagatcttggttttagctagcatggtggttcacgcctgtaatcccacctcttcaggaggctgaggcaggaggatcccttgagaccaggagtttgagaccagcctgggtgactctgtctctaccaaaaagaaaaaaaagtagccagatgtgtggcgtacacctgtagtcccagctactcgagaagctctgataggaggattgcttaagtccaggggtatgaggctgcagtgagatataattgtgtcactgcaccctagcctgggagacagaatgagactttttctctctctctctcaaaaaaaaaaaaagattttgttttttctcagtgttacttgataactataaacgacagacgttcatacaagagatctttcacctttactacttaggaatcaaaaattatttttgaaaagataagaatcattggtaactgcagcaggggacaccagatctttggtgttaaaagacctgaataacattcctgtaactatctgttatttacttgggccagttacaatcgccattatcttccaattaaaattaagatttaaaagacttctcttatcagagataggatccccctctgttgcccagtctggagtaaaaatccacctgtaactgctgcttatagagtgtgtatccagggcaacttgaatctatgttcctgggttgcaatcctaaagcttggctcaaataagctctacttatattattttttaaaacaagactttccttatctatctgactcaaattctaagaaaataattttataactttttttcaaactctaaagcagcatagtgaacacgtatttgttgacatcaccattattataattattgggttgttaacaataactaagcaccgatgctgtgtgcctactacagtgtcttttgcatactgtgtgcctgatagtatttaagagtgaaaatggccgggtgcggtggctcatgcctgtaatcccaacactttgggaggccaaggcaggcatctcacgaagtcaggagttcgagaccagcctgaccaacatggtgaaaccccgtctctactaaaaatacaaaaattagccaggtggggtggcatgggcctgtaatcgcagctactcgggaggctgaggcaggagaatcgcttgaacccatgaggcagaggttgcagtgagccaagatcgtgccactgcactccagtctgggtgacagagcgagactctgtctcaaaaaataataatgataattaataaataaagagtgaacatgaattttaaaacatgctcggtagtgtctgcttacaggacatatctctaaaaatagatgactgactggtgaatgggagaacaaatgttaatgaggttcaaataaaaatttaaatattttagcattttaacccagacaataaggctttcatcatataggaactctttattgaaatatttcaagaaaaaagggattatcatttagaagactgattagtcttatttattatgactgaaatgtgcaaacagaatcattgtttcatgaacagaaaacagcagagtttttgactgtcaatgatgttcgaatagaaaatggatcactaaggagataggagattctgttatcgacagtcttcaaaagtaagttgatggccctggaatgaatggagtacaggggattctctaatttgatgacttgttgaactacattatagtcaagatttttctccagtcatgagttggaagattctacaatctggtggtattatagaatggattggccacttgtgcatctgaatttgttatgaatgtgtaagaaaaaagcaattgagaagataccttgaaaataaatgagaacctcctttgtaacctgactttgtcagtcttcttaaagataacattgagttgatgtgtttttaaataagctgctaagagtaatatgtgtttttctgaaccaatattgtggtatttacatttaaggaattgttatagatttatttatttcaagtttccaaaggtatatacctaaacaagagatctaatcatacacatcttcaagctcattttcttgtatctttgtgatataatttgataaaataacattttaaacaacttgaatcttggatattagtctcatgagttagatgggctgttatacatatgattatttcataaactctgaaagtgtgaatgttattttactatactaccaatttgggatgttaaactacatcttgagcatttgttgttatagggaaagctcactaactacttttcatggagatcaggctggtttattttattctcttattacctgtgaccatttcatttaaacaaataaaatatttctctgatggaaaaactaccaacttctactctcacaaaagtcattcactcatgtggactgaccaactgttaaacatcctggcagtcatggaatttgctaagttatggctaaatgaggttctttaatccacctgcaatacagatcattaataataagataggctatctgaggttttgagagttcagtatagaattttgaagcatcaggaaaaaaaactaccaaattattgtcttattcttattttatggtctgtgaaagcctcttttttttttttttttttttttttttttttgtcagagtcttgctctgtctcccaggctggaatgcagtggtgtgatctctgctcactgcaacttcctcctcctgggttcaagcgattctcctgcctcagcctcccaagtagctgggattacaggtgcatgccaccatgcctagctaattttcatacttttagtagagatggggttttaccatgatggccaggctggtctcaaactcctgaccttaagtgatccacccgcctcagcctctcaaagggctgggattacaggcatgagccactgagcccggcctgaaaggcattcatttctgatcaggcttctgttgaggtggcaattgtcaaaggggaaggagtaaaatctcagaggagaaacattggaagatacctatatctttgcttgagaatgaaaatctaaatggaacttcaaagaactgttttgttgtttgttttttagaaaaaaaagtcccaaaaaagaaaagagagaagataatcaattcgatgcccaggaagccaaatagactttacatagaattctttttaatgcaaccaaacaaatggtcaggattcttcccaatatctcagtcaacaataatatacactctttaaactatgaaatgatttcaatttgatacaatgagcttatgttagattttattaaacatatcttggcggtctagtaaagatctttaatatttaattttatgatgttcgataacttagaaaatgtgaatgctagagacaatgaagccatttactccatagggtatgtatgctttgtgttcggagtagtctataatttaatttaactagctcttatttccttttctccaaagaaggtaccaagacactataaattaattgagacttttttaaaacagtagaataagaaacaaatgtgagatgaaactatgaattttgaggcatcaggtaaaaatggatcaagacattgagagctataacctccaaacatgaaagtttgtttgaaaatatctacaagtgcttacattgtttaataatcatacactttgcttgcctcaacaagaagttcaaaagtactattaaacaaatagaatttaactccagtttacagaattcatctataatacctctattagttcctttaaacaaaatttatctactttgtgaatgcaaagataactatggattattttgatagatcaaaacagaatgtccttcaaagtgttccctgtattctggagcaatgccaccagaaagcagaaataggttacttaggagcctcccacaaaacgaagttaagctttcttagtgttagttctggattctcctcctggttccaccaactactctccaggacctagaagaatttacaaaccaagactgtttcttgccaggtctttattccagagcaggtcattctcttttattctgcaactatgtgaaaggagctttcttttctttctgctagcagagggtagcctcggatccatcaataatttagttttactctatcaacatcagtggagagacgagtacctctaaggatcctgtcaggacagtcctgcattttgctcaaatgctgtctagagatccctgttttctcaattacactagaatagagtaggatgaagatttgaattgcatactaggatgaagacttgaattgaattgcataatgaaaagaatcagccaatccattatccagtttcttatgaattcacagcccagtaggatctctgcagatttctgccttctgtagaaaatgggttgcttctatagctgattgctgcagccaagacaaacaacgatttctttctttttttctcacaagactgggagtgagaatatttggattccgacattgttctactactatataatcaataatcaggaacaaggcaaggcaattccctctttctttctttctttctttcttcttcttttttttttttttttttttttggcagagttttgctcttgttgtccaggctggagtgcaatggtgtgatctcggctcaccacaacctccacctcccgggttcaagcgattttcctgcctcagcctcctgagtagctgggattacaggcgcgcgccaccacgcccggataattttgtatttttagtagagacggggtttctccatgttggtcaggctggtctcaagctcccgacctcaggtgatccgcccgcctcggcctcacaaagtgtgggattacaggcgtgagcaacagcacctggccccccctctcattttttaaacggttaaaatgaaggtgttagaccgtctctaaggttctatacaatcaaaaatttattaaaataggtctatatattttacaacaattttgactttctgaatcttgcatcatggtgtctagaacatatgtgttcaattaatactgaattaattaaaatttatatacactgatgtaaatattttctaagtaaaatctttcatatgtatttaaataaaatttacctttttgccttcaataactgattttcccatgtgcaataacgtgtgagtcagtgcccaaaagagtcacttgaaagttgcaaggcaaagcagttttttaaaaattatctaagattatcaaacaccggtccatgaacactgttgcattaattcagtgtcttaaaatggatttttaattatcagggatatctagagcaaagaaatctaacagggaaattttgaaagatgaaacaattttctatgaaatcagtgtattgtgtgcatcaatgtggtgcagtaacttagtaaggactcacagcgccgctgttcaccaaccagggaaaaatggtgcgagagatcccacagaaaccaccgagttttacagcacagagaaacgacagattgcgataagccctcttccaggctgcactaaactcaagcctctatcctgctggattctgagctccccttcctaagacagaggggtccacccggatacacccgcattctgaagcacttcccgagatcggcgcctaagcaagagaagcaggacgactatggcggctcagccgaggggcggggactacagaggattcttcctgctctccatcctcctggggaccccctgggaagcctgggcaggacgtattctctactccgtgtcggaggagacggacaaagggtcctttgtgggagacatcgccaaggacctggggctggagccccgggagctggcggagcgcggagtccgcatcatctccagaggtaggacgcagcttttcgccctgaaccagcgcagcggcagcttggtcactgcgggcaggatagaccgggaagagatctgcgctcagagtgcgcggtgtctggtaaactttaacatcctgatggaagataaaatgaatctttaccctatagacgtggaaataatagatattaatgacaacgttccaagattcttgacggaagaaataaatgtaaaaataatggagaatacagctcctggggttcggtttccgttaagcgaggctggggatccagatgtgggcacgaactccctccagagttaccagctcagccccaatcgccacttctccctggctgtgcaaagtggagacgatgaaactaagtacccggaactggtgctggagcgggtgctggaccgggaggaagagcgggttcaccacctggtcctcacagcctctgatggcggcgacccgccccgatccagcaccgcccacatccaggtgacagtggtggatgtgaatgaccacacgcctgtcttctctctgcctcagtaccaagtaactgtccccgagaatgtgccagtgggtacaagactgctcacggtacatgctatcgacctggacgagggagtcaatggggaagtgacatattcttttcggaaaataactcctaaacttccaaagatgtttcatctgaactcgcttacaggagaaatatcaactttagaaggattagattatgaagaaactgccttctatgaaatggaggttcaggctcaagatggtcctggtagtctgacaaaggcaaaagtactgatcacagttttagatgtaaatgataatgctccagaagtgactatgacgtctttaagtagctcaatccctgaagacacacctcttgggacagtcattgctcttttctacctacaagacagagattctggaaagaatggtgaggtgacctgcaccattccagaaaacctaccttttaaattagaaaaatcaatagataattattatagattggtcacaaccaaaaacttggaccgggaaacactctctttgtataacatcacactgaaagccacagatggtggaactcctcccttgtccagggaaactcacatattcatgcaggtggcagacaccaacgataacccacccaccttcccccactcatcctactcagtctacatcgctgagaacaaccccagaggggcctccattttcttagtgactgcacaggaccacgacagtgaggataatgcccagatcacttattccttggccgaagacaccatccagggggctccagtgtcctcctatgtctccataaactctgacactggagtcctgtacgcgctgcaatcctttgattatgagcagttgagagaactacaactaagagtgactgcacatgacagcggggacccgcctctcagcagcaacatgtcactgagcctgttcgtgctggaccagaatgacaacccgcccgagatcctgtacccggccctccccacagatggttctactggcatggagctggcaccccgctccgcagagcccggctacctggtgaccaaggtggtggcggtggacaaagattcaggccagaacgcctggctgtcatacctcctgcttaaggccagcgagccaggactctttgcggttgggctgtacacgggcgaggtgcgcacggctcgggccctgctggacagagatgccctcaagcagagcctcgtggtggccgtccaggaccacggtcagcctcctctgtcagccaccgtcacactcaccgtggctgtggctgacagcatccccgaagtcttggccgacctgggcagccttgagccctccgacggtccttacaactatgacctcacgttgtacctggtggtggcggtggccacagtctcctgcgtcttcctagccttcgtcctcgtactgctggcgctcaggctgcggcgctggcacaagtcacgcctgctgcaggcttcagaaggtggcttggcgaacgtgcccacctcgcactttgtgggcatggacggggtgcaggctttcctgcagacctattcccatgaggtctccctcaccgcggactctcggaagagtcacctgatcttcccccagcccaactatgtagacatgctcatcagccaggagagctgtgagaaaaatgattctttgctaacatccgtagattttcaggaatgtaaagaaaacctgccaagtattcaggtgagcccagcccttcctttatttccatgaggaatttatttgcatgatatttctctattattttgcaaaacaaatgttttgaaaatagggatttaaaaaactttatagaggtaaaaatgagtttaccagtttccttcagtggtgacactttaatatagaacacataggatatagtatttctttagtgaaagcctatggacaagattatgaatatgtggactatcacattttataatttccacctactttccaatctatgttccaacctactttcttaactcatatattttatacattggaatgaatcgagtctttcatattgcacaaggttagcaggaataaaacacacctcagctgtcttctcaggattctctttagcattcaaatatgtaaaaggttctgaaagatttcttccatgtgaagatttttttctgtggctgattctgcctccatgtacctcagcttggtggtcctaaaaaatcttgattgcttcttgacctatttacagtataatcatttattaatggggtggtagtagaaggttggatttatgcctaaagaatgaaatgtgtgtgtatcacacttcactaagatctatatcaaagacagacatcaagtctaatgccacactaaaggccatcggacaaaaccaataaaatatgtcaaataaaatgtcattttaagtgttgtaattggcatttgtgacataggcaattacatgttttaacagagaattccagtatgttgttttagtggtacagccagatgaagtgtgtctgtgggctatcaaagtgggagattggggatactggctttgtttcaactgtctcacgtactcaaaccttagaccatcttatgtacacagatcctagaccagtagttgattttatttattaggtctactgaaaaattcagttggaaataacccaatctgggattaactacttccatattcttttgtataacattttagtaaagctcagtatatcaagtgattgtcatccagaaggggtggatgacaaggtaatcttgattccagagacctttgagtattaattaaaaacacacttttagccaggtatggtgttgcaagctgtagcccacctgcatgggaggctgaggcaagaggacagcttgaacccaagaattggaggcccacctagataatataacaagactctgtctcttcaaaaaaagacttctttttagactagtgttgtatttggtagtattttgcacatgatagactctgtacaatagtgtgggggatacattttttttttttgacatggagtctcgctctgtcacccaggctggatacattttacaagttctgcagtgttcacatttcagatgtacaatcacttggggtagaagacaatgttgctgacaccaacaatgttactgagggaagatcctatggcagaactacggttataaggtattttgtaaaagaaaatctcctgaccaaaatttattagatgcataaaattgtttttaagcaatggagagacataatcactaaactcagtgagctattgcaatcaaactttccagggattgtttccttcaattcagaggtcaccaaggaatgtaaaataagtgcagaggtaggaagcagtgcttcagtgcagcagatctcagtgactttgtgttttgaggctatgtattatccccctgataactttgaagatgaatgttgtatttcataaccagtaaaataattgtgtaatgaggagaggagtaggctactgcctgtgatcatcgaaatgagaatcacataatattcctgtaatgaaatcactgaaactattgggaagggggtgtatttgaagataagtataaattgcaccttctaaaaggcaattttggtattactgatactctccggaaaaagttgaaataaatcaacttggaggtacttagaaaagtggagaaaatgttaggaacaatgaaagaaagataaaatgtatccagtatatttctaatgagtaagtatggaaaattactgtactctgagacggtttaggccaagtctgtgttatggctatctttatatagatagtgcatgtttgaagattggggaaagcttatgtcaataaatgtttatgtacttaatctacatgatttgcctaaaaatcctcaaagttgggatgaaggcattcctaagagtacatttttagacgtcattaaatatacagacgtatccacgtagtttttgttctttcagttaggcacacaattataattattgcactggttaacttgaagcagcagaggctgtagtttcctagtgctgactctgggcgccgctgttggccaaagtggagagcttggcgctccagatctcctcgcgcagccgcagcgcgctttccagggcagccccagctcagactccccagcgccagcctttacaccgcttcctcctcggaaaaagaagaattttttcttgaactggaactgcaactaaagtccgttcggagatccaaaaatctgcaatacagaggttatttgtaacccggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacacgatttatattaggatctgcccatgatgcggatattggtagcaacacactgcagaattaccaactcagtcccagtgatcatttctcactgataaataaagagaaatcagatggcagtaaataccctgagatggtattgaagacacctttggacagagaaaagcagaaatcctaccacttgactttgactgccttggactttggagctccacccctaagcagcactgcacagatacacgttctagtgactgatgccaatgataatgctccagtgttcagtcaagacgtatacagggtgagcctttcagaaaacgtgtacccggggaccacggtgctacaggtgactgccacggaccaggatgagggtgtcaatgccgagattactttctctttcagtgaagctagccagatcacccaatttgacctgaactctaacaccggggaaattactgttttaaatacattagattttgaagaagtcaaagaatattccatagttttggaagcaagggacggtggaggaatgattgcgcaatgcacagtggaggtagaagtcatagatgaaaatgacaacgccccagaagtgatattccagtctctacccaacctaattatggaggacgccgagctgggaacacatattgctttgctcaaagtccgtgacaaggattccagacacaatggagaagtgacttgtaaattggaaggtgatgttccatttaaaatattaacttcttcaagaaacacgtataaattagtgacagatgctgttctagaccgcgagcagaatccagagtacaatataaccgttacggcaacagatcggggcaagcctcccctctcctccagttccagcatcaccctgcacattggtgatgtaaatgacaacgctccggttttctcacagtcttcctatatagtccacgtggccgagaacaacccgcctggagcctctatttcacaagtcagggcttctgatccggacttggggcccaacggccaagtctcttactgcatcatggccagtgacctggagcagcgggagctgtcatcctacgtgtccataagcgcggagagcggggtggtgttcgcgcagcgcgccttcgaccacgagcagctgcgcgccttcgaactcacactgcaggcccgcgaccagggctcgccagcgctcagcgcgaacgtgagcctgcgcgtgttagtggacgaccgcaacgacaatgcgccacgggtgctgtaccccgcgctgggtcccgacggctctgcgctcttcgatatggtgccgcacgctgcagagcctggctacttggtgaccaaggtagtggcggtggacgcagactcaggacacaacgcctggctgtcctaccacgtgctgcaggctagcgagcccgggctcttcagcctggggctgcgcacgggcgaagtgcgcacagcgcgtgccttaggcgacagggacgccgtccgccagcgccttctggtcgccgtgcgtgacggtggacagccaccactctcggccactgccacgttgcacctggtcttcgccgacagcttgcaggaggtgctgccggatatcactgaccgccccgacccctctgacctccaggctgagctgcagttttacctagtggtggccttggccttgatctcagtgctcttcctcgtggccatgattctggccattgccttgcgcctgcgacgctcctccagccccgcctcctggagctgcttccagcctggtctctgtgttaaatccgaatccgtggttccccccaactacagcgaggggactttgccttattcctacaatctatgtgttgcacatacaggaaagacggagtttaatttcctaaaatgtagtgagcagttgagttcaggacaagacatactttgcggtgattcatctggggccttatttccactttgtaattccagtgaattgacttcccatcaggtgagtttcctttaagtataatttaatgctcattgcctacccatttctccatattcacaagaaaatatacatatttgcaggaaaatatataatttttagatgtcatggatcattttaggaaagttgtagtcagttaaaaagctgtcatatcattctacaaaggaggagtaaagtaggagcaattgtgtggcccaacatttgtttgttttttagccaagcttagatttataaagcaatgagggtgtggttttaaccacaaagtgaaagtgttagacagttgttggctctctcctaaaaagtgaatgagatttttcctatacattttccttcttgttgactaatatatgatgaatacttttttcagcttggatataccataaatataaaaataataaagccaaagaatttaagctaaaattcaacacttttcttaactaatttaactggtatggtctccatagtagtccactgttttgtttcctgtgttaacttcccttttgtttcaaaagctcttagaataaggagtcaactggatttttatgtccatggaccccttgtgattatatgcagtgtacgctgtgtgtgcgtgtgtgtgtgtgtgtgtgtgagagagatccttttacttagaaaaaggtctactatgctcattagaagatcaaaagcagattctccttacttgtaacataggagtttcaggattaatctgtattcaagctcattctatatccttcatcaaagaaaagacaatgttttgtgtctgttgtccctctcacacacagccctaatatataatgtgtaactgccttatctgcagccctaaactaatatagctagaggtcttctaatcattctcctacctctaggaaagaaatatagtcttgaaaactgccaatctggtgtgcatacaaaatatatacaaaataccaaggaacattatatgagccttttgctaggtatatctaagcaactgcttcagttaatggccactttacaaattgctgaaagaaggaaacgtctttcgattcttttttttttctttttttttttttgagacagagtctctgtctgttactcaggctgtagtgcagtggcacaatgatagctccctccagcctcaaactcctgggctcaagcattccttctgcatcagcctcctgactagctggaactcaggctcatgccaccagacctggctaatttttctgttttcagtagagaaaatattttctttcactaatttaactggtatggtttccattgtctacccagttttccatatgcataagaaaatatattcacaggaaaatataaagttttcagatttcatgagtggttttaagaaagttttagtcagtgaaaaaactatcataccagtcttcaaaggaagggtgaaataagttcatctgctacgttgcccaggctggtcttgaagggaaacagacttttttgtagtcatacttatcctttggcttcttagtaagtattatatagtcattactttttgcagttttttagatcaaagtgttaatgtaggtaaagttaattttagaatatatgtaaaagtcaagtctgctttaaatttaatcatctctttggtgaaagggatgggatggagctttgctttttatcatatattcatctgtacctttcaagtattcaaatagaaaaatataaacaatgtaaataaaatagcaaaacaatgtaatatctcataaaactgcaatggtaaaagcatttatcctattgaaattccacaatttttatttgaaaatattatcgacatgtaattcaagtggcatttagaagaataatttaaaagcaacaactctatagaaagcttgtaaaatgattaagtagtttaaaccaaataaaacaatttctgagtcagtcatctccagtaggtctattttagtctcaagataaattcatttctggtgacaactgaagttcttagttatttgttagtatatattggagacatttacaataaagcttagagcacaatgggaaatgaaagtatcatgttttttttaagaccaaatgtattgcagaaatgtgagtaatttaatccgatgctacaatctgatcattctgatctaatctgatcatttaataacactaaataaaaccttcatctcacattctttggctgtttcttttaaaatatgggtttacggataaatcaaataaattcaaaacaaagtaataagcaaatgatttttttttctcagtaatctagtagagtattacatttagaagtaatctgtatctcagtgcagtaactatttaggactgtaagcgccgctgttcacctactggaagacaaatgcaaccgaaaacactcagatctcacacctcacgaagacccgcagatgccacaaactaactgctggactgcagcgaaacccgacccctgtttggaggcactccaggtttccggaggattgtcatctccatagctgcggcaagaaactaaataagacccatttatgcacagtgaagattctgagaggattctgcagcaaaacaacaatggccgctccacagagtcgccccagacgcggcgagctgatcctgctgtgcgcgctgctgggaacgctgtgggaaatcgggaggggacagattcgctactctgtgccagaagagacggacaaaggctccttcgtgggtaatatctccaaggacctggggctggacccccggaagctggcgaagcacggagtccgtatcgtctccagaggtaggacgcagctctttgctctgaacccgcgcagcggcagcttgatcaccgcgggcaggatagatcgggaggagctctgcgctcagagcccgcggtgtctgataaatattaacaccctggttgaggataaaggaaaactctttggggtagaaatagaaataattgatattaacgataataacccaaaattccaggtcgaagatctagaagtaaaaattaacgaaatcgcggttcctggagcacgttatccactcccagaagctgttgacccggatgtgggcgtgaactccctccagagctaccagctcagccccaatcaccacttctccctggacgtgcagactggagacaatggagccataaacccagagctggtgctggagcgcgccctggacagggaggaagaggctgctcaccacctggtcctcacggcctcggatggcggcaagccgcctcgctctagcacagtgcgcatccacgtgacagtgttggatacaaatgacaatgccccggtttttcctcacccgatttaccgagtgaaagtccttgagaacatgcccccaggcacgcggctgcttactgtaacagccagcgacccggatgagggaatcaacggaaaagtggcatacaaattccggaaaattaatgaaaaacaaactccgttattccagcttaatgaaaatactggggaaatatcaatagcaaaaagtctagattatgaagaatgttcattttatgaaatggaaatacaagccgaagatgtgggggcacttctggggaggaccaaattgctcatttcggtggaagatgtaaatgacaatagaccagaagtgatcattacgtctttgtttagcccagtgttagaaaattctcttcccgggacagtaattgccttcttgagtgtgcatgaccaagactctggaaagaatggtcaagttgtctgttacacacgtgataatttaccttttaaattagaaaagtcaataggtaattattatagattagtgacaaggaaatatttggaccgagaaaatgtctctatctacaatatcacagtgatggcctcagatctaggaacaccacctctgtccactgaaactcaaatcgctctgcacgtggcagacattaacgacaaccctcctactttccctcatgcctcctactcagcgtatatcctagagaacaacctgagaggagcctccatcttttccttgactgcacacgaccccgacagccaggagaatgcccaggtcacttactctgtgaccgaggacacgctgcagggggcgcccctgtcctcgtatatctccatcaactctgacaccggtgtcctgtatgcgctgcaatctttcgactatgagcagatccgagacctgcagctactggtaacagccagcgacagcggggacccgcccctcagcagcaacatgtcactgagcctgttcgtgctggaccagaatgacaacgcgcccgagatcctgtaccccgccctccccacagacggttccactggcgtggagctggcgccccgctccgcagagcgtggctacctggtgaccaaggtggtggcggtggacagagactcgggccagaacgcctggctgtcctaccgcctgctcaaggccagcgagccgggactcttctcggtgggtctgcacacgggcgaggtgcgcacggcgcgagccctgctggacagagatgcgctcaagcagagcctcgtggtggccgtccaggaccatggccagccccctctctccgccactgtcacgctcaccgtagccgtggctgacagcatccccgaagtcctgaccgagttgggcagtctgaagccttcggtcgacccgaacgattcgagccttacactctatctcgtggtggcagtggctgccatctcctgtgtcttcctcgcctttgtcgctgtgcttctggggctcaggctgaggcgctggcacaagtcacgcctgctccaggattccggtggcagattggtaggcgtgcctgcctcacattttgtgggtgttgaggaggtacaggctttcctgcagacctattcccaggaagtctccctcaccgccgactcgcggaagagtcacctgatctttccccagcccaactacgcagacatgctcatcagtcaggagggctgtgagaaaaatgattctttgttaacatccgtagattttcatgaatataagaatgaagctgatcatggtcaggtgagtttagttctttgcttgcttttaatttccagatgaattttatttggcataaattatgttttgaaaaacattgtgaagatagttgaaaataatttttaaggtgtatcacagagttttgggtttattttggtggtgttactataaaattgaactctaatagtcataggttattgtttcatttgcttttaaacgacttggaaaagattgttcaaccattttaagccttccagtattttattcctattatcactcattcacttaagaagtagctacccgtccatactggtaattttgctattgtttgtttgtgtgtgtgtgtgtgtgtgtgtgtgtgtgtgtgtgtgtgtgtatcccaaactagaacttcagaaaattatcaagaagtctaaagccttgttattagcttagcaaaagtaaaatatatctcagaatttttagggttatgtttagcatttgaacctgtaactaggctcttgtagatttcttcactttaaacctcttttctgagccctgtttctgtaccagtgcccttcaaaactttaatacttcttaccatccttcaaaacatgaacaaactttaaagatggatcttggtgggagatgagactggttactaaatattaagtatgtgagtcagtggtcacctgggctccatgcccatggagacatgaaatctaaagcctagaatgtccattgctcccccaaacaaaaaacaaaagcaaaaacattagatctgaattaaaatgtaattttaaactgttgaaagtgacttttgtaaaatatgtaagaacatatttcaatacaattccaattagctgtttcggttgtgcattgatgtgaagtggtgagaatgttgatattaagaaccaatgtttcaggtacacaagttctaaataagctgatcaattcaattaaagttattcagtcttggctggacacagtgcctcatgtctgaaatcccagcactttgggaggctggggcaggaggaccgcttgagccccgggggtttgaaactgcagtgagctatgatcatgccactgcactccagcctaggtggcagaactagaccctgtctctaaaaaaactattattaggccgggtgcggtggctcacgcctgtaatcccagcactttgggagactgaggtgggtggatcacctgaggtcaggagttcaagatcagcctggcaaacatggtgaaaccccgtctctactaaaaactacaaaaattagccaggcatggtggcatgcgcctgtggtcccagctactcgggaggctgaggcagaagaatcacttgaacccgggaggtggaggttgcagtgagcctcgatcctgtcactgcactccagcctgggcaacagggtgagactccgtctcaaaaaaaaaaaaaactaatattaatagtaaaaactcggtataggctatccattattgtattcctgcataccttcttgtagcatttgaataaagctaatacctgaattgattgttgtaaggtagaagtagatgacccaataaatgtttgttattaatgaaaaggacatttcctaaggattgtgtagtgttctactgtatggtgcatattcagtggagtgggagttaacttcatagtttgtgtaccatttggatgcacatttgagaggacaacatattattggcactttgcaattttaaaaactcggatgaaagttgccctggtaggaaagaaaatccttactctccctaaaaatgttggctagttgtttttattaatctgacaaatggactaaagaaggttgaccaatgtccacaaatttatgtaaatgaacttatgagcttcatttatccaattccaaagtcatttcagataggataataatgcaatccactagaatatccctttgtaccttgtattgcagaatagataagcatttccccaataactcttaagaatgaatttatgtactgtaaaagatatgacataagagaagtattttgagatatgaagaagagcaacgtagtagggtatatcatttcttagctacatcatatgggcagtatacttgaatgaatatttcctgaagtagaagagtaaagaaaaattatttttataaagaatgttaatatagtcaggaagaggagatgtttggggattggtataaaattgccacaactttacaaaatagttttaaatagtatagatttccctaatatgtgtaatataaaacactagaaatattggggagttggaaatcatagaaatgaacagaagaatgataaaattgtttccatagctaataaaaaatgaatttttgaaatcagtatagtatgaaggctctgagagcaagaactgtatcatattaattattatattgccagtgacaagggcaatacttagttctagctaagagttcaaggtatgtttgcagaatggtgaaagaatggaccaatgtatgcaggtttgtataaaaacccaacgtgatatttctaacaatttggaaaacagagaaagataccttaaagaagttgttataattttttattaagtatatggacgtaaaaacttggcttgttaagttaggcacacaaaaacaattactgcactggttaacttgaagccgcagaggctgtagtttcctagtgctgactctgggcgccgctgttggccaaagtgcagagcttggcgctccagatctcctcgcgcagccgcagcgcgctttccagggcagccccagctcagactccccagcgccggcctttacaccgcttcctcctcggaaaaagaatcgtttcctaaactggaactggaactaaagcccgttcggagatccaaaaatctacaatacagaggttatttgtaacctggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaagggctccgtagtggggaacctcgccacggacctggggttcagcgtccaggagttaccgactcgaaaactgcgcgtcagttcggagaagccttacttcaccgtgagcgcagagagcggggagttgcttgtgagcagcaggctagacagggaggagatatgcgggaagaagccagcttgtgctctggaatttgaggctgttgctgaaaatccactgaacttttatcacgtgaatgtggagatcgaggacattaatgaccacacgccaaaattcacgcaaaattcctttgagctgcaaataagtgagtctgcacagcctggcacaagatttatactagaagtagcagaagatgcagatattggcttaaactctctgcagaagtataaactctctcttaacccaagtttctcattaataattaaggagaaacaggatggtagtaaatacccggaactggcactggagaaaaccttagaccgggaacaacagagttaccatcgtttagtcctgactgccttggacggtggacatccacccctaagcggcaccactgagctccggatccaggtaaccgacgccaatgataatcccccggtattcaaccgagacgtgtacagagtcagccttcgggaaaacgtgccaccaggcaccactgtgttgcaagtgtcagccactgaccaagacgagggcatcaactcagaaattacttattccttctacagaaccgggcaaatctttagtctgaattcaaagagcggagaaattaccactcaaaagaaactggattttgaagagaccaaggaatattcaatggttgtagaagggagggatggtggtggactggttgcacaatgtacagttgaaattaatattcaagatgaaaatgacaatagcccagaagttacattccattctctacttgaaatgattctggaaaacgcggtgcctggaacactaattgctttgatcaaaatacatgaccaagattctggggaaaatggggaggttaattgtcaattacaaggcgaagtcccttttaagattatctcttcatccaaaaattcgtataagttggtaacagatggaaccctagaccgagagcaaaccccggagtacaatgtcaccatcacagccacagacaggggcaagccgcccctctcctccagcataagcgtcatcctacatatcagagacgtcaacgataacgctccggttttccaccaggcgtcctacttagtcagtgtacccgaaaacaaccctcctggggcctccatcgcgcaagtctgcgcctcggacctggacttggggttgaacggccaagtctcctactctatcatggccagcgacctagagcctctggcactggcctcttacgtgtccatgagcgcgcaaagtggggtggtgttcgcgcagcgcgcctttgactacgagcagctgcgcaccttcgaactcacactacaggcccgcgaccagggctcgcctgcgctcagcgcaaacgtgagcctgcgcgtgttggtgggcgaccgaaacgacaacgcaccgcgggtgctgtaccccgcgctgggtcccgacggctctgcgctcttcgatatggtgccgcgcgctgcagagcccggctacctggtgaccaaggtagtggccgtggacgcagactcaggacacaacgcctggctgtcctaccacgtgctgcaggctagcgagcccgggctcttcagcctggggctgcgcacaggagaggtgcgcacagcgcgtgccttgggcgacagggacgcggcccgccagcgcctgctggttgctgtgcgtgatggtggacagccgccactctccgccaccgccacgctgcacttggtctttgctgacagcttgcaggaggtgctgccggatatcactgaccgccctgtaccctctgacccccaggctgagctgcagttttacctagtggtggccttggccttgatctcagtgctcttcctcctggccgtgattctggccgttgccttgcgcctgcgacgctcctccagccctgccgcctggagctgcttccaacctggtctctgtgtcaagtctggacctgtggttccccccaactacagtcaggggactttgccttattcctacaacctatgtgttgcacatacaggaaagacggagtttaatttcctaaaatgtagtgagcaattgagttcaggacaagacatactttgtggtgattcatctggggccttatttccactttgtaattccagcgagtcgacttcccatcctgagttggtgagtttcatttatgtctattctttttcattacccacccaattttctgtatttacatgaaactatcgtacattttcaagtccaatgagttgtcttagggaagtcagagctgctcagaaagctgtcctaccattctttaagaggagcagtaaattgtgagtttttatgtcgcataaaagaagtagccttatagatttacaaagtagtgagagtttgctcttagcttcctctctagcaaaaacatttggtgcgtttttttgtcctctttctcaaagctaatgaattttacctattcgttgtctcattctttaacatgtttatattttattgtatgtagataaaccattaaatttaatgtatgtaatcatttaattcatcttttaaagcaaagaaactgctagtagatgtctttcttcactgatttcactggtagttttcatctctttcttatgttcctcatatatgctttcttattcctacctaatggatttatgattttttgaatctcctaaaattttattaaaaatactatatgttggctgggtgcagtggctcatgcctgtaatcccagcactttgggaggccgaggcggttggatcacatggtcaggagttcaagaccagcctgggcaatatggtgaaaacccgtctctactaaaaatacaaaaattagctgggtgtggtggcgggcgcctgtaatcccagctactcaggaggctaagacaggagaattgcttgaacctggcaggtggaggttgcggtgagccgagatcactccattgcattccagcctgggcaacaagagcaaaactccatctcaaaaaaaaggaaggagaaggagaggaagaagaagaaaaatactacatgttatgtgtatgagagagaaagagagagactgattcactgaacttagaaggtccaaatcatccaaataattttctaagtttatccaggttttcttggatgcaaaatccttttccacctctatataattaccagaagaaacttacaaaaaaaaggaaatgctattgcctgaatttctcttgctcggaatcctgacatattcttgaagaaggggaaaaagacaccggatttgtcttatcgtttggagctttaaatataaatgactggatgttttctcaacatccttgtaggatggaaggtgaatacaggattattccatttttaagacaaaaactactagtcttgtgtacatacaaagctcccattacatggtataagtcttttgcttggtttcccttagtatgtgattcagtaaatgggttccttacaaagtgctgagatttcttataataccacttacttttaacctttcagtagttttctttgttgtatattttgtgttctttttcccaaattattatataagtttaagtgatgcttagaataatgtttaagaccactttaaaattgcataatttattgatgaaggattaaaatagaaacttgcttttcagtgtatatgcatttgaatcattgaaacacagtctgtgcatgcattacatattcacattaaaaaactaagcatttttgaaatagcagaaaagtttaagcaattacaaaaatgtgaaaatttccaactttaatcctgttaatatttagcaatattaggcgagaacatctgtaactattgctgaattaatattacttttataatacaaaaatttaaaataaacgtttttccaggaattttatcatcaaaataaaccccagaaaataatttcaaagtggataatctatccttatatatgtattaatacaattatatattttacatttacaaatatataggtataaaaattaaaaatgaatgtacttccaaacaagattgcacataaaaattacttcagaaaattgttaagatacacagaaaaaattgaagcatcataaaaaggaaattataatagtttacatatctagaaatagagtgcaaagttctaccaagaataagaataaattaatattaagcaatggtttgtgattttataatacacttacagaaattttattccactttatttacaactcagatatctaaaaaatagattgcttttgaaatacaaatgcaagaaacaattggagaaatctaaaatcataattagaagagagtagtgttttctttatcagccatctgatataatgttacacatcagtgggtgtagtaacggcttaggactctgagcgccgctgttgatcaactctaagcgaaaatcaggactccatccggatttccagttctgcggctacacaaaacccggcagataccacaaacctgctcccaggctgcagcaaaactcagcctctttcttctaaggaaaagatcaccatactttgcagggtggaagaaagaacctgatgaagcagcgcgcacagagatccttttgagaaaattccaaagcgaggcagcaatggcagctccaaccaaatgccagctccgcggaagattagtcctgctatgctcgctcctggggatgctatgggaggccagggccagtcagattcgctactcagtgcctgaagagacagaaaagggctatattgtgggcaacatctccaaggacctggctctggagccccgggagctggcggagcgccgagtccgcatcgtctctagaggtaggacgcagcttttctctctgaacccgcgcagcggcaccttggtcaccgcgggtaggatagaccgggaggagctctgtgctcagagcccgcggtgtctggtgaactttaaagtcctggttgaagacagagtgaaactgtacggaatagaaatagaagtaactgatattaacgacagcgccccaaagttccaggccgaaagtctggaagtaaaaattaacgaaatcgcggttcctggagcacgttatccacttccagaagctattgatccggatgttggcgtgaactccctccagagctaccagctcagccccaatcaccacttctccctgaacgtgcagactggagacaatggagccataaacccagagctggtgctggagcgcgccctggacagggaggaggcaactgcccaccacctggtcctcacggcctcggatggcggcgagccgcgtcgctccagcacagtgcgcatccatgtgacagtgttggatacaaatgataatgccccggtttttgctcaacggatttaccgagttaaagtccttgagaacgtgcccccaggcacctggctgcttactgcaacagccagcgacctggatgagggaatcaacggaaaagtggcatacaaattctggaaaattaatgaaaaacaatctctgctattccagcttaatgaaaatactggggaaatatcaacagcaaaaagtctagattatgaagaatgttcattttatgaaatggaaatacaagctgaagatggtgggggattgaaagggtggacaaaagtgctcatttcggtggaagatgtaaatgacaatagacctgaagtgaccattacatctctgtttagcccagtgagagaagacgcacctcagggaacagtaattcttcttttcaatgctcatgaccgagactccgggaagaatggtcaagttgtctgttctatccaggagaatctatcttttacattagaaaattcagaagaagattattacagattgttgacggcccaaattcttgaccgagaaaaagcctcagaatataatatcacggtgactgcaacagacagaggaactccgcccctgtccacagaaattcacatcaccctgcaagtgactgacatcaatgataatccacctgctttctctcaagcctcctactcagtctacctcccggaaaacaacgccagaggtacttccatcttctccgtgattgcctatgaccctgatagcaatgagaattctagagttatttactccttggcagaggataccatccaagggtctcctctctccacctatgtctctattaactcagacactggtgtgctgtatgctctgtgctcctttgactatgagcagtttagagatttgcaaatgcaggtgacggcaagtgacagtggaagcccaccacttagcagcaatgtgtcattgagactgtttgttttggaccagaatgacaatgccccagaaatcctgtaccctgccctccccactgatggttctactggtgtggagctggcaccccgctctgcagagcctggctacctggtgaccaaggtggtggcagtggacagagactcaggccagaatgcttggctctcctaccgcctattcaaggccagtgagccagggctcttctcggtggggctgcacacaggtgaagtgcgcacagctcgggccctgctagatagagatgcgctcaaacagagccttgtggtggctgtacaggaccatggccagccccctctctcggccactgtcacgctcacagtagccatagctgacagcatcccagacatcctggctgacctgggcagtcttcagatccctgcagacctggaggcctcagaccttaccctctacctcgttgtggctgtggcagtcgtctcctgtgtcttcctcaccttcgttatcacgctgctggccctcaggctgaggcactggcactcctcgcatctgctgcgggctaccagtgatgggttggctggtgtgcccacctcacactttgtgggtgtagatggggttcgagctttcctacagacctattctcaggagttctccctcaccgctgactcaaggaagagtcacctgatcttcccccagcccaactatgcagacacactcatcagccagcagagctgtgagaaaaatgagcctttgtgcgtctctgttgattccaagtttcctatagaagacacccctttggttccggtgagttcattttttttctttctttcttttctttttttgttttttgttttgttttgtttttgagacagagtcttactctgttacccaggctggaatgcagtggtgtgatctcggctcattgcaacctccgcctcccaaattcaagcgattctcctgcctcagcctcccaagtagagtagctgggactagagtagagtagctgggactacaggcctcccaagtagaataactgggactacaggcacgtgccaccacgcccggctaattttttgtgtgtttttagtagagacggggtgtcaccatgttggccaggctggtcttgaattcctaacctcaagtgatccacccacctcagcctcccaaagcactgggattacaggcgtgagccactgcgcctggcccttaactttctattatagttagctttctctttaactgtctgtacttaaggtagtataagttgatatcagtgtgtttctcatcacttttcactgggcctaattgttgctccaacactgaaaggaggcatttattagttatatttgctgatataactttcatgttctcataataattaacctgctgtcaacgtaaaccatacttcatggggtagctctcagcctgcattgatgtgggctttttgggtagggttgcttcattggttgcagtggactcatatcataaaattcttactcctttttttttttttttaagagatgggggtgtcattctgttgtccagggtggaatgcagtggtgtgggtaaagcttactgcagtctcaatctcctgggcttatgcaatcctcccacctcagccttcacagtagctaggactgaggtgggagggctagcaagctatgttgcccagactggtctcaaacgatcttcctgcttcagtttcccaaagcactgggtgaggtgtgaaccacctcacccagcaaattcttactcctacgatcatttattcaggtcatactatgtttgtaagggtaaactgataaaaaggtaaatgtattcttcttagagaaacagctgaaagcccagatttattgcttctattcttccatttctatgacaggaaaacacctctttgaggttatatttttcagatcacaagtgtgtaaagtctgtttgtgtttacagatattttctgacgaagattcaaacttcagttatccacttccaaaccctagtaaaccaattttttccctttaatggtgaaagttgtcacatcttttattctcatatcttcaaaggtcttaatttcctaatgctttaatgttaaattatggagaatagtaggacattcttcttttctatagtatatgcttgctcaagagaagtttctaagactggacactgtgaaatgacaaaacaaggaattaaaaatatttctctcacttatatattatttctggctcaattctccaacttttgagtctagaaatgaacttgcatatcagatataatttaagaaaatattctcaggaactgctgggaagattctaaaactattttactgtttttagctataaggaagagaataatgtattatttaatgttattttaaacatagtgttgtttcaaatagtaaataacatttcacaagacatttgaaaataagctttgaagttgactcaaaattctatgctaaacatgtgatccatagatacactgatgactgctggcatttctgtggaaatgaagaattgttttatttgtttgtaattatttgggtttcagttgctttatttttaagaaaaaaaagctgaagtgtctgggaatcctttatgacatacagacattttaattatttcaaacacgttttcccccttaagtgggtagcaaaaaaaataaagcatacttcaggctcatatttttaaccatgcaacaagaaaattgttacaatttctgttctgaggagtagccttcatacttagtatttataaatattgaaatgtatgttaatttggggaaaacataacagatatccatgaaggcttgtatgtcatggtaggtagttactattcgataccacaaaaatgtctcttgcccttaaaaccagaacacgaggctcaccagacagatgactgaatggagtatggaaaatctttatttctgtttttcttaggctatgtaggacttaacttattgtgcattggtaacagattgtagaacataagctgaaagataaaattcttgaccttaatgtctcatcttaaaaagaagcattggttgacattctatatctcgtattacttaaaaataatgggggagcgcagtatatattaaacaaagattggctttgtggtgatcattgttgaaggtggggtgatggctatgtgaaggttcactatatatactccctactgttgtataagtttgaaattgtgcataatagatttatttaaaacacaaagcatagaaatatctactataatattatggtgagagcaaaatttgagggggatgtacacctgcattttcgaagaatatatacatttcggagaccgaattcaaaatgaaaaaccgggctgctgtcccgcacggagcctctgggcgccgctgtcggccagtgcagagcaagcgctgacgccggggatccgtcagcctctggcctgggattccctgcgcagccaacaacagaaagaagaaaaccagctcccacacagagcctcccggctgcgcagacctttcccagcacagcggattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtgctatttcctttgctgctgcctttgttctaccccaccctgagtgagccgatccgctactcgattccggaggagctggccaagggctcggtggtggggaacctcgctaaggatctagggctcagtgtcctggatgtgtcggctcgcaagctgcgagtgagcgcggagaagctgcacttcagcgtagacgcggagagcggggacttacttgtgaagaaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaatttgataaaaaggaaatacatttagaaattttcgaatctgcatccgctggtacacgactatcgcttgaccctgccacggatcctgatataaacataaactcaattaaagattataagataaactctaatccttatttttcattaatggttagagttaattccgatggtggcaaatacccagagttatctctggagaaactcctagaccgggaagaacagagatctcatagcttgatattgactgccttggacggaggggacccaccaagaagtgccaccgctcacatagaaatttctgtcaaggataccaatgataaccccccggttttcagcagagacgaatatagaattagtcttagtgaaaatctgccccctgggtcccctgtgttgcaagtgacagccactgaccaggatgagggggtcaatgctgagataaactactacttccgaagcactgcccagagcacaaaacatatgttctcattggatgagaaaacaggtatgattaagaataaccagtcatttgattttgaagatgtagaaaggtacaccatggaagtggaagcgaaggacggaggtggtctctctacccagtgtaaagtaatcatagaaatccttgatgaaaacgacaacagcccagaaataatcatcacttctctctctgatcagattttggagaattcacctccaggaatggttgttgccctcttcaaaacacgggatctggatttcggaggaaatggagaagtcaggtgtaatatagaaacagacattccattcaagatttattcttcttccaataactactacaaactggtgacagatggagccctggaccgagagcagacaccagaatacaatgtcaccatcgtagccactgacaggggcaagccgcctctttcttccagtagaagcatcaccttgtatgtcgctgacatcaacgacaacgccccagttttcgaccagacgtcctacgtggtccacgtggccgagaacaacccgccaggagcctccattgcgcaagtgagcgcctctgacccggatttggggctcaatggccacatctcctactctatagtggcgagtgacctagagcccctggcggtgtcgtcatacgtgtcagtgagcgcgcagagcggggtggtgttcgcgcagcgcgcctttgatcacgagcagctgcgcgccttcgcgctcacgctgcaggcccgcgaccacggctcgcccacgctcagcgccaacgtgagcctgcgcgtgttggtgggagaccgcaatgacaacgcaccgcgggtgctgtacccagctctgggtcctgacggctccgcgttcttcgatatggtacctcgctctgcagagcccggctacctagtgactaaggtggtagcggtggacgccgactcgggacacaacgcctggctgtcctaccacgtgctgcaggccagtgagcccggactcttcagcctggggctgcgcactggggaggtgcgcacggctcgagccttaggcgacagggacgcagcccgccagcgcctgctggtcgctgtgcgtgacggtggacagccgccactctctgccaccgccacgcttcatctggtcttcgcagacaacttgcaagagatactgccagacctcagcgaccgccctgtactctctgacccccaggctgaactgcagttttacctggtggtggccttggccttaatctcagtgctcttcctcctcgccgtgattctggccattgccttgcgcctgcgacgctctctcagccctgctacttgggactgcttccatcctggtctctgtgtcaagtctggacctgtagttccccccaactacagtgaggggactttgccttattcttataatctgtgcattgcacatacgggtacaaaagagtttaatttcctaaaatgcagtgtgcccctacattccaatgaagacatggtttgcagtgtttctcctggagccttaattccacctcatggtggggaggatttgacttcacatcctgagactctgacttcggtgagtttctcttttttgtgtgtgatttatctaatagtctactagtttctcatattttaggcatactactttattttcatatctagaatcatatgtttaaaatccatagctttttacaatattttctcaatgttttttcaattatagttttcactatgtatttggttcataagttgctctatctttttgtaaaataatgtcaccagactgaagatattttgtctttgtcttttttttttttttttttttttgagatggagtctcgcactgttgcctaggctggagtgcagtggcgtgatctctgctcactgcaacctccgccttctgggttcaagcgattctcctgcctcagcctcccaagtagctgggattactggtgcccctcaccacagctaaattttttgtatttttagtagacatggggtttcactatgtcgaccaggctgttcagaaactcctgtcctcgtgatcctcccaccttggcctctcaaagtgctgggattacaggcgtgagccacaatattttgtcaagttctgactatcgaacagaagcagtggtcttggcatctaagaaaacaaacaagtaacctatctattcaaatttgcgaagacttagtgaatttacgatatcttatttatatatttttaaagcctaaaaatattcagaagacaggcccagtggctcacacctataatcacagcactttgataggctgaatcggaaagtatcacttgagcccaagaattgagaccagcctgggcaatatagggagaccccccatctctactaaaacaacaacaacaaaaaaaaacattagcagagtgtggtagcattcccctgtggtcccagctacttgggaggctgagctgggtggattgcttggtcctgggaggtcaaggttgcagtgagccctgatcttgccactgcactccagcctgggcgacagagtgcgaccctgtctctaaaataaataaataaatatgcaggcagggccaagtgtgctgtaatcccagcactttgggaggtggaggtggagaatctcttgagcgcaggaatttgagaccagcctgggcaacacagggagactccatcgctacagaacatttaaaaattagcagggtgtggtggcacatgcctgtggtctcagctactctggtggctgtggtgggagaatcgcttgagcccaggaagtctaggctgcagtgagctgtctaggtgacagagtgagaccctgtctcaaaaaaaaaagacatttctaagaaataaatgaaatactattgcctttgcactcagtctctgtctctgattctctgatagaagatttttgaagaaaaaagataaaatctttgaagagttctatacttggaaggcatagtgacataaacacttctgaacatcctgttctctgtgtgaaagaagtgaacttctataccctttgcatttgagggaacaattgctactgggttgatgggcacacacagttgaagatatgtgaaccactggactttggcctctgatacaaactgcctaagagaagagattatttatactggtattaatgctctgatgaaaacaggtcatttgacataaacacttacttgttaaaaacctatatcactacatctaactttgttttctaaaacttttagtacttcaaattctacgtatttcttttctcattacaatgcaaacagtttaatttgcaactgtaatatatgttcattttagtttgtgattacctgcttaatcatttaaataggtccatttaacttgtatccctgtaagataaagtatgttttacacaaaaaggttaattaaggctcagtaaaactattctagaagagtactttaaaaacctcttacacaatcctaagctaaataagtttaatgaattaagtagttacaattataaagcttcagagtgaattatctcatgagtttatttaatataatctttgtatgaatgtatactaaataaaattggcctattcaaatcacaattttaaattataagacttttctgaatttacctagacactaatatgacctaaaataagtattatttaccttttattaaagtgtgtacatttctgttgggaaaacgtgttgcaaatatatatttaaccaaacattatcttgaaatatttacaatattttcactccactttatcacacctcccctaagaaacctacatatagtaaattatttaaagataggagtggagaaaccaaagaatctatgtaaaatataataatccaacagaatagtttactttccattgcatgtatcacttgggtgcagtaacttcttaggactctgagcgccgctgttcacctactaggagagaaaacgcagccagagctcaatccggattctcagggcttcaactacacaagccccacaaaccggctgctgggctgcagggaagctcactccagaatttaaagtgcccaggctacagagacaccctgaagccacagaaagacaaaggaaccggttgaaacacacaacgtgtccagtgaggactttgcagaattctgtaaccagactacaatggccgctcaaaggaatcgctcaaaggaatcaaaggattgcagcgggctggtcctgctctgccttttcttcgggattccatgggaggctggagcccggcagatctcctactcaattcctgaggaattagagaaaggctctttcgtgggcaacatctccaaggacttgggtctggcgccccgggagctggcggagcgcggagtccgcatagtctccagaggtaggacgcagcttttctctctgaacccgcgcagcggcagcttgatcaccgcgggcaggatagaccgggaggagctctgcgctcagagcgcgcggtgcgtggtgagttttaatatccttgtggaagacagggtgaaactttttgggatagaaatagaagtaactgatatcaatgacaatgctccaaaattccaagcagaaaatctagacgtaaaaattaatgaaaatgtcgctgcgggaatgcgttttcctctcccggaagctattgatccggatgtgggcgtgaactccctgcagagctatcagctcagccccaataagcacttctccctaagagttcagagccgtgccaatggcgtcaagtacccggagctggtactggagcactccctagatcgcgaggaagaggccattcaccacctggtcctcaccgcctccgacgggggtgaccctctccgatctggcactgtccttgtcagtgtgactgtcttcgatgcaaatgacaacgcgccggtcttcaccttgccagaataccgagtgagtgttcctgagaatttgcctgtgggcactcagctgctgacagtcacagccaccgacagggacgaaggtgccaatggagaagtgacatattcattccgaaaattacctgacacgcaattgttgaagttccaactaaacaaatatactggagaaataaaaatatcagaaaatctagattatgaagaaaccggtttctatgaaatagaaatacaagcagaagatggaggagcatatcttgcaactgcaaaagtgttgattacagtagaagatgtaaatgacaacagtccagagctgaccatcacgtctctatttagtccagtgactgaagattcacctctgggaacagtcgtagcccttttaaatgtgcatgatttagactctgagcagaatggacaggtaacctgttccattttggcgtatctaccatttaaattagaaaagtccattgacagttattacagattggtgatacacagagcccttgacagggaacaggtatcctcttacaatatcacagtgacagccacagatgggggaagtcctcctctatcaacggaagctcactttatgctacaagtggcagatatcaatgacaacccacctaccttctctcaagtctcctactttacctatatcccagagaacaacgccaggggtgcctccatcttctcagtgacagcgctggacccggacagcaaagagaatgcccagattatttactccctggctgaagacaccatccagggggtacctctgtcctcatacatatccatcaactcagacactggcgtcctgtatgcactcagatccttcgactatgagcagtttcatgagctacagatgcaggtgacagccagcgacagcggggatcctccactcagcagcaacgtgtcgttgagcctgtttgtgctggaccagaacgacaatgcgcccgagatcctgtaccccgccctccccacagacggttccacaggcgtggagctggcgccccgctccgcagagcccggctacctggtgaccaaggtggtggcggtggacagagactccggccagaacgcctggctgtcctaccgtctgctcaaggccagcgagccgggactcttcgcggtgggggagcacacgggcgaggtgcgcacggcgcgagccctgctggacagagacgcgctcaagcaaagcctcgtagtggccgtccaggaccacggccagccccctctctccgccactgtcacgctcaccgtggccgtggccgacagcatcccccaagtcctggcggacctcggcagcttcgagtctccagctaactctgaaacctcagacctcactctgtacctggtggtagcggtggccgcggtctcctgcgtcttcctggccttcgtcatcgtgctgctggcgcacaggctgcggcgctggcacaagtcacgcctgctgcaggcttcaggaggcggcttgacaggtgtgtccggctcgcactttgtgggcgtggacggggttcgggctttcctgcagacctattcccacgaggtctctctcaccgcggactcgcgaaagagtcacctgatcttcccccagcccaattatgcggacacgctcatcagccaggagagctgtgagaaaaacgatcctttgtctttgttagatgattcgaagtttcctatagaggataccccattggttccagtgagttttattttcatttttacttttgttaaaaaaaaaaagattggtttttactttgaagtttgcggcatgatggtggaaagtgtaaatgctaaaacactgatgagtagaatttgatgtttattaaggttttttttttttttttttttttttttttttttactttctggtaaaattcacctagtctcaatcaaggcctatatatcataaggctttgttatgattagctttgcagaaccttgtagtttatagtgttgttgagtacaatattgacaattcctaagacagacttccatacagaagtgcctgtcaatttatatttcctcctgggtggtcacatattgaaactccagccccttaagcaaccctcttgttctgaaggcaggtctggtaagaataggtaagtatcagaaagaaatcacctctggaaacacaacccaaatccaagaatactcaatgcagttcttcccaaggagaagggcaataggcctttttcaaactacattttatatatttttcaatctatactttgtggtgatagttgcagttgaatatactaagtttttcattaatattgaattaacaatttatttataacaatgtatgcttagatttttccagccctatttataactgataacactgcagtatcctttttgcatacaattctctaatttcacactgctatgtggaagatatagcattttaatttaactttcattgctcaatagggatcctgaggaggctatagagggtgaaattaagaatatttgggattctgcttttgtcttttttgttaaattttctagtgactaaggctgaaagtaaatatgggttgggaagacagataaatttgtacatgttcccgagaacaggagcaagagatatatgacaaagctatttcagtggctctttaatgtataaggaggcaaacacctgaaactctgaaaactctgaaattgagaggcaaaataaacttagagtcaagaaagaaatgccatttctgcagatcagaatataaacaccaaccacagctgtaaaaaagaaaagaatatatgcaacgaagggaaattatataaacaaaggatcattggaggtactgatgagttcatttagttcaatgaaaatagtgacgtattaggtagatctcttaattttattactagtattctactaaatgtggtagtataaagtcaaaaagcattccgaagtttctcaagacccttataattccatgatttttttcaggtcagtcaacatttgttgaatgataggtctgtggaaggaaagcacactctttagggtcatagttattaactattaaaccattgaaactattattttatatttgtgttaatgagagtcaaaattattgtgcattcatctcaaataattctattattttgaaaaatacaggttttttttttaaaaaaaactgctcttgacattgtagctattgtgagaaaatattttgattataattatttaaaagcaatacaggacaccctggatgatggtaatgactagggcaatggttgcattccagtacttaagtatgaaataaggaattattactttctgggtgaatataggctagaattgaagacaaaaaaatttgttgcttatcttcagtacttccagcttcatagataattactcttaaaaggaacaagaatgactgcctctggatggaggaattggatagcaatgggccgtgggataggagacctataaaccttcatgctatattattttgtgcctttttaaattttgaagaaaaaatattcatttattcaagatatatgtaaattcagtaaataaaaagatatgatagttatgaccaagtggaaatatatttcctgatgtaaaaggaatcactgaggaaaaagattaaaatattttggctgtcaactcgtagtttaaaaaaaattccttgaaagaggtagagaaaagtcaagttgcagtcccacacagagcctctgggcgccgccgtcggccagtgcagagcaagcgctgacgccggggatccctcagcctctagcctgggattccctgcgcagccaacaacagaaaagaaaaccagctcccacacagaggctcccggctgcgcagaccttgcccagcacaccagattgccagctccgagacccgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtactatttcctttgctgctgcctttgttctaccccacgctgtgtgagccgatccgctactcgattccggaggagctggccaagggctcggtggtggggaacctcgctaaggatctagggcttagtgtcctggatgtgtcggctcgcgagctgcgagtgagcgcggagaagctgcacttcagcgtagacgcgcagagcggggacttacttgtgaaggaccgaatagaccgtgagcaaatatgcaaagagagaagaagatgtgagttgcaattggaagctgtggtggaaaatcctttaaatatttttcatgtcattgtggtgattgaggatgttaatgaccacgcccctcaattccggaaagatgaaataaacttagaaatcagtgaatccgtcagcctggggatgggaacaattcttgagtctgcagaagatcctgatattagtatgaattcgctgagcaaataccaactaagtcctaacgagtatttctcattggtggagaaagacaatcctgatggtggcaaatatccagaattagtattgcagaagactctggaccgagaaacgcagagcgctcaccacttggtactgaccgccttagatggtggggaccctccccgaagcggtactgctcagataagaatcctggtaatagatgccaatgacaaccccccagtgttcagccaggacgtgtacagggttagccttcgggaagacgtgcctccaggcacctccatcctgagagtgaaggccactgaccaggacgagggcatcaactcagagatcacttattccttctttggtgtggctgacaaagctcagcacgtgttctctctggattacactacaggaaacattctaactcagcagcctttggattttgaagaagtagaaagatatacgataaacatagaagcaaaagaccgaggatctctctcaacacggtgtaaagtaattgtagaagttgtagacgaaaacgacaacagcccagaaataatcatcacgtcactctctgatcagattatggaggattcccctccaggagtggttgttgccctcttcaaaacacgggaccaagactcaggggaaaatggggaagtcaggtgtagcttaagtagaggtgttccatttaagattcattcttcttctaataattactacaagctagtaacagatgaggccctggatcgggagcagaccccagagtacaacgtcaccatcgcagccacagacaggggcaagcctccgttatcctccagcaaaaccataaccctgcacattactgacgtcaatgacaacgcgccggttttcggacagtcagcctacctggtccacgtgccagaaaacaaccagccgggtgcctccatagcgcaagtcagtgcctctgacccagacttcgggctcaacggccgtgtctcctactctctcattgccagcgacctggagtcacgaacgctgtcgtcctacgtgtccgtgagcgcgcagagcggggtggtgttcgcgcagcgcgccttcgaccacgagcagctgcgcaccttcgagctcacgctgcaggcccgcgaccagggctcgcccgcgctcagcgccaatgtgagcctgcgcgtgttggtgggcgaccgtaacgacaacgcaccgcgggtgctgtaccctgcgctgggtcccgacggctccgcgctcttcgacacagtgccgcgggccgcgcagccaggctacctggtgaccaaggtggtggccgtggacgcggactcggggcacaatgcctggctgtcctaccacgtggtgcaggccagtgagcccgggctcttcagcctggggctgcgaacaggcgaggtgcgcatggtgcgtgctttgggtgacaaggactcggtccgccagcgcctgctagtcgctgtaagagatggaggacagccacccctttcagccactgccacgctgcacctggtgttcgcagatagcttgcaagaggtactgccggatttcagcgaccatcccacaccctctgactcccaggctgagatgcagttttacctggtggtggccttggccttgatttctgtgctctttctcctcgcggtgattctagctattgctctacgcctgcgacagtctttcagccctactgcaggagactgctttgagtcagttctctgctccaagtccggacctgtgggtccccccaactacagtgagggaacgttgccctatgcctataatttttgtgtgcctggggatcaaatgaatccagaatttaattttttcacatctgttgatcattgtccagccacacaagataacctcaacaaagatagcatgctactggctagcattttaactcccagcgttgaagcagataagaagattcttaaacaggtaagtatttaaaaatgtatttaatcctttttatattacaatatgccaatatattccaatatagtggtattattttaagattctagataacttcttcatagagttcgcaaaatataggtcaaatttatggttatcattattaaaacaaaagtttaaattaaatgcctcagtcttcctactattcaaagacattttaaagcaaactacatgggtaatctccggtgacatttttatgaagtaaaatacctttcggttaaaaatataaaatacaggtatatttttacggcatggtattttaattgaaaccctgatgctactcaatttttctcaagtatttcatcttcatttactcaataaaggaaccttgtaagaattatagttaggcatcctacctgatgattttatcgggaccgtattatttccacttccagaaatgtcgttcctttcagtcggttaaaatcaattggaaccaactacaacctacaagttttcagctccagtaatattttgaaaactttttaaaaattaagcaagcccttttaataattactcctttcgcaggtgttcttggtaaagttttaacgtcacataatgtaagtattgtgtatcatcgtttttaagctctacaaatacgtgtgattcacaaaggtgagcgtaatcatttcttctggaatttcttagtcgttgcaataataagaatgggctctaggcgccgctgctcaccaatcagggaatgggaagctgcgcgccattgagtccctccctcccccgcctctaccacacaaagcggaatgagatggatactcacagatcctgacactggagacttagaagtattttccttcgctttctgatatattttggatgtagtcggcctaggacttcatagatacataagccgattcacaaccaaccagctcgagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccccgggagctggcgaagcgcggagtccgcatcgtctccagagggaagacacagcttttcgctgtgaatccgcgaagcggcagcttgatcacggcaggcaggatagaccgggaggagctctgtgagacggtgtcctcctgttttttaaatatggaacttctcgtggaagacaccttgaagatttacggagtggaggtggaaataatagatattaatgataacgcccccagcttccaggaggacgaagtggagataaaagtcagtgagcacgcaattcctggggcgcgatttgctcttcctaatgctagggatccagatgtgggcgtgaactccctccagagctaccagctcagccctaataattacttttccttgcaactgcggggcagaacggatggggccaagaatccagagctagtactggagggaagcctggaccgagagaaagaggctgctcacctgctcctcctcacagctttagatggaggcgatcccatccgaaagggcgcagttcccattcgtgtggtggtcctcgatgtaaatgatcacatcccaatgtttacacagtccgtatatcgcgtgagtgttccagaaaacatcagctccggaactcgggtgctgatggttaatgcaacggatccagacgagggaatcaacggggaagtaatgtattcatttcggaacatggaaagcaaggcttctgaaatattccaattggattcacaaactggagaagttcaagtacgggggtctctggattttgaaaaatatagattctatgagatggaaattcaaggccaagatggtggaggtctctttaccaccacgacgatgttgatcactgttgtggatgtgaatgataacgctccagaaataactatcacctcttctattaattcaattctggaaaactctcctccaggtacagtgattgctcttctaaatgtgcaagatcaagattctggagaaaatggtcaagtctcctgttttattcctaaccacctgccttttaaattagaaaagacttatggaaattattacaaattgataacaagcagagtgctggacagggagttggtccagagctacaatataacgttgacagccacagaccagggaagcccgcctttgtctgcagaaactcatgtctggctgaatgtggcagatgacaacgataaccctcccgtttttcctcactcctcttactctgcctacattcccgaaaacaaccccaggggtgcctccatcttctcagtgaccgccctcgacccggacagcaaacagaatgccctggtcacttactctctgacggatgacactgtccagggggtgcctctgtcctcctatgtctctattaactccaacactggtgttctctatgccctacaatccttcgactatgagcagtttcgagacttagaactgagagtgatagcacgtgacagcggggacccgcccctcagcagcaacgtgtcgctgagcctgttcgtgctggaccagaacgacaatgcgcccgagatcctgtaccctgccctccccacagacggctccactggcgtggagctggcgccccgctctgcggaacctggctacctggtgaccaaggtggttgcggtggacaaagattcaggccagaacgcctggctgtcctatcgcctgcttaaggccagcgagccgggactcttcgcggtgggggagcacacgggcgaggtgcgtacagcgcgggcactgctggacagagacgcgctcaagcagagcctcgtggtggccgtccaggaccacggccagccccctctctcggccaccgtcacgctcaccgtggctgtggccgacagcatccccgaagtcctggcggacctcggcagcctcgagtctctggctaactctgaaacctcagacctctcgctgtacttggtggtggcggtggccgcagtctcctgcatcttcctggtctttgtcatcgtgctgctggcactcaggctgtggcgctggcataagtcacgcctgctgcaggcttctgaaggcgggttggcaggtatgcccacgtcacattttgtaggcgtggacggggtacaggctttcctgcaaacctattcccacgaggtctctctcattgcggactcgcagaagagtcacctgattttcccccagcccaactatggggacacgctcatcagccaggagagctgtgagaaaagcgagccactcttgatagctgaagactcagctatcattttaggcaaatgtgacccgacaagtaatcaggtgagatttatttctctgcctcctaattgttggtgtcttggcacaagtcttttaaggagatgttttttgagcctgttatgaaaactgtttggggggggggtggggcggcatatatttagttcatatatatttagagcaatacatgtgagttttactttgcctttcatgagattacgataatctttcagaacgtttttgtgaaagtcatttttcaatcttggcatattttcttttgatttcaaaggggccattcaactatgctggtttggtttgaagtaagttgaattttagtattatttttctattatcagtgtatgaggctctcaatttattatatatagatacaaattaatgattcacaaacactttttatttccatttcaattttgctgtgccttcactgatttgtagttatattccaccattatttgctattactgctaatgttcaaattttgatcctgttgatttaatagcatgctccctctagctctccttctcatctatctatctatacacatgcacacacacttatacacgtaagcttttctctgagcaattttattttgattcttggtggctggtaatatgcttagatcctgttgactatttcaactttgtctcatttcttcatcctatcaacacagacatattgactggcttttaactactggatttccttgggagataaaatttagatcacattttttcttaagctctagatgtcttttccattactatggtgaagttacattgactgttctgaggaaataattgaattattgaactggtattatttccttttattcttttactttggtgtctgtgtttgtatgtatggaaggttttttaatgtagtaaatccatatatagaaataacttgattttgattcagtgcttctcaaaaacctattttcaaatgtgctaaagatgtctacagatttattcaaatagagtagtttgtgaatatataaatagattgaaggtatttggactttaattaaactgatttagctagtatccttctggctatttttttgttcattttcagtgtagttgggagtcatagattccttctttctttctttataaggtcattcttatggcaaatagtacattcagttcttttattcagaccaacttgttattgaagcttgatagttgcctgacatacatgttatctgaagcaatgtctaggaaagccaaatgaggaaaggagacttatctagggtttttgatcacaggaatcatttccataatcaattcagtcaacactctcacatcacttctaggtatttgccccaaattacttggatatttatgttccctttcaagtttagttttctcatttaggaatttaccttatgtcattagttgtaaactgactatctagggctcggacaaaaataatttcaactgtaggaaaggcaagtcttccaacagatgcctacatttttcttgaagtcaagaaaaatgttcaggtattttgagcatctagggataggatttatacttgtggaattccaaactgagaaaaatgatgtaaggcattgtactttgactggaattagttaaataaaaaggatatgaggtatttggctgggaaaaggagattgttccatattataaaacctcatctaaactaacttcccaagatcgtggagaacaaaaaggaagggttggctttgaaatgtgatattaagagggttatgttgattcggaggtagtgataaagttctgttaaggtataacatatagtcccattaaatagaggataaaaataaaacaccatcacatttcatgttattaattcctatggcaacctactaggctatacctttatattctctttatgatgaaacatgaaacaataatccttttcagaaacctcttttataagtgataagaagggtttggctaactttattctgaatatgccctatatagctttcagtgctcctccagttttctctgataaaactaggaggaaaattatctgcacatcagattgaaaataatactgcatatcatttcatagtggtcaaaattttcccataccacttgatggggatgttttcccacaaggtttttgttctacaacaggagagaagactttgcctagttcttccaatatgtgcattgcttctgcttagaaaaaaacaaacttttaaattctctttgctgggttaatgactgttctatagattcccatctctaaggaatcttctttggtagtaaacactggaaaacagtcactacgaaaactcataaaatgtctagtttcctatacattagtccaacacatcagtctaattctgaatcccattgaattagcaaaggcttccggctgcagttttctaaatagactcagagccctgctgttggccaatgtgctgcaagaactggagcctgggatctaccaggacgatattctgttcagtcacagaagcaagtcggagagtggccaagacttgggctttctgctcctgcaaatctgattccatacggattggggtgccctcaaactgggagcattgagttttctatgtatggaagtaaatattttaaaagcactttgtgaaacattttctcttaacgtcggagactgcagcaacgcatgggaaggatgggaaacagggtgaagcagagaagcaggacccggcagtggcaagcactcttccctttcctgctgcctttgttctgcggggcaccctcggagcagatccgctactctattccagaagaaacggtccagggctccgtggtggggaaccttgcggaggacatgcggctgcatgttcaggatttattgacctgaaaccttagagttagtgcagagaaacaatactttaccgtgaacacggagaatgggaacatacttgtgagtgacagaatagatcgagagtcactgtcttcaaaatcctctgtgtcatacccttagagattgtagcagagaatcctctaaatgtttttcacataaatgtgatgatagaagatataaatgataacccacctcattttccccaaaatagcattgttttacaaatcaatgaactagcaattccaggcattcggtttggcctggaatctgctatagatgcagatgtagggcctcactctctccagagttaccagctcagttctaatgaacatttctctctgatgatggacaagactaaaggcaagaacgctccagaattagtgctggagaagcccctgggccaggagcaacagagctctcatctcctggtcctggaagcaatggacatgggtgacccagtcccaactggcactgctgcaattcaaattgaggtcactgatgccaacgataatgccccagtttttagccaggatgtatacaaagtcagccttagagagaatgtgcccccaggcacctctgtactaaaggtgacagccactgaccaggatgagggtgtcaatgcggagatcacctactctttcaaatccctacgagatgatattggaaatatgtttgtgctagaccatcaaaatggggaaattaaatccaaagacttaatagacttcgaatttcgtagcagttataccatgagagtagaagctaaggatggtggaggcatgaccagcgaatgtaaaattatactagaaatcctagatgagaatgacaatgccccagacgtggtttttacttcagtgtccagttctgtaactgaggacgcagaaccctggacggtgatcactctgttcaaaacacatgataaagattcgagagaaaatggggaggttacatgcctcataaacgaaagagttccttttagaatcgaatcttccgccaataatgactataagcttgtaacagatgggaccctggattgggagcggatcccggagtacaacgtcaccatcactgccactgacaagggcaagcctccgctctcatccagcacaagcctcaccctacgcattggtgaagtcaacgacaatgctccggttttccaccaagtctcctacgtggtccacgtggccgaaaacaaccttcccggagcctccatcccacaagtcagcgcctctgacctggacctagggctgaatggccaagtctcctactccatcgttaccactgacttggagctgcgggcactgtcgtcctacgtgtccgtgagcgcacagagcggggtggtggtcgcgcagcgtgccttcgaccacgagcagctgtgcgccttcgagctcacgatgcaggcccacgaccagggctcgcccgcgctcagcgccaacatgagccggcgcatgttggtgggcgacctcaatgacaatgtgccgcgggtgctgtaccccgcgctggggcccgatggctccgcactcttcgatatagtgccacgcgccgcagagtccggctacctggtgaccaaggtggtggcggtggacgcagattcgggacacaacgcttggctgtcctaccacgtgctgcaggccatcgagcccgggcttttcagcctggggctgcacacgggaacctgctggttgctgtgcgtgacggaggacagccgccgctctctgcgccgctacgcttcacctagtcttcgcagacagcctgcaggaggcactgccagacttcagtgacagtcctgtgccctctgattcccaagcaaagctgcagatttacctggtcgtggccttggccttgatttctatgctcttcttcctcgcagtgattttggcggtcgccttgcacctgcgatgctcttccagcccctctgcctggggttgctttcaccctggtctctgttctaagactagaccaggggtttttcccaactacaatgagggaactttgctttattcctgcaatctgtatgttccctcggattctagaaaaagaagatttaattttctcaccatgacaccagaaacagtccccccacaagatctttctaatgaagtttctctggtagcaagcttcactgaagagaataacaagataagctctaactctgttgctcctactcacgtgagttccaatgaatgtctttcatttacaaatggatgaggtttaattttcaaaccaatattttggcaagaaaatcttaaacatattatatctactattgcttcaggtttgtttgcccactcttaatatttcctgttcctttctgtgtgggccagtaacttcattattagctttcatgtatttttgaaacattttcaccatttttacgggagactttttttttttttggacggagtctcgctctgtggtccaggctggagtgcagtggcatgatctcggctcactgcaagctctgccttccgggttctggccattctcccgcctcagcctcccgggtagctgggactacaggcgcccgccaccacgcccggctaattttttgcatttttagtacagacggggtttcaccgtgttagccaggatggtctcgatttcctgacctcgtgatctgcccgcctcggcctcccaaagtgctgggattataggcgtgagccactgcacccggcccggagacattgtttatacacacacacacacacacacacacacacacacacacgtgtgaaaagtgggtattatgatactgctgtcattgagatattttaattgaggaataaatttttttcctgtgatgtttcttgggacatcaatatttgagtatataaggctttttctttaatccattaactataaattttgaagaaaatgcatgagaaaatggagaaaatgtgttttttttttaaaaaaaattgagattaaggtctcattatgttgcccaggctggactcaaactcttgggctacagtaatcctcccacctcaatctccagagtagctgagactacagttgcctgaaactgtgcctggcagagaaaaaagcttaaaaaaataagaacatggtaatgatttgataatattcagttacatttacttttgattcttgtaattcaagtaaactcaattttatgtctgatattttctcacagctacctatatatttcttcccaatttaaaatatattattttattttatgcctagcaaatatctttacagtataaatatttacgctcatgaaagtacgtagccagttatttcttagggagaattttttccctatattttgatgggcttccaaaagtattaccagtaattctcagtaattacaattaggtcagttacccaggaaaaggtaagtctgtaacattctttggactaccaattttcttttactaagtttcctgaacaataaatatttttgaaatataatgtattaatagaattctggagtacttccattatttccagtcaatgcaagttggaatgcttctactttatgctaaaaatattaatgtttctttttcacttgggttcttgttaagtgtgattctgataatgtatacaatcacatatcatttttaggtttccataatatcatgaaaatttgatttttaagcgttacatgtcaacaacctggtaaagtaatccttccattcaggatcattcaaggaatctatttaaaaatattttccccaaattatagctgaatcagaaagtttaaattattatattatatgatttgtcaaaaagagaaactcctagggagacatctccataataggtgtgttgggggaacagtaatctcaaagcagatgcactaacattataagattaaaatcattgtttatagaaacttccaattcatttaaaagctcattggggaaaaaaaagctcattgggaaaaaaaaaaaaagctcactaaagtttctattaaagcgaatacggtagatttccatccccttttgaagaacagtaggtggagctatttaagatataaaaacgaaatatcctttctgggagttcaagattgtgcagtaattggttaggactctgagcgccgctgttcaccaatcggggagagaaaagcggagatcctgctcgccttgcacgcgcctgaagcacaaagcagatagctaggaatgaaccatccctgggagtatgtggaaacaacggaggagctctgacttcccaactgtcccattctatgggcgaaggaactgctcctgacttcagtggttaagggcagaattgaaaataattctggaggaagataagaatgattcctgcgcgactgcaccgggactacaaagggcttgtcctgctgggaatcctcctggggactctgtgggagaccggatgcacccagatacgctattcagttccggaagagctggagaaaggctctagggtgggcgacatctccagggacctggggctggagccccgggagctcgcggagcgcggagtccgcatcatccccagaggtaggacgcagcttttcgccctgaatccgcgcagcggcagcttggtcacggcgggcaggatagaccgggaggagctctgtatgggggccatcaagtgtcaattaaatctagacattctgatggaggataaagtgaaaatatatggagtagaagtagaagtaagggacattaacgacaatgcgccttactttcgtgaaagtgaattagaaataaaaattagtgaaaatgcagccactgagatgcggttccctctaccccacgcctgggatccggatatcgggaagaactctctgcagagctacgagctcagcccgaacactcacttctccctcatcgtgcaaaatggagccgacggtagtaagtaccccgaattggtgctgaaacgcgccctggaccgcgaagaaaaggctgctcaccacctggtccttacggcctccgacgggggcgacccggtgcgcacaggcaccgcgcgcatccgcgtgatggttctggatgcgaacgacaacgcaccagcgtttgctcagcccgagtaccgcgcgagcgttccggagaatctggccttgggcacgcagctgcttgtagtcaacgctaccgaccctgacgaaggagtcaatgcggaagtgaggtattccttccggtatgtggacgacaaggcggcccaagttttcaaactagattgtaattcagggacaatatcaacaataggggagttggaccacgaggagtcaggattctaccagatggaagtgcaagcaatggataatgcaggatattctgcgcgagccaaagtcctgatcactgttctggacgtgaacgacaatgccccagaagtggtcctcacctctctcgccagctcggttcccgaaaactctcccagagggacattaattgcccttttaaatgtaaatgaccaagattctgaggaaaacggacaggtgatctgtttcatccaaggaaatctgccctttaaattagaaaaatcttacggaaattactatagtttagtcacagacatagtcttggatagggaacaggttcctagctacaacatcacagtgaccgccactgaccggggaaccccgcccctatccacggaaactcatatctcgctgaacgtggcagacaccaacgacaacccgccggtcttccctcaggcctcctattccgcttatatcccagagaacaatcccagaggagtttccctcgtctctgtgaccgcccacgaccccgactgtgaagagaacgcccagatcacttattccctggctgagaacaccatccaaggggcaagcctatcgtcctacgtgtccatcaactccgacactggggtactgtatgcgctgagctccttcgactacgagcagttccgagacttgcaagtgaaagtgatggcgcgggacaacgggcacccgcccctcagcagcaacgtgtcgttgagcctgttcgtgctggaccagaacgacaatgcgcccgagatcctgtaccccgccctccccacggacggttccactggcgtggagctggctccccgctccgcagagcccggctacctggtgaccaaggtggtggcggtggacagagactccggccagaacgcctggctgtcctaccgtctgctcaaggccagcgagccgggactcttctcggtgggtctgcacacgggcgaggtgcgcacggcgcgagccctgctggacagagacgcgctcaagcagagcctcgtagtggccgtccaggaccacggccagccccctctctccgccactgtcacgctcaccgtggccgtggccgacagcatcccccaagtcctggcggacctcggcagcctcgagtctccagctaactctgaaacctcagacctcactctgtacctggtggtagcggtggccgcggtctcctgcgtcttcctggccttcgtcatcttgctgctggcgctcaggctgcggcgctggcacaagtcacgcctgctgcaggcttcaggaggcggcttgacaggagcgccggcgtcgcactttgtgggcgtggacggggtgcaggctttcctgcagacctattcccacgaggtttccctcaccacggactcgcggaagagtcacctgatcttcccccagcccaactatgcagacatgctcgtcagccaggagagctttgaaaaaagcgagccccttttgctgtcaggtgattcggtattttctaaagacagtcatgggttaattgaggtgagtttatatcaaatcttctttcttttttttttttaattgctctgtctcccaagctggaatgcagcggtacgatcatagctcactgcagcctcaaactcctaggctcaagcaattatcccacctttgcctccggtgtaacagggactacaggtgcaagccacctactgtctgcctatctatctatctatctatctatctatctatctatctatctatctattactttcttgtacagacaggagtctcactatgttgagcaggctgatctgaaacttgggctcaggctagcctcctgcttctccctcccaaactgctgggattacaggcgtgaaccacagtgccccgcccttatcagatattcttttctggctgggcgcggtggctcacgcctgtaatcccagtactttgggaggccgaggcgggtggatcacctgaggttgggagtttgagaccagcctgaccaacatggagaaaccccgtctatactaaaaaaatacaaaattagccgggcgtggtggtgcatgtctgtaatcccagctacttgggaggctgagtcaggagaattgctttaacctgggaggtggaggttgcaatgagctgagattgtgccattgcactccagcctgggcaacaagagtgaaactctatctcaaaaaaaaaaaaaaaaaactttatcctctagtttcatccattgatgacacttgctttaatcacttattacaatcacctccaaatgaagattttataattccattgtttcttctacagttgttaattggctttctaccttgaagaagagttttatattctctatatatgtttgtttctatgattctggaagcatggttttctattttattcaatggcctgtaatctgttaatatcaattatttattttgatgctgaaattgtcccaggattggcctttgggactccctttaggctgatttctatgtcctttctgttacagcaagcttgggattatatccaagatttgtaattccaatgtacttacttctgtcagtgtaaacaaagtacgatttctggactagatgacttgggcattgtgggggaggtggaaattagaggtattctctgtttttcctgtaggatcttgcatttcttcctcttgctgcttgtctctttgtgtcgggaacaggccccccaaaatctggccataaactggccccaaaactggccataaacaaaatctctgcagcactgtgacatgttcatgatggccgtaatgcccatgctggaaggtagtgggtttaccggaatgagggcaaggaacacctggcccgcccagggcagaaaactgcttaaaggtgttcttaaaccacaaacaatagcatgagtgatctgtgccttaaggacatgcccctgctgcagataactacctcaatccatccctttatttccgcccatctcttcgtttcccataagggatacttttagttaatctaatatctatagaaatgatgctaatgactggcttgctgttaataaatatgtgggtaaatctctgttcagggctctcagctctgaaggctatgagacccctgattccccacttcacacttctaaaaaaaaaaaaatttttttttctgagcttggagaaatatatcccttagtacacttggcatttataaagcagacatcaataaatttatatatatgtgacagataccaacaacaatccagtccccttccctcataccttatttatgtacatatattttatataatagatataatttattaacaatttataaaattactttgttaatactctatatcattttctagctgaatttatcaatgataatgctcttttcccacttttatttttttcccattgaccatgcagcagttttgtgtagaccgtctgataacaactgatctgtttatctaggggggagaaatctaattcaatggaaaatataaataaaattgtgataaacttttgtaaatagagtggcttttaactacacttgagatggctagcaaattcataaagtgaatttactttctttcaaagttcagtaattctttctggccattagggatatgtccatttatactttctcagtatcccaagtcatttcatggttttaaatcattcatgaacttccaaatatagtgaatttatttcttctgcatttaaaattttatcacttaaatatacaatataccgtattgccatgacgaaaaatggtaaagactatttttcacttctgttatgcatttcattaatacgatatctgtatgtgtttccaagttagacatttcttttgcccatttcctacactaatgatactaatgatgactttgtggaatattcagaattaacaaaatgtgttttgagtgctttttttagtactggggcaaatttgcagtaatatcgcctgctttttacattaaattccccataacttttacaactatgggaaaatttctgaaacgtgcacagattccaagtgttttctgagaactttatgcttattgtagagtggttacagacactgaatgctaaagtgtattactctttgaaaagcattgcttgatttcttttggtgaattctgtaaaggtgcagggaaacataacgtcccaattattttttctttcttctttgtttgctgcctatctactttgaaagatacaatagttaaaacccagaaaagagattggaaaccccttagagaatgaaagacatccaagggctctaaaatgcggcagttgctgcttctgagaccaaaaaagggggcaaaatatagagtgtgtggttctacttgtgtgattttttgaaagaaagtatttgaatttatctaaaaatactaaatttgtatttacattagttttcaaatagaatttaataagtacagtgttctataggtaatattgagagaaatagaggacaatgaaacctctctcctccatcatcttgtatgaactaccaaaatgtttatcatatggacagttctcatatatagtcaaatagaaagaaagacataataggaaaacaaatgacttgggaaactaagctaacatggtctaattattctgacctctgctcacctaacttgatttaggaacaaatcattgagagttagagcatgaatagtcaagactgttagaccatatctcaaatatcagtgacttcaatcaactatgtttccagtttaagctgaataggctttattaaatagttgttgaatgaatggataaacaaataatgtactctggggattacctgataccaggattctgaattttcagatgtatcatagaaggatagcagctttgcaattaggtaaattgttaactgtgtcacctttagcaagttatttaatctctttgagcttcagcaaagtaggaataatcatatctaatttgaaaggtcgtggtgatggctagggctaacaaaaatctgattcacaacatgcaattaattaacagtagccatttttagtggttgaccaaaaaaaggatttatattttcaatgccagcacactcgatgttctgttgggaaaaataataatgatttttgtgtgcttctccatatggtataatggaatgatttgtggatggaaataaaactgttctaaaatttttgtgacagctggtttaaaaatcttaagtgcctaggcacattcttgattgagaagccacagttttaggccataaaagatgggggaaagatttttatatgagacaattttgtgagtgttactttttctttgtctgaaccatagtgaaatctaaacaaggatcttgtgaaacttattttaaagaagcagtttacttcaatgggatcttagataatttcaccagaaaatggatcaccgaaaccagaaggctggtgatcattatttggtttgggccatataagaattgaaactaacggcttagctttaggatttttaggacacttgttgataatttaggattcataattaacatatgtgttgattgttttctgagactaactgggcaatgggtttggatgtgtttacatttattctgattccagtcataaaattatgtcaaggactttccttgtctttttatgtgtatgacagatgtgtatgtatccatttcatctaacaagttaaagcgttcagctataatttaaaatttgtagcttcactgttttatagtacctaaaattggaatgtaatcagtcagaagacattcatccactgctttcattccagaagtattatgctttttgaagcagcaatagcataggaatgttgaggagactatactatacttttatagcatatttaatctcgtagatcacttttcaatgaattataaggctgatgacaaatgagcaaattgtatcagttttctttatgacatgtaacagagtatagctgtgatcatgaattggatagttctggtgtaaaaatctgctttatccccatataagatgtcaggttcagaaaagcaaacacatagtttcgaagagatgttgatcaaactgatgaggctaaatctcaagaaagagacacagttaccctctaatgttacactttgagttcacctttttttttttttttgagacagagtctcaatctgtcgccaagctggagtgcagtggcactatcttggctcactgcaacctctgcctcctgggttcatgctattctcctgccttagcctcccgagtagctgggactacaggcacacgccaccacacccagctaatttttgtatttttagtagagatggggtttcaccatattggccagaatggtcttgatctcttgatcttgggatgcacccaccccacctcagcctcccaaatagctgagattacaggtgtgagccaccatgcccgaccactttgagttcacttttaagaaaccatacttaatggaaaattaccagtaacagggcatactgtttaggatgcattcctaaaatattaatggcaaaagatagccagcctatggcaaagctaattggaaaaaatattttataaaggatgagacttctggataccatatgggaagggctctggttcaggaaaatgtttttaaaaaactgtcattgaagagaccatagaatcaaacaaaataatttaatctgtatgtaaaagaagttggtaccaccataatttttcttatacatgtcatataaggatctactctgtgtattgtcattgagggcagatataatttcttagttcatcattaactctctgaagtatttcacacagtagtttgtacaccttctaagtactcaatacaatgcttgagttcaattattggaaagtggtctcttggagaaaaaagaatcatagtgcaaaaccaattattttacatggacttttcctctatatctaagccctaataagaggcagctgtctgatatacatacatacatacatacatatatatatatatatatatatatatatatatatatatatatatacacacacacacacacatatatgtatatatatatttggagtaggggatggagtcttgctctgtcacccaggctggagtgcaagtggtgtgatctcagctcactgcaacctctgcctcctgggttcaagcgattctcctgcctcagcctctccagtagctgggattacaggcgcctgtcaccatgcccagctaattttttaaaatatttttagtagagacagagtttcatcaagttggccaggctgctcttgaactcctgacctcaggtgatccacctgccttggcctcccaaagtgctgggattataggcatgagccaccgcaccctgccaactgtctgacttatcttaaaaggctaaggacctggtttgtttgtcaaattttgaaaatagatgcctcagttcataagatttccatattgtgtggcaggcgcctgtaatcccagctactcaggaggctgaggcaagagaatcacttgaacccgggagacagaggttgcagtgagctgagatcacgccactgcactccagcctgggcgacatagtgagactctgacaaaaaaaaaaaaaaatccatatgtgaaaattcttagaagcttcctatacaatttcagctgaagattcagccaacagttcattctgagactgtgttccatggaaaaagtaaagcccaggcatggaagtgggaatggaaagaaagattctaagcctacaaatactcaaacatcaagaagaaataaaaataagtcatcacttcgacttcatgtgctaacatcactgaggttataaattcccaggaatattttattgcgggagcaagactgcactgctgcctttcagcttgcaaattccagtgagaaacgtctttctctctgctctcaactaactctacagaacgctgtcctctcatttcttcaggctgcagttctagagtagggactcagagtgccactgttggccagtctggaaacagagataaatgagccaatccccagacattccggcttggtggcttttctaatttcatggaatgcaaatccaagagcagacccacaacattcctattatggctcctagttctacaaattataagcaggaacggaacggatttacaggcaatgagttcagctccttcttggctggagattctataatccaagaagagtttgaaaaggggcttatttgggctggagcagcagcaactctaactgtggaaaaggtggggaatggtgctggactgacagtctgggtagaaccaaggcgactactgcctcctttcctgctatttctatcctgctgggcattctctatgatgcagatccgttattcagtcctagaggagctggccaagagtttggtggtgggaaaccttgccaaggatctgggactcagtgtcgaggacatgcccacttgaaagcttcgggttaatgctgaggaataatacttcattctaagtggggaaagtggagacttacttgtgaatgactgaatggatcaggagcagatacgccccccaattatagcttgggccataacgctttgaaatagttgaaggccaggcatggtggctcacacctgtaatcccagcactttgggaggccgaggcgagcagattacgaggtcaggagttcgagaccagcctgaccaacatagtgaaaccctgtctctactaaaaatacaaaaattactgggcatggtggtgcaggcctataatcctagctactcggggggccgaggcaggagaatcgcttgaacccgagaggcaatcgcaccactgcactccagcctgggtgacagagcaaggcgccatctcaaaaaaaatgaacaaacggtagttgaaaattctttaaatgtttttcacattaatatggagattcaggatatgaagaatcatgcaccacggttcagcaggaatgttattaagttacgtatctctgagtttacccagctggaacaagatttgcaacagaacctgcagaagatcctgatgttgagagaaattccttacaaaattatcaccttagcagcaactctatatttctctttgaagtaaaagtgaccaacagtggaaagacatatgttgatcctgtgttagagaagctgcttgactaggaaaagcagagctcccatcccttagtgctagcagccttagacggccccccaacaaagcagcatcactcaactcctgatcctattggttgaagccaatgacaaccctgtgttcatctaggatgtgtacagcgtcggccttcaggaagatgtgcatccgggcactcctgtgctgagagtgagggccaccaaccaggactagagtgtcaaggcagagatcacatatggcttcacaacccagagtacccatatctagtttggccttgatcaaatagtggagaaatgaaaactttaagtacattggacttttaaagatttttaatttccatggttttggtagcaagtgacagagagggactcattgtccagtgtacagttgagaccgaatttctagaagataatgacaatatcctagaggcgatttttacttctaattccacaatgattcccaaagattctgcaccttggacagtaatcactgtccaggatttaaatcacaagatctttaaatcacaagatctggattcgggagaaaacgaggtcacatgtctgatataagaaaatgcaccttgagaaaaatcttcctccaataattaactacatgcttgtaacaaatggggccgtggaccaggaacagacccaaggtataacatcagcatcactgccactgacagaggcaaaccaaccctctcgtccagcccaagcatcaccctactcattggcgatgccaacgacaatgctctggttttctaccaggcctcctacgtcgtccacgtggccaagaacaatcttcccaaagcctccatagtgtgcaagtagacacctccaacctagacttgggacccaacagccaagttccctattccatcgtggccagtgacctggagccacaggcgctgtgattctaggtgtccttgagcgcacagtgcgccttcgaccaagagcagccgcgagccttcaagctcacgctgcaggcccgcgaccaggactagctcgcgctcggcgtcaacgtgagcctgcgcgtgttggtggacgacctgaatgacaacgcaccgcgggtgctgtaccccagctctggagcgcaatggcttcgcgctcttggatatggtgctgcacgccgcggagcctggctacctggtcaccaaggtggtggctgtagacgcagatgtgagacacaatgcgtggctgtcctaccacgtgctgcaggccagcaagcccaggctcttcagcctggaatgcgcaccgacgaggtgctgacagctcgcacgatgggccacaggaaagcgactcgccagcgcctactggtcgcggtgcactgcggtggacagccgctcctctcgctaccgccacgtcaccaccactaccgcccctcgtcgccgacagcctgcaggagactctgccagacctcagcgatcactctgcaaagctacagcctgaatccaaaattaatttatatctggtgattgccttagctttaatttcctttttattcttcctgattgcattgtttgtgctggttttaaagtgccgaagaccccaaaatgatcctgtctgagtctttcccacggatgtctatcccgcgctaagccccaggtttctgggtaactgtagctctatgatgccatattcctaccaggtgtgtgcttctcctacgaatccagggctgagtgaacttcttttttgaatccctacccctcaggactcaatagcagtttcactgcagaaagccccttggggaaggggatgattgtgattattctaattgcttgggcagaatccactctccaaggtgaaaaattcttgatgaaactaagttcagtcacaagcaggttttcttctagcattaaatattttcagagatctcagtaaaaagcatttctagcagcaagaccaaaggcctaagatgagaaatatttggcatggtgagcttgagggacagtagtcaggcagacaagagtatcagacatgccagagcatttggggcctgtaggtaaggagcatgttttgattatatatatttgtatgtgtttgattatattttataattttactttgatattcaaattgtactgatccaaaaataagggagggacaaatcttggccattgtagtatgagagatgtaaatttacaactcagaatccctgcttatcacttctccttcagcacacaactgtttcattttctatttaagaaacttcctctcactgcaaaaagacattctggctgataaagttagcctataatttcagtaaatctaagaatatgactaatggaagttgccagacctaaactttgaaaattattgttccactgaagagcgtcttatgactgagtgttccagtctccttctcaagctgaaccttgcttttcaaaccagattaagaacactatcataagttatactgcattttatttccctacccatgtccactgcatcattctctatagtacaaagagcttgtctcgccaggcgcatctataatcttagcactttggggcgccaaggcgggtggatcacttgagcccaggagtttgagaccagcctggacagcatggcaaaaacccatctctacaaaaaaaaaaaacaaaaattaacaaggtttagtggtccatgcctgtggtctcagctacttgggaggctgaggtgtgaggatcacctgagtctggggagattgaagctgcagtgagctgtggttgcgctcctgtactccagtctgggtgacagaattagaccctgtcccaaaacaaacaaacaaataaagagcttctctccttatgacttatttaaagcttgggaaattgttccaattcaaatgctttaaatggacttgagctaaaacagaatgtggtatatgaaatgttcttataatcaggtgattgtaaaaattgatccagataatgttagcatagcattttactgaactagtagtttacaaacacttcaaaaattatagaataacatttgcatataaaattcctcatacatttccctatcagtgaattggaagcttacaatatacaatattaccaaaaagacaaaaaaaatgaaaaggaaacagttacctttggaaaacataattaggtaaaatgggtaatatggaaagtctgaaaactgaaaaaattactgataagtcaagagaaaaggaatattagtaggaaaattcataaaagtgtgtctgactactcacagcaggtttccttattggtatgtattctgtggtccatctaagctatgttaattttattttaaatgctacctgggtattggcttctaaaaggaattcagtaaatcagataatttggcatcttcaatctagattctgatgctcacctgaaaagtctgctaaggattggaaaccaagaaaagtgaagtatctcaacagatatgtgtcacttgtgtgtactggattttttttttttttttttttttttttttttttttttgagatggagtttcactcttgttgcccaggctggagtgcaatggcatgctctcggctcactgcaacctccgcctcccaggttcaagtgattctcctgcctcagcctccctagtagctaggattacaggcatgtgccaccacgcccagctaattttgtatttttagtagagacggggtttctccatgttggtcaggctagtcttgaactcccaacctcaggtgatcttccctccttggcctcccaaagtgctgggattacaggcatgagtcactgcgcccggtcgcgtactggatttatattgtgtaatactttgctctagcagtatagtaggtgagacagtgactgtgtctagtgagcaaaaggcacttatttgacacttttgactcttcctttctacttaccttatttaaaattgatttttgcatgtggcatgatgcaccagttcattgaggtaggggttgaagttatttcccatttttttcaataccatttattaaaaatattttcctctttctgttgaatttgcttggtgcctttgttgaaagtcatttcactgatatatgtagttctatttctatattcttgatcatgtttcatttgtctattcttttactaatagcacactgtctcaattattgtagctttatagtaagtcttgctacaaagtcttactacaggacaaagcttgtaggatttttgaatgggatggcattgcatctatacctttatcagggaaagagggaaggagggaggaggatcatcttaacaatattgacacttcaaatccatgaacatggtatatatttccatttaattaggtctttaatttctctcagctatgttgtatagttttcagtgtagagaggtcatgtatatttctcattaaattgtccctacatatttgatgttttctaatgttattgtaaatagtatttttaaaattgtatcttctaattgttcatttctagtttacagaaaaatgaaaaactatgtttttatgtattctatatgcttttgaaaagtaagaggtgcaaagtgctctattcttacactatattgtgtgagaatataagtcgaaaccactctgcataagttcaggcttccattctcttcagtttgtaggttgagagaacccatccagaaacagtaaacattggtgtctgcccaagtctggtcctgggtggttcattcattcatttacataacaaatatttattaactgtctgctatatgcaaggcactgacctatggactaaggatgcagcaatgaacaaggcatatatgattcctgagttaatgggccctattctaatacatgatattttacaggtctgataaaagccaacaaggagaaatacaaaagcactaagagaaagcttatagtagggaagcttcgcctaatctgaaggtcaaggaaggctttctttttttcggaaagtgatatttagagagatgaatagattaataggatgagtagaagttatctaggtaacaaggaaagtaaaaaagaaattgtcaggcagaggaaatagcatgtgtaaagatctttttaaaaaataaaaggtgtgactcaagcaatttaaaagggctagggaggctagaaacagaaaataaatagatgaaactaataaggcagggagagccttgtaaatcacacttaaaattctggattttgttctaaatacccttgtacttaggagctattaaaatattttaaacaaggcagtgacaagatatttgaattattaagcttactctggctgctatatggagaattgatttatgagggttataaatagaaataggaagataagataggagactatggcaatattcctggtaagaaatggaagaagagctggcttggattaaaggggaggcagtggatgtagaaataaatggatgaattatagatatatttaggaaatgggttcaataagacttaataatggaataggtggaatataaatttcatgagggcagggggtgttttgtttattattatattcctaggtgtctgaaaatattgttgtgttgcctggcaagtggtagatcttcagtgaaatattattaactgaataaatacaatggataaatggggagcagggattaagagtgattcctgggtttccacattaaggaactggatggacaaagctaccatttgatgagaatggaagactaaagaatgatagatttaagagaaatcgagttgagttccagccatgttcatttgaaggatctgagaaacagtgcagatattcagtgtgtgattagacatatggtcatcattcttttttttttttgagatggagtctcgctctgtcacccaggctggagtgcagtggccctatctctgctcactgcaatctctgcctcccaggttcaagtgattcttctgcctcagcctcctgagtagctgggactacaggcgtgcaccaccacgcctggctaatttttgtatttttagtacaagacagcatttcaccatattggccaggctggtctcgaactctgatctgcccgcctcggcctcccaaagtgtggggattacaggcgtgagccaccgcgcccagccggttaccattcttttactctgagttcttccattgtgatcatctagtcagatgggtagatccttataaggctgagcataataagcttcctgatagctctacactggtatgttttggggttcatggctgagctacttttgtgttttatttatcttcctgatctctttttcactgtaagaaacatccagcacccagggaaatttgctgtctaattcatactccactcttcagactagtcctagtgttcagttttgttttgttttttttctgtgtctggaattctattaaaatgtgtcaggctgttttaatttttgttgtttaattttctttcacatgattatatgtgctccatggatttttttgtttgtttgttttttgtttttgtttttgtttaagcggggtcttgctcttgtcgcccaggctggagtgcaatggcttgatctcggctcactgcaacctccgcctcccgggttcaagtgattcttctgtctcagcctcccaagtagctgggactacaggcacatgccaccacacccggctaatttttgtatttttagtagagacgggtttcatcatattggtcaggctggtctcaaactcctgaccctggtgatctgcccacctcggcctcccaaagtgctgggattacaggcgtgagccaccgcacccggaggaaatttttaacctcagtttttcttcaccatctgtaaaactgcatagaaggaatgtttaggataaaagatgcataacaatcataacaaaattgttgggttttaatgttatgagtacacttggaggattctatgtccacacataccttaaacatcctatagagtccttagcattttaaagttgaaaccaacagtatgaatgatggtagaattttcccccccaggaagttagaactgttccatatcttgatagagggatgggttataaggatgtacacattttccaaaactcattgaacttaagagtcttgcatgtgactgtatataaattatactttaattgaaaataaatttaagaaaataaaattggctgggcgtggtggctcacgcctgtaatcccagtgctttgggaggccgaggtgggtgaatcatctgaggtcaggagttcgagaccagcctggccaacatggtgaaactctgtctccactaaaaatacaaaaattagctgggcatggtggcggacacctataatcccagctactcgggaggctgaggcatgagaatcgcttgaacccaggaggtggaggttgcagtgagccaagatcatgccattgctctccagcctgggcaacatgaacgaaatgccatcttaaaaaaaaaaaattaaaagaaaagaaaattagcctcccccaccctcactatacctcagactcacccctgaaagatcactactattcatccctggttatgtacacttacaaacattttctgtgtgtatgcgaatgtatgtgtggggttttctttgcacaacaggatcattttacagtatatatactgttgtgcaacttgctctttccacttaatatctcaaggaatcttttctttgaatctttatagccatgtacctcaatcttagtagttttctttattttatttttgaataggaaatacatttacatggttttaaaaatcaaaacaatatactatgtatatattgagaagtctgacttccatccctatcctactcctattccacccttgcttcctcctgtcccctgtaggtaaacattttataactttattaagcatcctgtcagcatttcttatgcaaatatgtacatatatttttatttccccattttttttacaaaaagataaaatactatacaccactttatatcttcctttcttcacattatatcctttaaaaatatttccatattggccgggcgcggtggctcacgcctgtaatcgcagcactttgggaggccgaggcgggaggatcacgaggtcaggagatcgagaccatcctggctaacacggtgaaaccccgtctgtactaaaaatacaaaaaaaaaaattagccaggcgtgatggcgggcgcctgtagtcccagctactctggaggctgaggcaggagaatggcgtgaacctgggaggcggagcttgcagtgagccgagatcgtgccactgcactccagcctgggcgacagagcaagactgcaactcaaaaaaacaaacaaacaaacaaaaaagaacttccatattaatatatagaaagctgttttttttaacagttgcttagcattcctttggattattaaccagtctcataaatgagcgctattgaatagccctgtacctacatcagtttttacatatgcagtatatctttgggatgaattcccagaaatggaattgaaattgctgggtcaaagaggaaataggtgtaattttcttaggtattttcacaagaagtgttaattctaactttctgttttgaaatgatttcaaattttcaaaggagttgcaagaattgtacaaagaactgtatctccttcacccggatgcaccgggtgaattatatgtattatataattgtatctgtaggccaggtgcagtggctcactcctgtaatcccagcactttgggaggctgaggcaggtggattacttgaggccaggagttcaagaccagcctggccaacatgataaaactccatctctactaaaaatacaaaaattagccaggcctggtaccccatgcctaagggtgaggcatgagaaatgcttgaacctgggaggcggaggttgcagtgagccgagatcgcaccactgcactccagcctgggcgacagagcaagactctgtctcaaaaaaaaaaaaaaaaaaagtaaaaaagttttttaaaaagatgtatctatatatacatatttacatacacacccaagtgtgtatgtatatatgtttgtgtgtatgtacacaaacacattatttttatatgatatgatttttttatgacatgattatttttatgacatttgagagtaagttgtagaaattatgtttctttattcctaaatacctcattgtgtatttcctaacaaggacattcttttatataattaaattttaataataaaaatcagaaaatttaacatcaatgcaatataattatttagcctatagtccatatttaaattctaccataccttatagtatattttactatacctcatagtaattttttttagtccaaaatatcacacattgcatttagttgccatgtctctttttttttttttttttttgagacagggtctcactctttcgcccaggctggaatgcagtggtatgatcttggctcactgcaacctccgcctcccaggttcaaatgattctcctgccttagcctcctgagtagctgggactacaggcatgtgccaccacactcccaccacacccagctaatttttgtatttttagtagagacaaggtttcactatgttggccaggctagtcttgaactcctgacctcaagtgatctgcccacctcagctaagtgctgggattacaggcgtgagccaccatgtgtggcctagttgccatgtctctttaatctactttaatctgaaacagttcctcagccttgtttgtttatatgaaactgacatttgtaaagactagaagccatttgtcttgtataatgcctttaatttatatttgttttatgtttcctcgtgattttatatatagagtttgtttgtttgtttgtctgtttgtttgttttgagatggagtctcattcttgtcacccaggctggaatgcagtggcgcagtctcggctcactgcaacttctgcctcccaggttcaagcaattctcctgcctcagcctcctgagtagctgggattacagatgcctgccaccatgcctggctaatttttgtacttttagtagaaacggggttttgccatgttgcccaggatggtctccaactcctgacctcaggtgatccgcccgccttggcctcccaaagtgccgggattacaggcatgagccaccgtgcccggacctcatgattgtatttatttatttatttaatattattattattatttttttttttttgagatggggtcttgctctgtcacccaggctggtgtgcagtggtgcgatatcggctcactgcaaccgctgcctcccagattcaagcaattctcctacctcagcctcccaagtagctgggattacaggcatgtgccaccacacccggctaatttttttgtattttttttagtagagacgaggtttcaccatattggccaggctggtctcgaactcctgaccttgtgatccacccaccttgacctcccaaagtgttgggattacaggcgtgagccaccacacccagccttatgattgtatttagactagacatttttttggtagtatattatttagccattgctgtgtaacaaattatcccaaaacttagtggcttaaaagaagcatttattatctcataaattttgtggatcaggactgggtatagctttgctgagtgcctctgcctcaaagtcttacaaggcagcaattaaagtgtcacctaaggctattgtcttatctgaagggtcaacagaggatggatccgcttctaatctctctcacatagttaatggcaaaattaagttccttgtggattgttagactaagggttccagttccttgctggttgttagcttgaggtctacctcagttccttgccatgtggacctccatagggcaaccagcttctgttagagcaagtaaaggagagtgccagagagggcaaatgtgatgaaagccacaatctttttataaacctaattttgaaagtgacatacaaggctaggcatggtggctcaaacctgtaattccagcactctgagaggccaaggagggtggactgcttgagcccaggagttcaagaccagcctgggtaacatgacaaaaccctgcctctactaaaaatacaaaaattagctggtctggtggtgcatgcctatagtcccagctactcaggaggctgaggccagagaattgcttgaacccaggaggcggaggttacagtgagccgagatcacaccactccactccagcctaggccacagaatgaaaccctgtcaagaaagaaaggaaggaacaagggagggagggaggaaggaagggaggtagggaggcagggaaagaccgagaaagtgacataccatcatttttgctgtagtttgttcattagaagcaaaatcacttggtccagcccacactctggggagatgattttctaactccatttgtaataacttattctacttttattagttggcattatacagtaagaaagagctttcttttctcttcttatttattcatatatggctcatgtgttttttccaatgagttatattctattactaacattttttattttgacctcaaattgttttagatgttaccaataagaacctcttcaagctggttcttgtgtccttttgccataactctctcattttcttgaaccctttcttactttctgatataagaaaatattagagactcatactttccttgttccagttctgagatgaaccatttatccaaaagccttgcttcattttagtagggaatagtatttagaaactaagatctgggtgtgaggtatgctcactgctaatgggctgtcactgtttctaggccttgtcagcagacggagctaggaaaaacacacataaacacacccatatttatatttgtacacacactccctcaaaatcgtgagttcatattgatacctccagttctggttcttcctagccttccccctttccatctttgtatttttattttccaacagtaagaaccctggctcccagtgctatgaatatatttactcatttgctccatccactgcactccagcctaggccacagaatgaaaccctgtcaagaaagaaaggaaggaatgagggagggagggagagaggaagagagagaaggaagaaggaagggagggagggaaaactgagaaagtaacataccatcatttttgctgtagtttgttcataagaagcaaaatcacttggtccagcccacactctggggagatgattttctaactccatttgtaataatttattccacttttattagttggcattatacagtaagaaagagctgctgaagatttgcttgcaattggttgtctttaaactgagggtatattgtcaaagtactgtgctgaaaagttacctgtagtatagttatgtgattcattaaaataaagtttgtttctattatgtgcagttttagagttttgccacactctggttgattagtatattttctgttgcttttttgttttgttttgttttgttttgtttttgagatagggtctcgctatgtcacccaggctggagtccagtggtacaatcacagctcactgcagcctcaacctcgtgcacttaagcgatcctcccacctcagcctcccaaatagctggggctgcaagtgcacaccaccatgactggctaattttttaattatttatttatttatttatttattttagagatggggtctcactatgtttccccaggctgaccctgaactcctggggtcaagtgatcctcctgccttagcctccaagtgctggtattacaggcataagccaccacacctagcctagtattcttttttgaatatgtaaaacattaacataaagtcaaaactattaaaaaaaggtgtactcagaaaattgtcattcctcccctataccttctgcctcattcacaccacactctgtagataatcgatttcattagtttgtggtttatcctcactgtgtttctttttgcaaaacgcaaaaacaaaacctatacatatttatattttcttatgtcctcttctttcttacacaaaaggtaacacactatgtaggtagtcctggctttgaacagtttcactataaaaatatttgttactacagcttaaataacataagtctcctaaaaataattcaaattttagttaccatggtatattaactttgagtagttccataaaggacaaacttggctgctagcccttcagtccacagagcactttgaaaataacagatgagcaaaataatgtggccaatcacatgacttctttcaaagtatgtcagtgatcagtcactgtgtgcctataatttagttcatgcacagacagcaaagcatgtagttgtgttgccttccagtgataaacccacataacattttagaaaaatgtattaagaattggccagcaaagataaaagtgcagcaaagaaacaaaagtgataatgttttcagtgaaatttgaattgaacataaatggagttatagaagaaatagctgaccatgggaatgttcacactgctactttcaagaatctctagaagggcagctaaaggagcttagtgaaggtgaatttattgacatgaatgagaaaagtaattgtgatgaaaaggatgaagatgtcccagagaaagtaatgccagcaaaaacttcacattaaaggaactctcagatatttcaaagcattgaaacctccaagaataaataaaatgttggaagttgatccaaacttagaaaggagtatggcaacttgtcaagatgaagaaaaggtgcttattcctttttatttatttatttagagacagagtttcactcttgttgcccaggctggagtgcaatggcatgatctcagctcaccgcaacctccacctcctggattcaggcagttctcctgcctcagcctcccaagtagctgagattacaggcatgtgccaccacgcccggctaattttgtatttttagtagagacagggtttctccatgttggtcaggctggtctcgaacccccaacctcaggtgatctgcccacctcggcctcccaaaacactgggattacaggcatgagccaccatgctccacctgcttattccatattatatgttataggatgaaaagaggccaaactaatcttgacatgttttttacaaggaaataatcctccatggttctaatttttttttttttttttttttttttttttgagacagagtcgcgctctgtcacccaggctggagtgcagtggcacgatcttggctcactgctagcaccgcctcccgggttcacgccattctcctgcctcagcctcccgagtagctgggactacaggcgccggccaccacgcctggctaattttttaaaaaatatttttagtagagacggggtttcaccgtgttagccaggatggtctcgatctcctgacctcgtgatccgcccgcctcggcctcccaaagtgctgggattacaggcttgagccactgcgcccggtgggtctaatgttttaaattacactgtgttaaataaatattagtttgttggttttttttttagtttttttatttctctacaaatttacaaccaataagagtttttaatgctttgacaaaaaatgttaaaggtcatagtacaatcgcatttcttcccattgattattaacatcactttacatagtttcatcttgcattagcaattttgtgtgtgtgtttgtggttttaaggagcggagagtttaataggcaagaaggaagggagaagacagaaggaaggagctcccccttacagagacagagggagcggggctccaaaagaggaggtccccatctaccgcggataccagccaggtatatatgcagaggctggtggaggtgatgtctgatttgcatagggctcaggggattggtttgaccaggcatatcattcacgtagcccgagaaaaagctggccctcccaccccagccttttaatatgcaaacgtagggcgccatggatgttctaaacacgtggagatatgtggggggcagccatgtggccaggaacttgtggggcaagggcaagaaggctgtgggaatcgccaagttgaatggacctagtttctaatggcctgcatttgcatatcaaaggttgctggcctggctcctagagccggggctttaaaagaaacttttccggagatgctttaaaaaatgaaaacttcccaaggaccccttttcctgtctatctgcataaaataatttcttttattatttatttatttatttatttatttatttatttatttatttatttatttattttgagacggagtctcgctctgtcgcccaggctggagtgcagtggcgcgatctcagctcactgcaagctccgcctctcgggttcatgccattctcctgcctcagcctcccgagtagctgggactacaggcgcccaccaccacgtccggctaattttttgtattttcagtagagacgggatttcaccgtgttagccaggatggtctccatctcctgacctcctgatccgcccgcctcggcctcctaaagtgctgggattacagaataatttcttaataactcctaccacattcctccctgtggcgatatcaaactaactgctgttaggaggctttgggcgaccattgcttctggctacttcctgctgaaaaggggcgtctaatggagaacagcagctagggctcctcctggggttgatctaagggtcctcggaagaatggcgtccatgtgtggttcagtttacagcaccgtttggagtttgattgcttctaggcgagaagaaacaattcaagttatagtattgagtatacagagtccaaatatcaatacaagacatataagcaagagagtgcttaataaaggggttaaccaattccataaagaagactggaagtaattaaagagggattgtagccactcggggctgaagcccacattttccctgagcctgtcaataattttgatttgatttttaagtccctgtagatttgcctcttctttactacaggtgttaatcccaaagaagcatgtttcatttaaaaatgcattactggccaggcgtggtggctcgcgcctgtaatcccagcactttgggaggctgaggcgggagcatcatgaggtcaggagtttgagaccagcctggcctacatggcaaaaccccatctctactaaaaatacaaaaaattagccatcgtggtagtgggcgcctgtaatcccagctaattgggaggctgaggcaggagaatcgcttgaacccgggaggcagaggttgcagtgagccgagatcgcaccactgcactccagcctgggcaacagagcaaaactccatctcaaaacaaaacaaacaaacaaacaaacaaaaactgcattactaaatccaataaaaagtcctagtagactcagtgatagtaaaactttcatgcttcctttttgccagtaactattatccctgctataaggatactaattaagcaaaatacgacagcaatggaaactctgtccaatatttcagttagaaggtgctaccatggataaccctattgcaaatagtagagtgaggaaagcagttcccacaaatgtggtgtggtaggtaatttccatctaaaattttacttgccaacatatagaattcccctctgtgggcctacgaagttccttggttttattttcccaaacaaagaaacctccgggttacaggtaccttacttactttcattacctggcacaatttgcaaaataattgcccagaactagcatattgattcacattttcacattacccatccctttttcccccccaccaagctgcagaagatcaccacttgattcacaggaataagcagggccagggttagtctaaaatgtaggcaaaaagcttaaaaacaattaatgagactagggtttaatgacaaatgtatgataagctttggagcaaaatttttctctccagtcctcatttttggtaaaaactaattatgaatgaactttaatcttatacttggcctgattatttgcatgaagtgcagcaagaatggttatttctacataggacttttggattggctttgatgaaacactgttccacaaggaatttcagattagacttttaaagctgagcccagacatgggtttgtatcctctaatacctgtgagttgggttatcctctcctcttgaggtcccaagataaactcagagcttccagacctgttagaaagtgacattcttcactgaccacaggttaggaaccctgtgtggggactgtgtagacaaggtgtgaggccagttctccccaaggggcttttattggctctgcatgtcaagcttgattccttaaagggaaacacaccctttcagttaaagccttggcaaaataaccggtttttccaattgtgttctgttgacaaagaaaaatggattcttgctgcactgatgcgaacaactatattgccgtaagttaagagtacttacagatagtctccaaattttagaggaaccaggcagagaaaaatgaacatgctccaaattttgttcacagtagtataccttacttgattattaaaggccataaatagtttaaaataagtttcctttcccagtccatgcaccaaaatgatacggctctgatgagtggaggaacaacagggttcctggtcctcatgctggtttagataaaatgacacagacacatgtggagtggttttaaggagtggagagtttaataagcaagaaggaagggagaagagagaaggaagacgctcccccttgcagagacggagcgggggttccaaagctgaaagaggaggtcccccacattaacaatttttaaaataccgtacaactgcagaaaatgaggactgcctgtacatactgtttgacactttgtttttttttttaacttatcaactttattttgtttgtttgttttggttttgggtttttgtttgtttgtttgttttggagacgagtctcactctgtcagccaggctggagtgcagtggcacaatcccagctcactgcaacctccacctctcgggttcaagcaattctactgcctcagcctcccgagtagctgggattacaggtattcgccaccacatccagctattggttttggtttttgagacagggtcttgctgtgtcacacaggctggagtgcagtggtgtgatctcagctcactgcaacctctgcctcccaggctcaagtgatcctcccacctcagccttccaagtagctgggactacaggcatgcacaccatgcgcagctaattttttctattttttgtggagacggggtctcactatgttgcttaggttggtcacaaattcacagcctcaagcagtcctcctgcctcaccctcccaaagtgctgggattacaggcatgagccaccacatccagccttaccagctatattgaagtataatttatataacataaaatttgccttttaaaattatacagtgcaatgcattttgacaattgtttacatctgtgtaaccaccatgcaatcaaaatatagaacatttctataaccttcaaaagttccctcatgcccctttgcaatcaattcactacttctccagctccaggcaacaactggtctgcttcctgtcactataaattagtgttgcctctttcagaatttcatctaaatggaatcctataacatatactattttgtatccatcttcttttactccaaagttcttgaaattcattcatgttcctgtgtgtatcagcagcgtgttccatttgattgttgagcagtattgcattgtgtggatatatcacaatgtgttcattcattcaactgttggtggacatttgagttgtgtccagtttagtgctattctgaattaaagtgatgtgaacaatcatgtacaagtatttttgtaggcatattttttttatttctcttggataaataccccaaaacagaattgttttgggggtcatatgaaatgggaagtatatgcttaactttataagaagctgccaaactatttttcaaaatggtaatatcactttacattttcatgagcaatgcataaagcgttccgcttgctacattttctcaccaatgcttcctattgtcaattttttaaattttagcaattctagtgggtgtgtgatactatctcattgaagtttcaactgtttttccctgttgactagagacactgagcaacttttcatgtgttgtctatttgtatatcttcttgaagcattcgttcatctttaactgagctgaacgccttcttaaaattgagctatgggagttttaaaatatatccttgtagctgggcgtgatggcaggtgcctgtaatcccagctactcaggaggctgagacaggagaatcgcttgaacccaggaggcggaggttgcagtgagccgagactgcaccactgcactccagcctgggcaacagagtgagacttcatctaaaaaataataattatacatgtaattatatatgatttttatatatgtaatatatatattcttgatgtgagctctttgtcacatacatattttgtggatattttatcccagactatgacttgtcttttcattttcttagttgtgtcttttgaagagcagaagatgtaattttgataaagcccaatttattttttcttttatagtttgtatttcttatgtcctattcaaaaactccttgcctactgaaaacttatgatgattttctcctatattttcttttagaagttttatagttttaccatttataatttggtctatgaatccttttgagttgatgtttatgtatggtgtatggtgtgaggtaacaatgaagattcatatttttttccaaaggaatatccaattgtctctttggaaaaatatgctgagaaggctatcttttccccaccaaataatcttagcaccttaatcaaaaatcatttggccatggacatatgtaggtgtgggttttttctgggctctctgtgttagatggatagatagacagatacagatatataactgtgtttacacatatgtaactgtaaacacagttatatatctatatatccaccaacagttgaatgagaataaactattgttataagcatatatacacattgtatatatatgtgtacatatacatattgcatatgtatgtatacatatatacacacaaagtatatatatgtatgtatacatatatacacacttaaagtaatggcctccagttcgatccaagttgctgcaaaggacattatttcatgccttttcgtggctgagtaatattccatggtgtatatatatatatgtgtgtgtgtatatatatgtattatgtatatatatatgtgtgtgtgtgtgtgtgtgtatatatatatatgtgtatatatatataccacattttctttatccactcattagtcgatggggacttaggttggtttcacatttttgcaattgtgaattgtgctgctataaacatatgtgtccaagtgtctttttcatataattacttattttcctttgggtagatacccaatagtgggattgctggattgaatggtagatctgttttttgctctttagagaatctccatactgttttccatagaggttgtactaatttatattcccagcagcaatgtgtaagtgttctcttttccccacatccacaccaacatctattgttttttgactttttaataatggccattcttgcaggaccaaggtggtagctcgttgtggttttaatttgcattttcctgatgattagcgatgttgagcattttttcatatgtttgtgggccatttgtataccttcttttgagaaatggctatttgtgtcctttgcctactttttaatgggattgtgttttatttttcttggtgatttgttagttccttgtagattctggatactagtcctttgtcagatgtgtactttgcaaagataatattttggatgttatatttccattataatttagttcaaagtattttctaatacaccttgcaatttcttctttgacccatggattattttaaagtttgttattttgtttgtttattttgagacagagtttcactttttttgcccaggctggagtgcagtggcacaatcccggctcccagattcaagcgattctcctgcctcagcctcccaagtagctgggattacaggtgcccaccaccacacccagctaatttttttttcttttttttttgagacagagttttgctcttgttgcccaggctggagtgcaatggcacgatctcggctcactgcaacctctgcctcctgggttccagcaattctcctgcctcaacctcctgagtagctgggattccaggcatatgccaccacgccaggctaattttgtatttttaatagagacggggtttcttcatgttggtcaggcgggtcttgaactcccgacctcaggtgatctgcccgccttggcctcccaaaatgctgggattacaggcatgagccactgcacccagtccaattttttgtatttttagtagagatggggtttcatcatgttggccaggctggtcttgaactcctgacctcaggtgatccgcctgcctcggcctcccaaagtgcagggattacaggtatgagccaccatgaccagcctaaagtgtattgtttagtcaccaaatatgtaagtattacccaaatatatttgtcactgatttctaatttaattgtattgtgatccaaaaatatacattgtatagtttctattcttttaaattcgttaacatttcttttatggcacagaatatggtctatcttggtgagtgttgcttacacacaactgtgtaactgaaaactgtgtattctgcttctcgtggttgttgtatcctataattgtcaactagatcaagttagtaagagtgttgttcagtgatcttttcttcttcagtgtttactgtatttgctaatcccatccagtgaagtttccatttcatatattgtatttttcacttttagaagttccatttgactctttcatttccatcctcaattatcttcatatttttctttaaatttttgagcacatttataatggaggttttaaagtccttgtctgctaattttgtcacctctgtaattcctatgatgattttcttcctggcttggggtcataatttgttgcttatttgcatgtctaataatgtttttattggacagcagacattgtaaatgttatatttttgagtgtttggattttgtctttctttaagaactattgcagtttgttttggaaggctattatgttttttgcagatcaggttgatcttttcaaggcttgtttttaagctttgttaggacaggtctgtagtaacttttgccttgggctaatttagacctaccacttaattctgacttttttgattaatctgagtgttcagcagggtctctttattatggctaaatgaaattcaaacattttccagccctatgtgaccatcaagaattcagctaatagctccctggcagttcttcgcccagctgcagaaaagtgtcagtgcactctatgtatgctcagattattatttagccaaagacttggggatccatattaatattcctggagttctttgtgtagctccattctctttagtactctatcccataaattctggctgcctcaatctcctaatctccccaaactctaatatctattcctcaactcagcaaaaccatggtgttattcttggatttcccctttcctgccccacagtctgaaagttgtctccaggcaaaaaaaatggagatcctagtttgcggatcctcatttccttctccttttttttttttttttttttttttttttgagatggagtctcgctctgtcacccaggctggagtgacgtggcgtgatctcggcttactagaaactccggctcccgggttcatgccattctcctgcctcagcctcccgagtagctgggactacaggtgcctgccaccatgcccggctaattttttgtattttgtttagtagagacggggtttcaccgtgttagccaggatggtctggatgacctcgtgatctgctcacctcggcctccaaaagtgctgggattacaggcatgagccaccgcgcccggcctgcttctcttctcttatgggttagaatcctgcactgtcttttgaacaaatgtctaaaagcttttatcacacattttgatccacttcccagttgttatagtggtatatctggtttcacatgactgaaaggaaaagttttcaccttgctttttgtactaataatatatcctggaaatcattctatataaatttatagaaatcttcatttttaaaatagcttcataaaactccattgtaaaaaccaggtgcagtggctcatgcttgtaatcccacactttgggaggccaaggcgggtggatcacctgaggtcaggagttcaaggccagcctggccaacatggtgaaactccgtctctactaaaaatacaaaaattagctgggtgtggtggtgggcgcctgtagtcccagctacttggaaggctgaggcaggagaattgcttgatttcaggaggcggagattgcagtgagctgagattgcgccactgcactccagcctgggctacagagcgagactccgtctaaaaaaaaaaaaaagcaaaaaaaaaaactccattgtatgtgcacatatcattatctgttcaacccatctatgacttgtcatttaggtagtttccatccaatatttttgcaatataaaaaatgctaatgaagaacctgagatatatatatatctatatatatagatatatatgtttgttgttgttgttgttatttttgaagtatgtacgtataataaattcctaatagtgtgattgctgcatcataaggtaaaggcatatgtagttttgttaaatatagctattccccatcttgcattcctacaaatagatgagaatgtccattgtcccatagtctcctttgcagagtatattgtcaagctttttaattgttgccaacctgatgggtaaaaagatatctccaaataattttaattaaaatttctcttattatgaatgaggttaaatagtttttcatatgtttaaaagccagtttatatctttttgtttttttagagacaggaatcttgttctgttgcccaggccaaattgcagtgatgcagtcatagctcactgtagcctcgcactcctgggctcaagcaatcctcctaccttagcctcccaagtagctaggactacagatggatgccaccatgtccagctaatttttttatttttttgtagagatgtgaggtctcactatgttgcccaggcttgtcttgaactactggcttcaagtgatcctcccacctcagcctcccaaagtgctaagattacagccatgaaccaccacaaatgaccctatatatttttttgaattgtctgttcatgtcttattttcatttttctagtagttttttttttaagtgttttagcctaaatttgtaaaaagtttaggggatatatgaagggactctaaatgtttatgaagaaatttaattaaaagataaaaataaaaatataagctttatttttcaacatgagctccatcaagttcaaggcacttttgtaagcaatgatactagccatttagttcacccctaaagaactgagagtcctgggaatttagccatgtcaatgcagtattttttatattggttactgaagaaaaaatgggtgccctttaaagttgtaagattaggaacaaaaacaagtcagaagaagccaaatcagcactgaaaggtgggcacttaatgattacccaagaaaactctcaccaaattgcccttgcttcatgagaggaatgagcgggagcattgtcgtggtcaggaaggattctggggaagttttcccaggcattttttctgctgaagctttggtaactttctcaaaacactctcataataatcagatcttatcactctttggccctccaggaagtcaaccagcaaaatgctttgaacatcccaaaaaagcgcttgccatgacatttgctcttgaccagtctgcttttgcattggtcaaatgccaccacttccacctcttgtgctttgttttcaggatcagactggtaaagtcatgtttcatctcttgttacagtttttttttttttaagaaacccttcaggatcttgatcacatttgtttaaaatttcaactgaggctgggcccagtggctcatgcctgtaatcccagcactttgggaggccgaggcgggcaaatcacgaggtcaggatttcgagtccatcctggctaacatggtgaaaccccatctctactaaaaatacaaaaaattagccgggcatggtggcaggcacctgtagtcccagctactcgggagggtgaggcaggagaacggcatgaacccaggagacggagcttgcagtgagctgatatcatgccactgcactccagcctgggcaacagagtgagactccagctcaaaaaaaaaatcaagtgaaaactctggtcttaaactgcagctgatctattttatttttattttttttcagacacagccttgctctgttacccaggctggagtgcagtggcaccatcatggctcaatgcagccttggcctcgtgagctcaagcaatcttcccacctcaggctcccaagtagctgggactacaggcacatgctaccatgcctggataatttttttgcagctaatctagatgtaatggttttggcacccatctaatggaaagtttgctcaactttaatttttcagtcagaattgtgtaagctgaaccgagatgtctatggtgttggctattgtttctgctgttaattgtaggtcttctttaattagagcacagacaagatcattttttttcctcccaaattgatgtagatggtcttttgctgtgggcttcatcttcaacattgtctcatcccttcttaaaacaagctagctacttgtaaactgccgttttctttggagcattgtctccataaacttttcacaaaacatcagtgatttcaccgttcttccactcaagcttcatcataaatttgatgtctgttcttgtttccattttagcagaattcatgttactctgataggggctcttttcaaactgttatcttattcttcttagtgcctcaaactagatcctattcagacatggtataacaagttagtatgggtttattttggtgcaagaaatattttgaaatccacacatttttttcataatatgcattttccatgaagtttttgaaaactccttgtattaggaatattagtcctttgtccagtaaacagactgcaaatattttctcacagctcatcatttaccttttggcatttttttgcaatgcaatttttttccctttgtttttgttttttgtgtaatgaatcaatgttttcttttttttttttttttagaccaagtctcactctgtcacacaggctggagtacaatggtgcaatctcagctcactgcaacctctgcctcccaggttcaagtgattctcatctctcagcctcccaagtagctgggattacaggcacatgccaccatgcctggctaatttttgtatttttagtagagatggggtttcaccatgttggccaggctggtctcgaactcttgacctcaagtgatccactcacctcggcctcccacagtgctgggattagagacgtaagccactgcccccggccaaatcaacgttttcttatattgcatttaggttttaagtcatagttagaaagcctttccccacacctaggttatagaaacattcattacttttttcttccagtgctagtacttgcatggtttttggtttccacatttagatccctgatctaattggagtttattcttttgtgtgctgagatatggatctgattatatcttttttcccaaatggctatccagttgtcccaatgccatttattaagcacttcatctttgtcccagtgatttgagatagcatctttatcatgtaccaaacttctatagtgccagaagatttttattttttttagacagggtctggctctgttgcccaggctggagtgtagtggcacaatcccagctcgctgcaacctccgcctcacatgctcaagtgcccgcacctcagcctctcaagtagctgggactacaggcacatgccaccacaccaggctgatttttatatttttttgtagaatgagatttcaccatgttgcccaggctggtctcaaactcctgagctcaagaaatccgcccacctcagcctcccaaaatgctaggattacaagcatgagccaccacacccggctgccagaaaattttaatgatcagaaaaccacaattctttcttcctctgttatatgttgaagtaaaatacttcatttagaaaactaagccgggcacagtggctcacacctgtaatcccagcactttgggaggttgaggcaggcagatcacctgaggttaggagtttgagaccagcctggccaacatggtgaaaccctgtctctgctaaaaatagaaaaatttgctgggcatggtggcgggtgcctgtaattccagctacttgggaggatgaggtaggagaattgcctgaacctgggaggcagaggttgtggtgagccgagaccacgccattgcaccccagcctgggcaacaagagcaacggtaaactccatctcaaaaaaaaaaaaaaaaaaagaaagaaaaaagaaataactcagccatacaaggctacccatttggtgagaactaataataagttagatagcaaggtaatagcaaaatgtgggtgcaaaattaaagcaagttatttctgaggagaatgtaggtctcatggaagattttcatgtggacaaatttagtaaattttttgcaggtagtttcctgacatatttaacatttgtgatatagtaaacaataagaaggtactaaaggctgggcgcggtggctcacgcctgtaatcccagcactttgggaggccgaggtgggcggatcacaaggtcaggagatcaagaccatcctggctaacacggtgaaaccccgtctctactaaaaatataaaaagttagctgggcgtggtggcgggtgcctgtagtcccagctactcgggaggctgaggcaggagaatggcgtgaacccgggaggcggaacttgcagtgagccaagatcaagccactgcactccagcctgggcaacagagcgagactccatctcaaaaataataataataataataaggtactaatatgatccagactagaagagaatagcactaaaatgggagatggggtaaacctgtggttttttttaccttaggcttttgacttccaaaattattgtttttgctgggtgcggtgggtcactcctgtaatcccagcactttgggaggccaaggtgggaggattgcttgagcctaggagtttgagaccattctaggcaacaaagcaagaacctgtctctaaaaaaatttaaaaattagccagaaatggtggcacatgtctgtagtcccagctacttgggaggctgaggcaagaggattgcttgagccttttgaagttgaggcttcagtgagccatgatcaccccactgcactccagcttgggcaacagagcaagaccccatctcaaaaaataaaacaaaatagactgggcacgatggctcacgcctgtaatcccaccactttgggaggctgaggtggatggatcatgaggtaaagagatcgagaccatcctggccaacatggtgaaaccccgtttctactaaaaatataaaacttagctgggcgtggtggtgcacacctgtagtctcagctactcgggaggctgaggcaggagaatcgcttgaacccgggaggtggaggttgcagtgagccaagattgtgccactgcactccagcctggcgacagagtgagactctgtctctaaataaataaataaataaaacaaaataagtaaaataaaataaatgtttgtagttccaaaatattttgatgacataatttcttcttgttctaataaaactacatatgcattggtcctatgacctagtaatcacactattaggaatttatcataaatacacacctcaaaaattacaaaaatacatatataccagcttatttattacagcgttatttgtaattgcaaaaacattgtagatagaatggaggtcacataaaacttattcttaagattcagaccgggtgcaatggctcacgcctgtaatctcggcactttgggaagccgaggcaggcagaccacccgaggtcaggagtttgagaccagcctggccagcatggtgaaaccccatctgtaccaaaaatacaaaaattagctggtcgtcgtggcacgcctgtaatcccagctactcgggatgctgaggcgcgagaactgtttgaaccccggaggcagagactgtagtgatctgagatcatgccactacattccagtctgagcaacagagcaagacttcgtctcaaaaaaaaagatcatagatcatcttatcaaatcaaagtatgcaaaatattcaagtaaacttcagataaatatgaaggctaaaccattcagcttcttcaccaaacccttgaatgtcccacctgtctaaatggagatacatgtttgtttgatttattggttaactgtttttattccatttttcctcaaatgatcccataatttgaccttaggaagctgttcaaatagacacattaggttgaatggaaagactactcgatgatatttaggattttaagaggattttatgtattttttccttgtgtgcaataatttaatagcatcttgaataggattttctgatattactaaccctctgggaataatattaggtaattagacagttagctaatattaaaatatgtatcaggtaatatttattgagagtttcctctgtgccaagcaggatcaacttcataggcaggcgacctgtgcggggacacagggcttcatgcttagataggcccccttgctttgaaggcccctaccctttggttagggctctgctgttaccatcttgaaattcttaataatttttattttatttttttgagtcagggtcttgctctgtcgccctggctggagtgcagtggactcactacagtcttgaattcctgggctcaagcaatcctcccacttcagccttctgagtagttaggacgacaaacacacgccaccatgctcagataagttttttgtttgtttgtttttttgtttttgtttttgttttttgtagagatgggactgtccctatgttgctcaggctggtctcaaattcctggcctcaagtgatcctcccacctcagcctcccaaagtgctgggactacaggcatgagccactgtgcctggtcaatcatttttattaacaagcccaagccctcttttttttttttttttttttgagacagggtctccctctgttgtccaggctagagtgcagtggtgcgatcttaccttcactgcaacctctgcctcctgggttcaagtgattctcctggctcagcctccctagtagctggaattacaggcacccacccccatgcctggcaatttttttgtatttttagtagagatggggtttcaccatgttggcaaggctggtctcaaactcctgacctcaagtgatccacccaactcggcctcccaaagtgctgggattacaggtatgatccactgcgcccggcctccaagccccctatttttattttgcactgaccctacaagttacgtagctaggcttagttatgtttttagcaaggaaagtgtataatctcatgtaccttttgaaagattactcaggtctctgcatgtgaaatggaatttagggaatgcaagagagggagtaaaaataacagcgaggaagctatgatagcatttaaggttgctttgactcaggggtagcagtagatagggtaagtaattgatagtttcaaaatatattttgggagtagtaagcattggtatggattagtaatatactggatgtggggatgcagaaaaaaatattaaaaattacttctgaaattctggctggaatagaagtgccacttaccaggtaaggaaggttggagacataacatatttgagggtgtggtcaaaagatgagtttgacattatgctatgtcatataaaagacatataaaagactacctattttataattcctttttaataaaatattcagaaaaagcaaaactgtggttgcctgaggctgaagctaggaagattgactacagacaagcatgagggaaattttgggggtgatgagagttttctaaaactggattgtggggttggttgcattactgtataaatttattaaaaatccctgcatcgtataggggcactatattgtatgtagaaagctgtgaaaagattttaaaaatgattgacatgtctgtggttatatcaatgagtactattattattcccattttatacataaagaaaataaaagagaagttaaaaataaaagtttcatggttacatagctactaggtgtaatatccagtattggaatttgaatctttttgacactaagaccttactctcgatcatataatacattcactttctattttaaagttatattatagccgggcgcagtggctcacacctgtaatcccagcactttgggaagccgaggcaggcagatcacgaggttgggagatcgagaccatcctggctaacacggtgaaaccccgtctccactaaaaatagaaaaaattagccaggcgtggtggcacgcacctgtatcccagctactagggaggctgaggcaggagaatcgcttgaacccagaaggcagagcttgcagtgagacgagatcgtgccactgcactccagcctgggtgacagagtgagacaccatctcaagaaaaaaaaaattatattataaatgctgcatctcattggtcagaagctctcttgaaattataaaacaaagaagaaaaaagataaagactgggaaattgtgttgaatcagtatataaatcctgtatactggtccttccatttcccctagaaataagtgatacaggccaggcgctgtggctcacacctgtaatcccagcactttgggaggcggaggctggcagatcacctgaggttgggagttcaagatcagcctgaccaacatggagaaacccccgtctctactaaaaatagaaaattagctgggcatggtggcacatgcctgtattcccagctactcgggaggctgaggcaggagaattgcttgaacccaagaggaggaggttgtggtgagccaagattatgccattgcactccagcctggggaacaagagtgaaactcaaaaaaaaaaaaaaaaagaaagaaaaagaaaaagaaagaaggaaggaaggaaggaaagaaagaaagaagtgatacaacaagttacagcatctttgtttattatccactgtgagttgtattaccacactttacttggctctttggcaaactatattatctcttcagatcactagggctaggaaggcccactggtaacttgaaggagtaaatgtatcttctaaaaaatgcttacttccagggagattggatccacacaagtgaatacatatatagtccttagtgtatgctatgattattttactatgtcagtagcataaagattgctatattaataagcattaagtgcctgctgtgctagacagtgaggatgcaagtggccaccaaaatagcatggtccctgccctcctggagcttctttttttcttcttcagtgggggaagcagatactttgcttatgcaaaaataattataaaatttaaagttgtgccaagttcaatggaaaaaatataaggtgttctgagagagcataacaaaggatcctggttttaactggggcctaatggaagacctctattaggaaataacatttaaactaagaccagacagacctgtagaaattagcaaagcaaagggagggaggaaaaagcagctttcctggcaaaggaacaatttgtgtgaaggccctgagacagggaagggctggggttctgaccaccctccaagtggtgcaatggaatatagtgagagagggagaagacatgagaacttggatactatgcaaaggatttggtattttaattcaagagcagtatgatgctactgaggagcagctggacaattgtgtgatccaattaaaattttaggaagatgaacctcgctattgtggagaatgcatacacaagggttctgttggttcatgaagaggtcttaagaaaactatgagctgggtgcagtagctcaggcctgtagtcccatctacttagaagtctgaggcgggaggatcccttgagcccaaggagctggaagttacagtgagctatgattattccactgtactccagcctggatgacagagcgagatcctgcctcagaaacaaaaaccaaaaaacaaacaacaacaaaaacaacaacaacgaaaatctcagaaaactacaggccttattatcaagaaaatgacaggccttattattgagaaaactacttacatttttaaaagctgattttcaaaaaccagattgtgaattaagtgatgctgaataggggaaaaaaagactgataaaccagtgtatctctgaataacccactagatcagtgcttgtcaaactttaatgtgttttcaaatcaccctgatgttttgttaaaatgtaagtcatgtctcagtaggtctagaggagggcatttctgcatttctaacaagctccccggtgatgcctagaccattggtcctcacactttgagtagcaagtgattgggctatactctttattctaaattctaaatgtattctatcttctaatgcctatcagccctcttgctggtctggctaattatcaaacttgagcatttaaaactgggggttttcagagattaattgaagtgttaaagacatggaaatataggtcacatatggcttttcatctcttccggaaatatcctatatatccttacttcttttctacctacctaacctatgtgcctaccccttcacttatgttcaaggttctattatacttcaaaaggactctatgcaatcaaagtgatgtccaagacaaatatacagaaatagtatgaggctctaacactttacatctaatggagtggtttgcatcattaattgaggcttactctgtgccaggcactttacctgccttcttcatttaataggataggagcaggaactcttagaggttcatttcttgttcaaggatatacatctcatctctggcttatatcacagtggactcttttattcactatcctaatcattataattttgtttggtgacaacaattctaaatgcagaaaagttaaggctctttattctgtgactaaaggctttgtattttctaaagatttgtggagctttgctgccattatttcaataattttataaagatcctaggtggtaaataggcctggctttttttctttttgaaatcttctccgtcttcttcttcattagcagtgcaacttcttgtggcatatggtacccaagatcttgggaaaaggattgatcaagtaaagggaaacgatagagagagtgtgctctacaactgagatcatgctccttgtgaaagacagggtagggaaatttcttattgctccctggttcttaagaaatgagagctaacaatgacatccagttttaaaagaaataaaatctgaattgtacttttaaattttataagccagagttaaaccaatagattgtaactcctgctaatttgatagtagctccagataatgaggaagtgacagggaatgctaatttcatttggtaagagataaaactgaaattattaatgtctccacggaaatgctaaatgcctccttacaagtagggtccggctaattgtctgtcttccaacaagccagatttgttggtgtttttccagacaatgttgtgtagttttcggtttggttcgatcccctttcttgtgatcaaagaaagtgattcaaatgtttaatgagtcttgatttggattggagacttgcagaacggctagcctcacagccccaaggctggctttccctaaggtaggtttcctatgcaccgatactggcaaggcgctttggctggaaactctggaaggaagccaaaggaaagtgaagttcctggcgctagcgcgtgtcctgctcagagagcccggcgctagctcattcttcgtgcagttattggctgggactctgtgtgccgctgtcggccaatgaagacgctggagatcgggcccctgcccgtcccctttctgcgccccgggatgaggcagagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattgcaaagtgttggtggaggttgtggatgtgaatgacaacgccccggagatcacagtcacctccgtgtacagcccagtacccgaggatgcccctctggggactgtcatcgctttgctcagtgtgactgacctggatgctggcgagaacgggctggtgacctgcgaagttccaccgggtctccctttcagccttacttcttccctcaagaattacttcactttgaaaaccagtgcagacctggatcgggagactgtgccagaatacaacctcagcatcaccgcccgagacgccggaaccccttccctctcagcccttacaatagtgcgtgttcaagtgtccgacatcaatgacaaccctccacaatcttctcaatcttcctacgacgtttacattgaagaaaacaacctccccggggctccaatactaaacctaagtgtctgggaccccgacgccccgcagaatgctcggctttctttctttctcttggagcaaggagctgaaaccgggctagtgggtcgctatttcacaataaatcgtgacaatggcatagtgtcatccttagtgcccctagactatgaggatcggcgggaatttgaattaacagctcatatcagcgatgggggcaccccggtcctagccaccaacatcagcgtgaacatatttgtcactgatcgcaatgacaatgccccccaggtcctatatcctcggccaggtgggagctcggtggagatgctgcctcgaggtacctcagctggccacctagtgtcacgggtggtaggctgggacgcggatgcagggcacaatgcctggctctcctacagtctcttgggatcccctaaccagagcctttttgccatagggctgcacactggtcaaatcagtactgcccgtccagtccaagacacagattcacccaggcagactctcacggtcttgatcaaagacaatggggagccttcgctctccaccactgctaccctcactgtgtcagtaaccgaggactctcctgaagcccgagccgagttcccctctggctctgccccccgggagcagaaaaaaaatctcaccttttatctacttctttctctaatcctggtttctgtggggtttgtggtcacagtgttcggagtaatcatattcaaagtttacaagtggaagcagtctagagacctataccgagccccggtgagctcactgtaccgaacaccagggccctccttgcacgcggacgccgtgcggggaggcctgatgtcgccgcacctttaccatcaggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacaggtaaggtttagcaagtcatgcttgaccctgttagtgcttttttattcctacatcatattgaggaaggaatggagctgtttttttagtgatgaagatgttttcctggtgatgcattcacactttcaactggcccttcctagatcaaagttagtgcctttgtgagatggtggcctgccagagtgtggtttgtggtcccatttcagggggaagatacttgactcatctgtggacctaattcacatcctcagcactcttttgctatcacaactaaccaatcttgctaagggatggttaagctaaaacacaagatctcagcgatcagagtttagcttggtatcatttacattaggaataagctgctggatacctctaaccagtggcagcttctaggaatacaaaaactacctcattcctccacctttcaagtgattgtgacatttgtattaaaactaatagctttttgataattttcctttgtttatacagatcgtgtacctcattctcagataattttttatgaatgaaatgaaattccaggcatcctttaaattttatttcaagcattctactggaaatgatgtgcaccctgcttacaaaatatttttaccttataacagtaatgcatgtttgctagaaaattcagaaaatacagaaaagtatttaaaaaattaaaactataatctccaaacccaaagataaccatttttaattataaaagtaataatttatttcaaaaataaatctaggcaacccaagaaaacataaagtagccagactcagtggtgtgcacctgtagttcttgctgctcagtgcctgaggtgggaggattgcttgagcccaggagttctgggctgtggtgcactatgctgatcaattgatcaatccactgtctgcactaagttcagcatgaatacagtgacctcttgggagggcaggaccatcaggttgcctaaagaggggtgaactggcccaggttggaagtggagaaggtcaaaactgctgtgctatccagtagtgggatgacatctgtgaatagccactgcactccagcctaggcaatatagggaaaccatgtctctttaacaataacaacaacaacaacaacaatcccagaaactacaaaaggagagtctttttggtgcctccagtgttagtccctgtccttccagccttatttttcttaagtatatgcacaatgtgaaaggtagataaattcatatccttagacaggtaaagcattcattaattcagggtggtatgcaaggatactatccaaggcatggtatccatgcaaggtgactgcaaggcctttgccctggagagaaccctatacatactctcaactgtaggagaaacactgttattttgttactcagtgcatcattgctatcaactcttggatttggcagttagtcaaatgaggttctaccatttaccaactaggagtctgtggccaagttactcaatctcctttctaagcctcttcctcatatgcaaaaagggaataataagtgttttataagattcatgcatgatataatgtatgcaaagtgtttagcatggtgcctggcatatcataactgttaaacaattattagccagctcctagcattttgggaggctgaggcaggcggattgcttgaggccagcagttcaagaccagcctgagcgacatagtgagatcctgtctctacaaaaaaaaaaaaaaatgtgttttcattagctgggtgtgttggcatgcacctgtggtaccagctacttgggaggctgaagtgggagaattgcttgagcctgggaggttgaagctacagtcagctgtgattgcaccactacacttcaaccatggcaatagagtgagaccctgtctcaaaaaaaaaaattatcagctattactataattatttttattagttcctcactcacctaaaatctcaaacacaccttagaaatacacatatgagaacaaccaaaaatgacaaagtagaagcacatatgaaaaggctaagaaagcatgaaagccagcaagaaataactgccgctcttctggtcagcctggaaagcaactggcattttccctagaacaatgttttcaaacttggttgcacattaaaatcacctagagaccttttaaaaattctgaaacccaggccacaccccgacaaatgaaagcacagtctctgggggtgggacataggcatcattttttgaaggtccccacttgatcctaatgtgcagacaaatttgaaaaccacagctttgggaggctgaggtgggtggatcataagatcaggagtttgagaccagcctggccaatatggtgaaaccccgtctctactaaaaatgcaaacattagctgggcatggtggcgcatacctgtagtcccagctactctagaggctgaggcggaagcatcagtgagggagaatcagtgaacccaggatgtggaagtttcagtgagcccagatcacaccactgcactccagcctgggcgacagagcgagactccacctcaaaaacaaaaagaaagaaagaaaaaagaaaagcagtactctggaacctaccaatccatcatttagcatatttgtgaagtaaagtgttattctggtatttgcagaaccagaatccagctttattgggccaggcccaatttttttaaaaaacatggtaaggtctcccagccttaaagtattacatagcatagctctaaaagatcactgtaggaagacataaaatggtatttcagtcatctaagggaaaaaccttcctaaagcactagcccctggacaactattatttaaacatctacagctgttcaatagatattgggttctttttggagggatgtgacaaaattcttgtataattagattgtgatgatgattgtatcagtttagtacatgtaaatacactgaaaaccattggattatacactttaaatatgtgatttgcatggtatgtgaattatgtctcagtaaaaatctagagatggggctgggctcagtggctcacgcctgtaatcccagtacttagggaggctgaggccagcggatcacctgaggccaggagttcaagaccggcctggccaacatggtgaaacttcatctctactaataatacaaaaatcaggccgggcctggtggctcacgcctgtaatcccagcactttgggaggcggaggcgggcggatcacgaggtcaggagtccaagaccagcctggccaacatggtgaaaccccgtctctactaaaaatacaaaaattcaccaggcgtggtggctgaggcaggagaatcgcttgatggtggaggttgcagtgagccgagatcgcgccactgcactccagcctgggtgaaagagcgaaactccatctcaaaaaaaaaaaaaaaaaaaaaatcagccagatgtggtggcaggtgcctgtagtcacagctacttgggaggttgaagcaggagaatcgctttatctcaggaagcagaggttgcagtgagccaagatcatgctgttgcattccagcctgggcaacaagaacaaaactcactccatctcaaaaaaaaaaaaaaaatatctagagatgggagaatcatatggctggcataaaaaggtcaagtcaaagatatgtaagattaaggctttacgatgctccagttctagtaaaacagaccaggtacttgttttggtgtgaaattgccaatataagtatagtactgtacatattagttgtttagcttaggtaagtcttttaatctctttaaactccagtttcctcatctataaaataaagagaatatctactttgcaaacttgttgtgagagtgaaaagtaatgcatataaagtccctgtatggagcaagtactcaataactatttgttgaactaaaaatgataatactgatattcaccatttattagcatccctatgtgccagacactgtaaacaattaaaagttatcattctggtacccagagtacagtatgagacagacatgcaaaaaaaaaaaaaaaaaaagataatggagatctgcatagcataagatgcagtgggaccaaacgggaaaaaacacctaaatgagcctggagaaaggaagaaatgatagaggtggtgatgcttgagctatgatctaaaggttgagtagtagcttgtcagacagtaaaggggaaaggacagggcagggaggggccattgcaagaaattccatgcagagggattatggtatttcattatcactgaaccttaaactgtgtgtgtggccgggtacggtggctcatgcctgtaatcctagcactttgggaggccaaggtgggcagatcacttgaggtcaggagtttgaaaccagcctggccaacatggtgaaacctcatctctattaaaaatacaaaaaattagccaggtgtggttgtgggtgcctgtaattccagctacttgagcagctacttgagaggtcgaggcaggagaattgcttgaacccgggaggcagaggttgcaatgagctggtgtcaggccactgcactccagcatgggcaacagagagagactccatctcaaaaaaaaagtgtgcgtgtaaaacagacagtctttgtaggagatgaggtgaagcaagtaggcaggagttagatcctgagttacctttgggccaagccaaggagtttttattttattccatatagatgacagtcactgcagaaatttgaactgatatgcatatatcatgaggtttttttgttttagaaatattattctgtcagtcataagtgaagggactggggacattgggactggaggcaaagagatcttatctctttgcaatagtttgaaagctattgcaatatttgaagagaagattgataaatgcttgaaccagcacagtggcagtacagatggagggagctgactacaataaaatcatcaggacttgttgattgacatgatataggaagtgagggacagggatgagtcaaggctgatccccctagatcctgactaaggaagctgggtggttgacagtgccattcacagagacagtgaattctggcataaacacctaataggtcaggctggtttacacctccatcattcccatgggagaaggtatagaggggtgtgtgtttgtgtgtgtgtgtgtgtgtgtaaaagaacacagaaagccagattcctctttttgacaccagaatattggttcccaccatagtcaaaaggatattcctgaggatcgaggcttggaaaaatattggggaaggataagaactccagttgttgctgctttttttggcagccagtgtaacctaggtaaggacttggttgaattaagaaatttcatgtccagatcaggatggatttttctatttctctgagctctggtgtgtttcccactcagattgcaggtcgtaggtacctacggtgtgaattgtgttgtgtttctgtgcttgtgcaagggagtagctaggttgctgggaggtctggatgagggtgggggtggggtgagatcaagtctccagctccaagaggtcccctggggctaagtgaaaagcttgctcttttgaaatggtcttcgttggtaattaacaaaagatcaagaataccttggtgtcagataaagggaatttgtaggcacaatgctgttggtagctgatctcaatcattcaaggaagctattaaatctatgaacattagcattctgccaggtaaagagatctggtccttagcacctcccagacacactgattctttactgttttgaaacatctccctctcctggcttcctccaccccgcttccatactgtccttgaaatcaatgaatggtaatttagtgtatctagtgtatcactagcaaatgtctgaataagaaaggtttggtttccgctgtgtctcctgttacaatgagaacatgtactgcataaatttaattggctacgttaatgtgtaagccttttctgcaaagagatggatccgtttctgaatattctgcagaagggcagagttttgagtatatggcagtggttctaattagcagttgctccaatacaatcagactgagacggaagctactcatttagaatactggttgatgacaacactggcttgaacaaagtgaccactctccaatggctactctccctctcagtgggccgcaggttgctagggctcaggctgtggctgttttccccgccgaaaaggggcggggtcagtcggtgtgttaggaaaaaaaatgtatatatatatatatgttgtctgcctccccacagagataacaacccgtggaaaaacatgccgttgagcgggaggaaggcgaaaagataggctgggttttttggggggtgggggagcgtggaggatagggtgggctttttcccctccaatgctgcgacgcattaaccctgctgctgttgggacgttctctgctcagcctattggctgagcccgggagccgctgtctgccaatcgggtggtgaaaggcagacaaatctaccccgccaccagcaaaaacggcgcgtaacccttgcggcgccggccgaaccgcgccagagctggcgcggggaaagggagataggtgtctccagctgctgtggctgtttggggcgggtcggcttcatccgcgtctcaggagcaagtagagaattagcgggcggcagcaatgctccgcaaggtgagaagctggacagaaatctggcggtgggctacccttttgttcctcttttaccacctgggttacgtttgtgggcagatccgctacccggtcccagaggagtcacaggaagggacttttgtagggaatgtcgctcaagatttcctgctggatacggacagtctgtcagctcgcaggctgcaggtcgctggagaggtgaaccaaagacacttccgtgtggatttggacagcggagccctgctcatcaagaacccaatcgaccgagaggcactgtgtgggctcagtgccagctgcatcgtgcccctggagtttgtcaccgaaggtcctttggaaatgtaccgagcagaggtagagatcgtagatgtgaatgatcacgccccccgttttccgcggcagcagctggacttggaaattggggaggcagctcctccaggacagcgtttcccgttggaaaaggctcaggatgcagatgtggggagcaattcgattagcagctataggctgagctccaatgaacactttgcactggatgtgaagaagcgcagcgacggcagcctggtcccagagctgctcctggagaagcctttggatcgagagaagcaatcggactaccgcctggtgctgactgctgtcgatggagggaacccgccgagatctggcaccgcagagctccgggtatccgtgctggacgtaaacgacaacgccccagccttccagcaatccagctacaggattagtgtgttggagagcgcaccagcgggcatggtgctcatccagctcaatgcctcagacccggacctgggtcccagtggtaacgtcaccttttatttcagtggtcatacccctgatcgtgtaagaaacctctttagcctgcaccccactactggaaagcttactcttttggggcccctagactttgagagtgagaattactatgaatttgatgtgcgggctcgcgatgggggttctccagccatggagcaacattgcagccttcgagtggatctgctggacgtaaatgacaatgccccttacatcacagtgacctcagagcttggaaccctccccgagagtgcagaacctggcactgtggtggcacttatcagtgtgcaggatccagactcagggtcaaacggagatgtgagcctccgcattcctgaccacttgccatttgccctcaagtctgccttcaggaaccagttctccctggtgactgctggacccttggatcgagaggccaaatctagctatgacatcatggtcactgcttctgatgctgggaaccctcctctcagtacccacagaactattttcctcaatatttcagatgtgaatgataatccaccctctttctttcagaggtcacatgaggtgtttgttcctgagaacaatcgcccaggggacctgctttgctcccttgcagcctctgacccagactctggcttgaatgcgcttatctcctactcactcctggagcccaggaatcgagatgtatcagcttcctctttcatctctctgaacccccagacaggagctgttcatgctactcgatcctttgactatgagcaaacccagacactgcagtttgaggtgcaggcccgggatcggggcaacccaccccttagcagcactgtaacagttcgtctatttgtgctggacctcaatgacaatgctccagctgtgctccgtcctcgggcccggcctggttccttatgtccccaagcactgcctccatcagttggtgctggccacctaatcacaaaggtgactgctgtggacttggattcaggttacaatgcttgggtttcctatcagctcctggaggccccagatcccagcctgtttgcagtctctcgatatgctggggaggtgcggacggctgttcctatcccagctgacctcccaccacagaagctggtcattgtggtaaaggatagtggtagtccaccactctctacctctgttactctcttagtgtccttagaggaagacactcatccagttgtcccagatcttcgagaatcttcagctccaagggaaggagaatctcgtctaaccctctacttggctgtgtccctagtggcaatttgctttgtctcctttggctcattcgtggcactactctctaagtgtcttcgtggggcagcctgtggagtcacatgctttcctgctggcacctgtgcctgtctcaccagatctcgaaggagggaggggcttcccccttccaatgggatcctccgaatccagctagggtcagatgaccctatcaagtttgttgatgtgggaggccactctcatggctgtacacccttggcttctgcacccactcggagtgatagcttcatgatggtgaagtcacccagtgcacctatggcaggggagcctgttcgcccaagctgcccaccctctgatcttctctatgggctagaggtgagacctttgcaggctcaacaaatgcttgagggttattctgatccaggcatatggctaggccatgtcctagagagtactggcctctcagtaagtgcccatagtgatgtcaccatttttgtaagaggtaactatgtggtagacgctgtgctttgtaactgtttcgtgaattaaccagagttgtcacagtttagcattgggggcgggtcatgcctatatctgagtaagaaatgaaagtaattggtgatcaagagccaggctgttgtggaagcatgatgatggaatgtgggagcacaggaggctacagtgcacagggtacagtgcaccaggcagtcacttggacaaaggtggctgttttctctactcttcctgaaagaggggatcagattctgaagtaccttaactctaggttaccatttcccaagggattgaggggaaataaaatctttgtctcccagtatctagtacactgtgaagggacctctctatttgaaacatagagacagcagaaagaggagagaactaaaggaatagagaggcacgcatcagagtggtggcatagatcttttggtctgggtcttaggactcatatcaagtccctactggggatttgaactagatgcggtaaattggaaggttggggcgggttggtcatcacctttggaaaaaacagtaagtgaaatcacttatgtcagaaaactggtttacagttggctgattcatagaaacagccaccctgtgcatctttaagttgagttctcctgaatttggtgaaaccatgaaacctagaagccaagccatccatgcttggcctctgaccaccctcctgggtgacctgattcagccccagaaatgttcccctacccaaaaactgtaacactcattccacatttggggtctggggtgtcagaaaagctaagtcccatgtcagctgacattgagatttccgcaaagcattgctggagagtcagggcaagactttacaaggttcttactaatcttttctctcaccttagcagcattcagcaggatgggggagggtgggggaatacatgggctttgcctctcccagaaggacaagattttgctggttcaagcaaagtggtggaagcttctgaagtcatgcaggaagttgctgggacagaacgctgaggagttttgtatcactttgtcttccctgttgagtaccatctgagctgtcaaactttgctgccaagggggctgaatcaacctgcagcacgaagtgagtggggaggtaggaagcttctgtgacacagatttgcagcctgtgttcccaaggtttccaggattgaggaaactccataattggttgagagcacacagactttttggccaatcagactcagagctgaggtgggagatctgctcttccagcccgcctctcctcctccagctccccagctccactcaaattcagctcccctcccccctgcccacccccgccactcggtgactaagaactgctgcaagcaggcaaacctccgagcagtttttaagaggctggaaggagacataagagacttcagctgctgcattccaagccctgggtctaccttggagacaggacagcacagacttactctccacaaagggacttctgggtcatggggcccaagacactcccacagctcgctgggaaatggcaagtgctgtgcatgttgtccttgtgctgctggggctgggtgtctgggcagcttcgttactcagtggtggaggagtctgagccggggacgctggtggggaatgttgctcaggatctgggcttaaagatgacagatctgttgagccggcggctgcaattgggctctgaggagaatgggcgctatttttccctgagcttgatgagtggtgccctggcagtgaatcaaaagattgaccgagaaagcctatgtggagccagcaccagctgcctgctgccagtgcaggtggtgactgaacaccccctggagctaatccgtgtagaggtagagatcctggatctcaatgacaactctcctagctttgccacccctgagcgagagatgcgcatctcagaatcagcagcatctggggcacgattcccactggacagtgcccaggatccggatgtgggcaccaatactgtgagcttttacactctaagccccaacagccacttctctctgaatgtgaagaccctaaaagatgggaagccattcccagagctggtgctagagcagcagctggatcgtgaagcccaggcaagacatcagctggtgcttactgctgtggatggggggaccccagcccgctcagggaccacccttatctctgtcatcgtgctggacatcaatgataatgctccaaccttccaatcctcagttctacgtgtgggaatcccagagaatgcacccattggtactctgctgctccgcctcaatgccactgatccagacgagggcaccaacggccaactagactattcttttggagaccacacatctgaggcagtgcggaacctctttggcctagaccctagcagtggggcaatccatgtgttgggtcccatagactttgaggagtcacgtttctatgaaattcatgcaagagcccgtgaccagggacagcctgccatggagggccactgtgtgattcaagtggatgtgggggatgtcaatgacaatgccccagaggtgctattggcctctttggccaaccctgtcctagagagcacaccagtgggcacagtagtggggttgtttaatgtgcgagaccgggactcaggtagaaatggtgaagtgagccttgatatctctccggacctgccatttcagattaagccttctgagaaccactactcgctgctaaccagccagcctttggaccgggaggccacatcccactatatcatcgagctgctggccagcgatgctggttcaccttccctacacaaacatctcaccatcaggctcaacatttcagatgtcaatgacaatgcaccccgcttcaaccagcagctttacactgcttacatcctagaaaaccggcctccgggctcccttctttgcactgtggctgcctcagatccagacactggggataatgcccgcctcacctactccattgtaggaaatcaggttcagggagccccagcctcctcctttgtgtatgtcaacccagaggatggacggatctttgcccagcgtacctttgactatgaattgctgcagatgctgcagattgtggtgggggttcgagactccggctctcccccattgcatgccaacacatctctgcatgtgtttgtcctagacgagaatgataatgccccagctgtgctgcacccacggccagactgggaacactcagccccccagcgtctccctcgctctgctcctcctggctccttggtcaccaaggtgacagccgtggatgctgatgcaggccacaatgcgtggctctcctactcactgttgccacagtccacagccccaggactgttcctcgtgtctacacacactggtgaggtgcgcacagcccgggccttactggaggatgactctgacacccagcaggtggtggtcctggtgagggacaatggtgacccttcactctcctccacagccacagtgctgctggttctggaggatgaggaccctgaggaaatgcccaaatccagtgacttcctcatacaccctcctgagcgttcagaccttaccctttacctcattgtggctctagcgaccgtcagtctcttatccctagtcaccttcacctttctgtcagctaagtgccttcagggaaacgcagacggggacgggggtggagggcagtgctgcaggcgccaggactcaccctccccggacttctataagcagtccagccccaacctgcaggtgagctcggacggcacgctcaagtacatggaggtgacgctgcggcccacagactcgcagagccactgctacaggacgtgcttttcaccggcctcggacggcagtgacttcacttttctaagacccctcagcgttcagcagcccacagctctggcgctggagcctgacgccatccggtcccgctctaatacgctgcgggagcggagccaggtgaggggctcggcgccgccccgggcgacccctgggggcggcactggagaagccgcccgtcctcataagggattgaacttgcatccactcctctccggccggcttggtcgctggctgcgctccacccgattctcgggatcattggaccgtttgcgcgaaaccagagtggccgattaagggatggggctccgagcaccgggggtggtggcgactgtgggcgaggggaggtgggaccgacccccacccctacactcaaaaaaggccggggcctccttcgagcttccggtgaatttcgggcgatttccgcgggtgtcgggggtcccgggaggaggcagtcacagatccacccctgcagccagcctcctaggcgccggctccggcacgcttcgccggtctgtagatttcctcttcgatttctccccagctcccagcatctgtgacttcactgttaccctccctatccccgcatcacccaaccgcacctgtctgcgggacttaggtgtgcgcgcggggctcatgcgtgtcctccctgctggccacccccacggcccacacaagttgcacgggctcgccacgccccgccaacacgtgcgcggacgcacgcacgcactcctcgcacgtgggcttacgcgaataccagctttcactgccactcgctcgcggccagattcacaggcctgttccggtccactcgcagctcccctctgccgctccctccgccgggctcaggagtactcgtagctgattgtgcgcgcctgagggtcccagatcgcggccgcccaggaccaggcgaggactccggagcctcctctcacctctcccacctgcgccccgggctgggccgggtcgcctggggggcggcctgagcgaggcgcggggccaggagcgctggagcgactgccgctctaagtgccgggcgggcaggactctacgatccttgggccagaggtccggatggtcccgggactccgtctcaagggtcggcgacccctcaacccagaagcctcgagcaggcggacaggcagagctgcccagtggccgaggcgcggcagggctccgcgttgggcgagtgagtgagcctctataggacagcaggactgggactccagtggcaccagcggccccttcctcccgcaggaagtgaaagcctcgagcgccctggctctcaacccccagagatacaggcttttggcgccgtcgtgatcacaatgtgcccagcgatctagggtcagagatttggaggtgaccaaactatctgacactctaacaagtcctgtctcctctggcagatggaaagctataggctctgccagatgccagggtgcccttatgtgtgaggaaactacaatagtaaaaaacacaagtttctccaactccaggagcttttattcaaaatatatcaatgcctaactctgctcctaggactgtattttgaaacacccccaggtgattttgatagctgattgagagaaacttactatataactcctttgagaacctcatctcatttgctcttcccaccattgctgttggctaggtactaacatgcctctcttataacagcttcacagaggtcaagtgacttgctcaagttcacagagcaagtaagagagattctaacccctgtctaactccagaatgtgtgcttttaatttcttggcacttggaactttaaaagcttgaggacaggagaggggagttgcctctgctgggattttgcttctgctgggatggggcaagggtggggttccttcccttttaggaccttacatgtggggaaagtcttctgtggctcctcatttctgagcagtccccgcagcgcaaacttggccagttatccttttggagattgagttcccccagctccgtttcctcctatcacaatcactgcatttccatgtagattctgctgtgtctaagaatacagtggctgagggctggccatccctgtgcccttctccatggcagccccagaatggtgctggtgactcccgatacacctggaatgctaggtttctgggttctgctcatatcactgccacctgtgagccttgagtgagccactggcagttccggagcttccttctccctggagtaatctgagatactcacactctctgcttctgggagcaagtatgagtattaattaccagcccaccccagaaccagtgaggaggtggctctaggagtgctccatgagagtgtgtgatgggataacacaccccctggaaagaccagaagggactcaggaatgaagtggctggccagagccccacaccttcagctaggtgggagatggctacacatcagccccttgggagccctggagacttagttggccctgcttggaggctgtgggagctggatccctccccgctgcatcccttccatttttctccgtctcagacagagcagccttgttctcttctccttagtcacagaccattgtctggcacggagttctaggggtgagaagtgtcccgggacttggatgccccgcaaaggcccaatctggcatgactcctaaattaataatgtatttagctgtgggaagagattcttgcaagccaagggcccagagaagatgtccctgtgaatgtgtcactgcacaacctggcaccaaaagggttaccaagaacagcagccatcttgctgcagaggatgctttgttcccagctgaggagttgaataaattcattctagggctggtagaattctcattgaaaagcctcctttgccactttagggggctttgtctgcacctcttcccccagttccacagaagatgccttcagtccttgaattttggctcaggagttctgactctgggggcagggaggaaggggccatttctttaggaaaggagtctcagcttgctcactgtggtcagatgaaatgtgatttatctcttggtttctggtacctcagacctctgagacctgaggtgtattttgtctttggagatgagtccacccctgccccctcttagtccgttttcttctctgtgcccactcccctccttctctcccggcccatccctaggggctcgggtgacattctaacttctcacgggtactcagcccctttccctctgttttctccacagcaagccccgcccaacacggactggcgtttctctcaggcccagagacccggcaccagcgggtaggtgactgattctccagcccaccctcttctctgcggcattttctcagggatgacgtgggaggagatgggggagggcccagcatttgctacagatggcttctccctcagtttgagatcccagggaggtcttggtgtgcggggggctggcacacagaccccggaaggaagaggcgactgccctgactgttcaggaagctcaattcacatgcttgccccttccctcctcgccacgaccggcaccttttcctatcccctgagggcactgtggaaccaaaggatggtcttaagctggtctctgggtgaaagcgaggctttctatgcccatgtactgcctaaccccctcccctgagttgagctgggctccattatgacctggggctcaggcagaaaagcatttgaccggaggaggcggtccgcactcagcgcctcctccagagcctccagagccgaggctgactgcagcctggggagagtggaggcagcacagctggaggtggaactgaggaaggactgggcggggcatggagcaggcccccttctccggcccctcctcccactgtcctctgcccctacttgtcctgctctctgtctgtggggtctccgtgtctctgcccctttttcttgagtttccgtctttgccactttctcttacctctcagtccttccctcagtctctatctcgctttgcaatctctgcctctccctctcttctccatctctgtcttagcttccgtcttgattgctgcacctcagcctcagtccctttcatttgtctacttgcattgatctgtgccgcccactgtgcctgccatggcataagtgctcaataaatgtggagtgagtaactacacgggacccttagtctctttctccttctctatctctgcctccctgtccttgtcctggacctcttttctgtttctcctttcaccgtttcctagcgccttgtgttcttctatccccagcctctatgtttctctgtctctcactatttctgctttcctctctgttctttgtctctctttgtctctgtctctgtatatctttctttgtctctgtctctggtctctgtgcctgttgtctttttctgcctctttctctgttactctttctttatctctctttttcttttatcttgtcttttttctctgagcctctgtctctgtctctcatttttttgtgcttgtgggcaagccagcacacacaaccccccacccaccacccaccaacaccccgctctcttccttccctgcccctcacacactgagcctttgatcgcagctctccaccagacaccctcccatccaagcagccccagctgctcatttcaatctggtatgaattcctgctgagacaggaaccccctgcgggctgaaggggagggaaacttcagcagaaagaccttcagttggtctgagcagagtgggataggctctgcgccaggcctcccagttagaagtcaggagcctggaggagtctcagagcccagggagagaagcaggagcttgggccaccttaccctacctcctcaatggttgagtacttgctgtccacatttgccaagttgctacagatgctgagcttccaagagttatctttcccccatcctgcaaccaaccaaacccttgttgccacaaggacccaggagcccttggtgtatggcagagattccagcttctgggcatgcacagtcctgtcacccattttaggaacgcaaagcgcttcttagaaggcccctaaaaagcagcagatcaaaaggcttgggctgcccttgcccttcctttgaccccagctgttgtccttctccctgctggccttgccaaccttctcataagttatccattaagtcattaatgtattcattcgttcatttattcaacaaatatttatcgagcatctactatgagcagggccctgtgctaaacattgggctataggagtgaacaagtagatgtgatcccagaactcataggcttccagaccagcagaggagactgaaaatttgcaacaagtaacacttaaaaaaaaaaaaaaaggctgggcactgtggttcacgcctgtaatcccagcactttgggaggccaaggtgggtagatcacttgaggtcaggggtttgagaccagcctggcagccaacatggtgaaaccccatctcgattaaaaatacaaaaattagccaggcgtggtggcaggcacctgtaatcccagcgacttaggaggctgaggcagaactgcttgaacccggaaggcagaggttgcagtgagctgagatcacgaaaaaaaaataatctagccacaaatcacagtaagttctgagaggcagagaacaatgtgagtgtaatgggggggggaagatcagagaaggcttctaggaggaggtgacattgagaagttctaggccatttatgttccctctacctaccaccaccccaggccatacactggctttgaagcagaattcaccattgaacctggaagccccaccaactgcctctcatgtgtcctctggggtgagcaccttacccctgcctcaactcccattccatcaaatgagaggcttagtggcctggaatacatgtgggagctcttggagatatggaggagaaggtgcggaacctctctctctctcctctctctgcttccttagttaacttgtggaggatgcaacaaaccttttttttttttttttttagacagagtcttgctctgttgcccaagctggagtgcagtggtgcgatcttggctcactgcaacctctgcctgccaggttcaagcgattctcctgcctcagcctcccgagtagctgggacagcaggtgtgcaccaccacacccagctcatttttgtatttttagtagagatgggtttcgccacgttggccaggctggtttcaaactccccgacctcaactgatccacctgcttcagcttcccaaagtgctagaattacaggtgtgatcgcccccggccacaacaaacatttttgattcagcggctccaaagtgaaataagcgttaggatctagtccagtaacttcaacttctctccttcattcattcaacaaatggtcagtgagcactttctgttggccaggcagtgttctcgatgtgggaggcccctgccctcaaggagtttacagtgcactgaaggagacaaatattgaccaaataattacaaaaataaatgtgagactgaaactgtcataagtgctaggtagaattgtatctggtggtgtgggcgtataatagggatttgatttagggagcaggaggacatcctggaaatgaagttgtgctgagatctgaaagacaaatacaaattaaccagctaaagaaaagaaggaagagcattccagatggtcaggcataccagcttcaaagcagggctggtgttgagttcttcagtaaacttggttcaagatcaagccagctctgggtcacactgcctacacagaaggaagagcattccaaatgggaaaagcctatgcaaaagccttgtggtgaggcctcctgggatcaagggaatggcagggagttttctctttgctggcactggagtgaggggatgaagaggagaggttccttttatccagtctaaccctggttccagccttctgttgatgccctgcctcactccctccccaccatcttgcccactgccctccagcctggtctggtcagacacaccagcttcaaagcagggctagtattgagttcttcagtaaacttggttcaagttcaagtcagcactgggtcacactgcctagacagaaggaagaagacctggccaggtgtggtggctcacgcctgtaatcccagcactttgggaggctgaggtgggtggatcacctgaggtcaggagtttgagaccagcctggccaacatgatgaaaccccatctctagtaaaaatacaaaatattagccaggtgtggtggtgcacacctgtagtcccagctactcaggaggctgaggcaggggaatcgcttgaacccaggaggcggaggttgcagtgagctgagatcacaccactgcactccagtctgggtgacagagcgagactccatcaggaaagaaagaaagaaaaagagagagagggagggagggagggaaggaaggaaggaaggaaggaaggaaggaaggaaggaaggaaggaaggaagaaaagaaagaaaaagggagaaaaaatgaagaagacttacattctgaagttcctgcttggcacatgcttctcctccccaccactatcccttctcaggtcatcctttgggtgtctgatcccaatagctgttgtctcaagctctgagcccagcaaaccatttcccccttcttaggctgtaacccaggccctgccctgcagctgtccccagcctctgcacaaagagtctccatttggtccctagactgttctctgatggctccacactaccatccctcctctgagagacagtatccctgctctctctcagtttgggcagtcattcaacaaacaaatagcaacttaatttttttccacttataaaatagtacatgctcattatagaaacatgaaaaatagaaaaaaaattaaaaggaaaaccacccatcattttacaatctagggagaaccaccaccaactacagtttaatatgaaacatttcaaatatgtacaaaagtagagagaatggtgtcatgaacctgtatgataccactatccagcttcaactaatgccttatcttgtttcacctatatccctacccttatcctgtccttggattcttttgaagcaaatctcagacatcatataatttcatcttggtctccaccatctttaacagatgacttttttttttttttttttttttggagacagagtctcactctcttgcccaggctgtggcacaatctcagctcactgcagccttcgcctcccgggttcaagcaattctcatgcttcagcctcctaagtagctaggattacaggtgtgcaccaccacacacagctaatattttgtattttcagtacaaacagggtttcgccatgttggccaggctggtcttgaactcctggcctcaagtgatccaccctcctcggcctcccaaaatgttgggattacaggtgtgagccaccttgcccggccagatgattctttcataaggtccacattttatatttgagtgagtgtctcttaagtatcttaatgctcttttaatgtaaaagacttcccctccatcttccatttttgcaatttatttgttgaatccctgccttttcatatatatctttctaaacttttctttgtgtaatcaaagaacatgcatgagcttcatttttatttttatttatttatttatttatttatttatttatttatttattgatacgtagccttgctctgtcacccaggctggactgcagtggcgcaatctcggctcactgcaagctccgcctcccaggttcacgccatgctcctgcctcagcctccagaatagctgggactacaggcgcccactaccacgcccggctaattattttgtatttttagtagagacggggtttcaccgtgttagccaggatggtctcgatctcctgacctcgtgatccgcccgcctcggcctcccaaagtgctgggattacaggcgtgagccaccgcgcctggccgagcttcattttaaaaaaatctcattcacctaaataagttgttcacaaacttgtcacactttcatgtgacactttattcacatattaagaactgttattcccagtcatacggtacatttcctactagttttttaaaaatagcaactgaggccatactgtccaacagaattatagcttttttcttctttgcagtgtatcatgagaatttccccatgtctttcaaaattcttcccaagtcatttgcagagtaactcctcttatgaatatacatattattttacagaataagtcctcatatgaatatacatattatttttctaatgctaatgggcttttgctacattagaaaacatacacattcatttacaattttttttttttgagacagtctcgctctgtctccaggctggggtgcagtggcgccatctcggctcactgcaagctccacctcctgggttcaagcaattctcctgcctcagcctcctgagtagctgggactacaggcacgcgccaccacgcccagctaatttttgtatttttagtagagacggggtttcaccatgttgaccaggatggtctcaatctcttgacctcgtgatccgcctgcctcagcctccctaagtgctgggattacaggtgggagccaccatccccagcctcatttacattttaacacaattaaattcagggtgttgtcagggtgacttcctagatttctcagttttttgagcatgatgtagggagtattttattatagtccagtctatgggatattcccttatacacacacacacacacacacacacacacacacacacacacaccccaaactcaatagggcaagaaccatattcatcatctcttaaatcctaggtcctgtcacaggccactgcttggaaaatagttgactaaatgtagtccatttcttccatttttacttttcactattccccaaatcctggaagagtccctcatatctgctgctggggctccaaggcctccaagctgaagcccagtacgttgttgtgcataagatcataggccctggaatcatattaggctggctttcaggttgcaactctaccagttccagctgtgtgactctggtatagtctctcaacctctctgagccctgttttcatctgttggaaaatatagataatcacaacacttatctgcagggtgattccgaggataaaaaagacaaatatattacccagtcagcttagaataggaagctctcagtaaatggttaaaaaagaggtctctctccctctgctcatctcttacccagcttcacataattggcagcccacccacctgtttggccctcaaccttcaaccatttcccaggacgcctccttacactcctgatcatcatggttccaaccccactgttccactcagctttgttccctcaacaccactgctccctgtgacaggtcatcctcctaacctctggcatctggtcccgttgtctccctgacaacccgcatgctctcctccctgcaacccccgccgcttgcctgctctccctactttattcccattagcccccttcacctggggctgagaacacctggccttgaccctgcaccctcagccaggcccacagagctcagtcgggccggaagtaaggaccccagatattcagttgaggaatttaacattaatacaataatatagaatccaccagcagattttcataaatgttctgtgtgttcttttatccttttttttaatccaggattttatcaaggagcatagattgcatttggttgtcacgtctttcctctcctttaatctggagccagctcccagtctttttatttttttaatgacatggatatttttaaagagtccaggccagttgtactttaaaatgtccccgaacctggatttgctggctattctctgatggttagattcagattacacaccttggtaggaatacttcccgcagcatcacactgggactcatctaacgtcggcctgtcccactatcagtgatgccgagtttgttcgtgtggtaaaaacagtgtcccagatctctccattataaaaatatatttttataaagatattttaaaatatttgtgaaaatataagtaatctgtggatgatactttgagataggcagcaacccttcatgcaattttagtattccctgatgatccttgcctgtatctgtttttacatcagtgattacaaagcggtgatgttctgtcattccttctacatgtatttgctggtattcttctgaaaattacctggatgatttcttcagatttaaattcactgtcttttccttggggaagcctggactggctgagctgcctaaccctgactctctgtcttttttttttttttgacagggagtctagctctgttgccaggctggagtgcagtggcaaccttcacctcctgggttcaagcgattctcctgcctcagcctcccaagtagctgggattacaggcgtgtgccaccatgcccggttaattttttttttttaatatctattttagttgagacagggtttcaccatgttggtcagaatggtctcgatctcctgacctcgtggtctgcccgcccctgcctctcttcataccctctggtagcccctgacacagcccatggcaagtatcacaattgcaattactctattgtgtaattatttaaaatcagcctctcagtgcccaccatgagcaccgtaaagatggacagtttctatcatactcacagccacaaccccagcacctggctctgtgtctggtacatagaaattgctcaagaaagaattgttggaggggcgcggtggctcacgcctgtaattccagcactttgggaagcggaggcaggtggatcatgaggtcaggagttcgaaaccaacctggccaatatggtgaaaccccatctctactaaaaatacaaaaattcgctgggcatggtggcatgtgtgcacttgtcgtcccagctgctcaagaggctgaggcaggagaatcacttgaacctgggaggcagaggttgcagtgagccgagatcgcgccactgtactccagcctgggtgacagagcgagactccagctcaaaaaaaaaaaaaaaagaaaaaagaaaagaaataattattgaatcaatggaaacagaattacaactcttcccacttttgggaaggagaattgagattcctgctttccccttcaaccctagctttatgtttgttgtgatggtatagaggtcacacatggcagccttgtgtctgttcttaggctgagttcatctacttagggacggggaatcccagattgggcaaaaccaaaagcagggacagaccttggaaaaattgtaaagcagttcttggttgtgctcacccaccatgacaaaatatgcacacacacaacgcaacacacacacagacattttcatgccttcaaggcctaccctacagcctttcccatggtgccaaacccttcttcttaccttacagtcacttaactgtctctgctggtctcttcccactcatttaggcaacaaatatttattgaaaaacttctctgagccagatggtgccaaacagttacctaaagggcagactgtgtgtgtgccagggctgtttcccgccaacactcccctgcaaattgaaataatttcatccttggaaattcaaaaaaatcatgaaaattgtcactgtgggaaaattccaagtagagctgaaccttctaagaagcagagagttcttcttatggtttagtatttttttaaattatgaatcatttcatgttttttcaacactcggagtttctaaaagtctcacttaggtccaagtgctaggctttgtgctaggtgcttcagtaggaagcaggtggagtcgctgcctcacagaagccagtgtggtggaggaacagacaggcactacaacagctgcagtgtgactagtgccatgtggggcagccgctgggatgggagtacagtggaggcacctgcccagtctgagtggatctcctctgatatattttattcgtgtcatcatggcaaatgttgggggactggcattctagggaacaccatctgcccaggattcacagcaagagggaacttgagggataggaaagtgcaccttggaaaaggtttgatgatagagtgtttgagggcggggggtgggggttcttgtaaaataggaggggcaggttcttctatggccgtggattttactctgagggcttaggaagccattgaattttagaaatttcttctccctgctccagggtctcttggggcctcctacatctccccctaggtacctcctaggtccccactttttctctagctctggaacattctcttccatttcccaccttcacagtcctctggagaaggtctgatctccctcactatgacaggaagccaggctctctcatggtgggtgggggaatgcactatgttcaatgcattggaccagcctggccaacatggtgaaaccccgtctgtactaaaaatacaaaaattagcctggcacagtggcaggtgcctgtcatcccagctacttgggagactgaggcaggagaatcgcttgaacccaggaggtggatgttgcaatgagccaagatcgcgccactgcactccagcctggatgacagagtaagaccctgtctaaaacaaaaagaaaaaagcatcggaggcagcaaagagctggtttgagggactgacttgtgggattctggcttctgaaggattgtagaagtgcctcctaccttgctgagagaaacaggtcttgggcatggggtagggttagggtactaggtttgggagccctgggagaggacaggaggggcatgagctgtgccggcctgggagtctgtgctcaccatcctactctctccccagctcccaaaatggcgatgacaccggcacctggcccaacaaccagtttgacacagagatgctgcaagccatgatcttggcgtccgccagtggtaagtggtgtcagtgtgtgtatggaagagtgggagacctggggttctggggtgcatctcacagccaccatgcccacggactggatgtcaaacctgtgtagtttctccagatctttcggcaggtctgaaaggacccacaattccaaacataaagcctggaattgtggctaaggaacagcagaggggttgggggtcctgggatgcctggaggagagcgaacaaggaaaagactcatggagggaatagtggttacaagtctagctctggaatgggacagtgtagctcaggtcctagctctgctactatccttgggacttggatcgacttgctcaatctctctaaacctcagtttcctcagcctagaaagtggggacagggaccccaaagggttgttgtagagattaaatgagatgataccacaaagcatagagttctgggcctggcgcttggaagccctcaagcaatgaaagtgggtgtagaaatccccagccgagagaacacctcctctttatgcgaggctcctcttttgctgcccctaactccagagtaggattctggttttcccataaggttgactaagggcttcctttgtaatagagattcggctagtggtggttgtccctgaagagtcactagggcccagagcaggagaagaagaatatcatttgtccttaagagcacagcctaagctgggcgtggtggctcacgcctgtaatcccagcactttgggaagctgaggcaggaggatcatgaggtcaggagttcgaaaccggcctggccaacatagtgaaaccctgtctctactaaaaatacaaaaattagctgggcatggtggtgcgtgcctgtagtcccagctacttgggaggctgaggcaggagaatcgcttgaacctgggaggtggctgtggtgagcagaaaatcgcaccactgcactccagcctgggcaacagtctcgctctgtctcaaaaaaaaaaaaaaaaaaaaagagcacaggctttagaggcaggccaatctggattcaaatcctggcacctggcaccaccacttagcaatgagtccttaggtaagttattaaaccccctcggtttcacttactattaatgggcacagtattaacggatctcattgtggtgttaccagggccaaatgcaagtccctcagcacaggattggcagagagtaagggcacaatatattattatctttgctgacccaaacccgttttttactgggtagaaagcagaattagaataatgcctattaataaagactagcttctggagcagcaaatcctgggcttataaggaggctggcagaggatcaaggcattgccctatatcatgaactgatagccctgccctccagcatgtctggaggactggtgggtagagaaccaggtgaaatcacaagaagcactgtcatcacacctgggcacatactaaacaaactttaggggcctcctgtcaatgaatcctctcaatagctctgcaaggcaggtctgatttctcacactcgacagatgagagaaccgagaaggcacttgccccagggtcctcagttttgagctgccaagctgaggttctaacctggctcaactcctaagtttatgctctttctactatagggaccatggctgcctttggatccagcctcggcttctctattacctgagcaggatgagaggctgtcctcttcctcgagctctgctttattcttccagatcagggttgccagataaaatacaggatgcccagttacagttgaatgtcagataaacagcaagtactatttcagcataagtcagtctcaaatgttgcatgagacataatgtactaaaaaaaaaaatgctcattgtttacctgaaattcaaatttaactgggagccctgtacttttatttactaaatctggcaactctaccccagatgtctgtgaggttaagtggggccaggcctacagctgacggaaggacagagagagaggtggcagggactgctggcctcctgaggcagagctgtcccaggtctggtggggctatgattccagagaggccagagactgagtatgaaagtggcaggcggctgggtctgaggagatgccaagttggcctcttgagggaaataaacaggtatatttagctgttgtggccttgcgccctgaggccaggaagcagctttttagcctaaatccagatgttaaaaacagaaatgaaatcagtatttatggccccaaaccctccaagcaagtcatgcagctcgttcccctgtcaaggcctcccacctttggcccacacagggcctgaccctcgtctaagcctgcgccctggggaacggaccctgggggtggaggtggtgggtcaggccctgctctcactttcacacccgcttcctagccctgaaaccagagaggttcctgaagtccagcccagccaggcctgtggggctgctgagaggggttaagtaagagggagagtaaaaaccgacacttgggaggaggcttttaaaataaacatctgcggggagggatgctctcaaggaggctgcggtttgcagctcagccagctgtgttccagctaatcagcctccttgggctactctggagttgctgccttggccctgggatggggtaggttaagaggacagagggaggtcagggagctgggggctgagtttccctgagtagaggctggcacaggagagaaggcatcacccccacctcgtccaggccagaagatgtccagcttcttgaggctctcctaagtctgcctctcctgggaccaagagaaaatcccggtccttgaccaaggtgggccttggggggagtggggtgtagagggaggggcactggagaactgactctacagaaagtcaaagctggcaatccaacttcttcccctcagatttatagatgggaaaacaggcttgagccacgcagagacttgaccaagctcacacagttccttagtggcagagcagagcaaatattctctttcttttacattctggatttccatatcttctctccctcctggtccagcccaacctcagggcaccccccacgaggtgggcgggggatggctttgtcacttgcacccactcggggtgctactcagagatcttgggtgcacataggacgtgggtgggccgagcttctagctactccgtcaggcccttcctgtcattctgtctctgcctcccttctccctgcttctccgtgttcctcctcattcttttctgtgtgcagggagactacaccccccaccccgctctttctctggcgcctctgaggtcccccctctagcccctaaatcactctggaatcctggctctttgaagccagatctgggcccccctcccctaccccttccattcccaggctgggaaaggctgaagaggctgacggctggaggggagggggcggggcggtggcggatctggcttccttttggagttaattagggaaaacagagaaatgtcagcggaatgaaagggctgggggtgggggccagctggggtaggagaggaggaagtgggcagctgctccctcccactcaacccctctcccccgcccccagaaagctctcagctccggggatttgcgacatgaaatgggggctgtagaaacctgagcgctggtgcgtgaagagaaaaaccgaggcgcatcccggctctcccctcccgtgtgccctcctcctcttatgccggcttgaaaatatttcctgtctctctatttctcaatccctggttgatgtcccaggattactcagcctctccggctttagtcactctcgctacccgctcccagggtccagggtggaggcagagggaggctgggagagaagctctactgccagctgggcctgggctggcctgggcatccctgaggttttaactgtctcctaaccacagaggatctcagggcctccagcagcgagccccaatgagtcaaactcttgtttcctcctctcccacccccgacccagtcagggcaggtgaggggtagaggtgatggcatgctggatgtgacggtgttgatgatgtattgcacaggatgaagcaccatctcatttagtcctcacagcagccttcacagtgcgtacaaatcagctggcaattccgagaggctgcattctaaacaagttcctgggtgatgctgagccagggccagagtgtggacttctctgggccccagtttcttcttctgtacagtgggacgttggactggaggtgctgtctgatgtcacctagctgtggcactctgagcctgtgcctaaagtgtccctgagatgtctagtccccgagatcatcatctcctcagcttcatagagccgagctcttctccatcttctctctacctcccattcactcagaacagggataaggtccaagctgctggtggtgatggtgactgactgtcccttccagcatgcgcttaggtacacttgggcctgaatgcccctctaacaaatgctaccgggtatggccttggtccttctaacacttggttccctcatctgtaaaatgagggtcataccacatagctggctgggctgttatgtagaggttaaaagtgattgtgcatgtgaagcatccagcagagtgcctggcacacagtaggtgctcaaatgctgttttgaaatacaaaaattagctgggctagtggtgtgcacctgtaatctcagctactcaggaggttgaggcaggagaatcacttgagcccaggaggcagaggttgcagtgagccgggatcgcgccactgcactccaggctgggcgacagagcaggactccatcttaaaaaaaaaaaaaaaaaaatgctgttttgaaatggaggcttggaagagcactcttcacccccaccccacacacttactaacggaactaccgaatctctactcgtgccaggccttgcttggcaaaggctaggggcatgtaaagccatggtttcatggctgctgccctccaggagcccatggtctagtgtgggagtcagaggctcccttgagaaagccagggcaaggaactgagagcccgtgtcacagccctgagagaaataccagcgaatgtgttttgagcacttacatctaccaggcactattttacgtacctgacatacattttcttatttagcattcactaaaaccagaagaggtggttaccattatcatccccattttgcagatgagaaaactgaagtggcataaggaggttaggtagacttgcccaggatcacagtgagtaaggaaaggagctaggaatcaaacctagactttctcactccagagcctcttaacctctaccctcaactcttgtgaagagagactaccttggtgacccctatattcccagtgctcagcgtggtcaaggcccagggtgctgtataggcattcattaactgctggggatataagacagtgactgttgaggaccctaagtttagctcccacctgatcttcctctgtctctgcagaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctgaacgtttctgtataagcgatggaagctcctggcatgtgtgcatgaagtgatgagctgaggtgggtgctggaagaagggcggaatcgggaggccactctgtgtcattgcgcgtctagatgtttccgaattgcgtgtgtgtgtgtgactgtgcaatatggttgtgtatgcttgcaatgccgttgtgcctatgagac

SEQ ID NO: 14862 - DNA, 7292 bp, Human
cgctcggttgctgcgcacaaaggctgaggctccaagagctgcagggcgtgtttggggtgcgcgcgaggttgtgtgcaaggtccggggcgcttggcaccggccacgcaagggtgtcagtctccacgcggacgggctgcgtagggactcgtagggacgggttccgggtgctgggcccggccggtctcctctgtcctacccatcccttcccgatggcgcttgccttcgcgggccgtcgggggagaacgggagaagattgtgggaccgctctcctctccctttctccactcgtgggacctacacggagactgagtagaggagagaagcgacggcaccaatctttgtgtttgtttttaaattgtggagggaaacagccatgctctgctaccctcctcttactggagagctgtcaaaaattttggggatcccctattcccccgcgtttagtccccctgcagatagaaaattgaggccaaatgtagtaactaactggggcaaggtcacactgggagtggcagagccgggattcgaatccggaggttctgacagggccaccctcttacctccacatcagcacttccttctctcctccgcgcagcctgaactgatgcccttgtagcctatattgattccggctcgagcctagagaggacgtgttctctggacttaggggtagacagacactggggagggttagtgacccgaggaggttgatgaccctgggagtctgggtcttggctgaggctttccgtccctaaaagaccccaggtctgtctcccatgtcattcacctcgttgctgtgttttctcagaccccagagtcagaaggagtgagaaccctgacccctaatcccactgcatccagccaataggagcccagtaagtgaccccaccccgcaggctgcaggctccttcctgtgcaggtctgtccaggtgctctgctcctcacccactaatgttgaacttgcggagtttattcagagttgggaggaagggtcttgggaggaagggaggcattgggttggttggacagatgtcccttttatgttgttttccccacctcccccattggtcatgttgctttggtcatttttagccccctttgagctgccgactttggggctttaattgaaggtcatggtcaattgtgaactctcacagtcccgtcttttggtaccctgtcctttagaatactcagtcactgagctacaagtttcactccctacctgagagtgtggggtggcccctaaatatagcccgagaaatctgagctacacttctgccccaccctggtattttggtccagggcagaggagggagggggtctggaggtgtggtgttgagggtggcagtggggatggtgagtatcaagagaagggctgtcctgattcctcttccaaagcttccaccgatcagcctggaaacggagctgggggcaggaaaggccctctgtgtgttctagagtagtcttcaacccctgggtccctctgttccctgcatcttcctgtgctgagagaggaagcctggtgtttgaggcgatgtggggatgtagagacaacttcccagtctcatttcctcatcctgccaggccaccatggcggagctgcaggaggtgcagatcacagaggagaagccactgttgccaggacagacgcctgaggcggccaaggttattagagaccgtttgactcccatgcccaaattccagacctctaagcatcccccttgccttctaacttcccaagcgtactgatcttattctaactcacaccactgcttcaccactaccctagtctctctccccatacactataattgggagtcaggcccttgtctcgtcactacactaaccttcatcctttccgtgtctctctttgtcaatctctttctgtctttggtcatttgttggtctgtctttacttgcctctctttgtctgtttgtctctccatctgggacgccacatggtcatgtgtttctgtgtgaatccgtgtgtgtctctccaggaggctgagttagctgcccgaatcctcctggaccagggacaggtaacagtgtgggggcagtcccaaggtgggaggaggggctgtcctcttccccagtagaaggatggcctctgcttggccctctcttctctctttgctttctttccttctattctagtcctttcccttccctatctctcccctctccttccttcccctcctcttctctctctaatcttcattattctttcttatcctcaaactcatcttccggtatcatgttttcctcaattcttgctgatcctgtttttaattctttgttcccttttccctcttgcccacccactcccagctccctgaccttggtgttgctccttttctggcctcgtctcctctgagcctagctcttggtgccctgttttcctgcagactcactctgtggagacaccatacggctctgtcactttcactgtctatggcacccccaaacccaaacgcccagcgatccttacctaccacgatgtgggactcaactgtaaggaccttcattcatctcccactcctgtctgggaagaggctgtgggggaagggtagaaatgaaacccagagggaggggaggggtcagtgtgggaaggagaagttctctcctggtctgactgtggcatgaaaggaagggtgagttctgactgggggacacgagtccctgtctgattctattgttgaggtgatgtgggttctctttagataaatcttgcttccagccactgtttcagttcgaggacatgcaggaaatcattcagaactttgtgcgggttcatgtggatgcccctggaatggaagagggagcccctgtgttccctttggggtaagagttaggtcgttactgcttcaccagactgtgaggaacaggacaggtgcgggaaaggttcgactggggaggaggaaagggagggcagtggtgattctgggagagaatgagtaggacatcctgaggtggggggtgtgagggcaggttggtatcttccttaacatgcctctcttttccagatatcagtacccatctctggaccagcttgcagacatgatcccttgcgtcctgcagtacctaaagtgagaggcctgggaacccctccaaaccagagttctctttccagcacaaggagacccttagaacttccaggttcaccgtggttcctgagccagtttcagcttctgaactcaatatatcttcttccttcatgctcccgccttgattattgagaaaaggtggtgggtttggaaaattggccagagtcaacagaatagccctaatgggtggagggaaggaaaagggtctatgcttggccctgcctcaggctaaggagggccttctctgatcagaaagtcagggaggaatgaaagggggtgacataatccctgaggaaccagatagacctgtctctttctctcccactcccctctccttcatgcccacacctggtggatggggagctctgcgggtgagagagagttggggaaggaagagaacaccagaccaagtgtctttggtattcagagggaggtgctggcccctgggtgctgttcttagctaagcttctcctaggcaccagggctcagcagctctggttcaccactttgccactcttttcctcattctctccattgttcactaaaattgtgtctgttttcacatttgctttaagttccattcttcccgttcctctagaggaaccaggaactaaagcagaacaagttgaactggctcttgaaaattgagaatggacaaagagctatctatatgggaaaacagtgtgttggttggctggtggatgggtgtttgtttttaagacactagctctccagcagaaagctggggatagacttcaggtatctaccctgactacccgtgccaacctttggcttcttgggcccttctttttcgcgtcctccaaagaaaggtccgtgtctgcctttctttgtgcccgtggactcaggagggagggtgaagagtttgaagagatgggctgtggcaggttttggacagcagatcccatgaggcgtatatttctttccctttcacagtttctctacaataattggagttggtgttggagctggagcctacatcctggcgagatatgctgtaagaaataaaaagcccagaggagggaaaggagggtccagactgattaggagaatactgtttattagtgctgtttgggggaggaagtgggcactaggtggggagtcaggccctgtgggagtccaggagtgggtcgagcttagcggggaggggataaggccatgccctgtttctcatttccttccttctgctgtccctcagcttaaccacccggacactgttgaaggtcttgtcctcatcaacattgatcccaatgccaagggttggatggattgggcagcccacaaggtttggaggggcctgtgtgctgagacctacggttggggatcccctcgtatggatccagttaggctctggtagatagcctaactggatggactctgaacttcaaggagggagtaaaggggcaggaaagtgaagctgtcactttgcctgagtctcttataatatcctgaactttctttttctttttcttttttttttttttttgagatggtgtctcactctgttgccaaggctggagtgcagtggcttgatcttggctcactgcaacctctgcttcctgggttcaagtgattctcctgcctcagcctcccaagtagctgggattacaggcacccgccaccacgcctggctaatatttgtattattagtagagatggggtttcaccatcttggccagggtggtcttgaactcctgacctcgtgatccacccgcctcggcctcccaaagtgctgggattacagacgtgagccactgtgcctggccaataccctgaactttctcacctgccttctcctcatagctaacaggcctcacctcttccattccggagatgatccttggacatcttttcagccaggtaagtgggtgtaggagatgtagaagagtcgaggggagcagcagggaacttgaatgcttgggctaacttccttagctgggacaggatttggggaaggaagaaggcttacctcttttcctccagtaattgttgttttctctttccatccctaatttttctccttgttctctccttcaggaagagctctctggaaattctgagttgatacaaaagtacagaaatatcattacacatgcacccaacctggataacattgaattgtactggaacagctacaacaagtgggtgggctgtgtgtgtatgcatgtgagagaaatgcagaagcagtaattgggcgtcatgggggaggcacagaggaggagagggaagtctgggtagtgtgcaatgtgcaaggaatgcagcatttagtgtgcaatgggggcagcttcaggacagagtcagtgggaaggattgcaaggggctgtcccccttctcttgtttacctcctttggattattggactcccagaagtaagatgatcttgtgtcctgtgtccttcctccccttttgttgccctctgaccagggatctagggcacaagtgactataggggctgtgcttggggcctgcctgcccctttctcctttggtttccacctttaataaccaagatttgaccgtaatttttagacaaagatagttccatcatgggagagatagcttatatctggttagatagcattgcccacctaaaattcctactcttttaacccctttctagccgccgagacctgaactttgagcgtggaggtgatatcaccctcaggtaagactttaagagataatgcattgcctgtctccctggatcttccctaggagcttgtgtcccttagaagaaggagaatcttttgccagggaacttccttgtcatgtcccaccccatcctatttggtaaatcacttccctctaggtcttccccctttgaatcctcttggtggcatcagcagggagacacagaagtgtctttcctctttggagccagatatttttccagctgcactcctaggcagaggccagtgagggagtgccaggggctcactgccttctccccaacactgtgtctttaggtgtcctgtgatgctggtggtaggagaccaagcacctcatgaagatgcagtggttagtagggaattttggggtgagtgagggaggagggttggggtcctaaagtggtggtcagaagagtatcttgccaaggggatgtcctgtttggcacagggagatcaactttggggcactaagaatttgattcctggtaaggaggaactgggtagggagctgatagaaaagggactggggtctgggttcctgggtcccttacgggggaggcgccacagtgggcgtgacctcattcattcagcctcctgcttactccaggtggaatgtaactcaaaactggaccccacccagacctcgttcctcaaggtcagtaacctgttcctgggcccccgtccacagtcatatatcctctctacatgcagctgctaagcctccagggcccggcatgggagcaaatggggtgaacgaagaacaaaacaaaggggctagagtgaagaagctagggaagagagaccctttccacctctctgcatggctcatttatgtgtgtttcactttttctgggtggtgctctcctgaacagatggctgactccggaggtcagccccagctgactcaggtgagtgccgctgccgtccatgggatggggaagggacataggataccggtggcactgggctctgccctttgccacacacccggccccacagtgccgcagcctcaggctccagctcttcctctaacctcatctcaccgtctccctcgcctcttcttacttccgcagccaggcaagctgaccgaggccttcaagtacttcctgcaaggcatgggctacagtgagtatggggacaagagcttgctgcactagaggagagataggcactgacggggtggaaccgttttaggtgaatgcctggactcaccgctgtctgcccaatcgagctcgttgatcccctggcttagttataactagtccataatccaaggaccacaccctgagtcgccagccccccttccccacttcctctctgactgcttgtgcatcgtgctgtctccacagtggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacacca

SEQ ID NO: 14863 - DNA, 25227 bp, Human; identical to SEQ ID NO: 11847

SEQ ID NO: 14864 - DNA, 288031 bp, Human
  misc_feature (1)...(288031): n = A,T,C or G
ctagcctgggtgagaaagtgagaccctgtctgcaaaaacaaaagatttatctacatatcaaagtgaagaggaaggattaataaatataggtttttctcaaggaaaagtcctaggaaaagggaagacagataagatctctctcttttgccaaaagagaacgttcaatcttattttttacatgtacacactcttccttatgggcaaaatggatgtttgatgaaagactcaccaatgaagagaatctacatctgataaagaggagatcaagacatatctgggagggtgtcaggggttccaggaagcgggggaggaatcatgttggtctgtctgtgagcatctatttttcttctcacagagtagtagaaacttgggactaggagcaatataggcagaaacacacatcaggcaaggcattcctgacaggcagagagaaactgcctgctcatcgggatgccactctcctactctactctctattgtggacaaaaggtagccacagggtcctcccaattctgtggcaatgagtatggagagggcataactggatagcagaataaaaatccagtgcacattgctgccttacagccaataacagttgctcgccagtggtatgaagcttctgtgtgcctaggactgagctactgggtatagcgtgtgtgggaaggggagtcaccaaggggagtcatccccagaaggggaaggtaagatactcttccaggatcaggctcacctttcccatccttggagggggtctggggatggaaggtttttaccactttgggcatggtacacactctatcagcagaaaagggaattcatcggagattatttgggtagactgatggccttaaaggaaactgggtattatcttgttctgtcaggggaggagtttacaccttcactaacagttctgagcagatgcaacagcaggacagaccagaagtgtgacctaactcaggctgcctcagagagattgctgttggactgcctctattgatgggactcttactgagggggtccaggcattcagggggttgagcgtcccagaaagttccccaccgacgctttaaaaatgtattccctgcagccttacgttcttgcagttccaatatagcattggtgtttaaagccaaactacattataattgattcgccatcatccagctttatatttaacactttaatctggtaacaaaggaaaggctcgttaaaggacggcatttataaaaatttttcaagcacctctgcttaactcgaagggaaaataaaaggcactgtttatttggtaggccaaggagaacaacgccacgaagaggttctccactgatcaattcctacctttgtcaattataccacattaattagtaactttttttggagacatggaccctctcaaactccccagtatgctttgaaactttgatccagaaatgtacaaacaaaactctaagtgttctggaattaatttcagaagcttcatagatcctcgtaagtactcaccaaaagaaaaattccccatttctggtactccaatctcatgtccttagaattctcctaagacttgttcccttgaacaactttccctaattgcaaatcaaacctagatccggctgggacgccaagcttgagctgtggtaacgctcagaaggcctcttttcatcagtaaaatagatgccttaacggaagtggcgggcaatctacgcatggaaaggcgcttggcttccctcttttttgggtttctctaggttgtctggatgggaaaaaaatacacgcttcgtcctgcggagttcggtacgagggcaattgcacatgcgcaaaggcgaaccagtagcgtccgggcgcgtccgtggagcgggacggggcggggcggggcggtgccgagtggggcgagagaaggcccgctcctcccattcgtcgcgtccttaactctttgctatccttccgctgagcttcctcttctttccctctgacctcggaaagggggcggggctttcgggggcggaagttgcggtgcattgtgggttctcctggagctgtggagttgatcctgaatgaaagtggcgcgccgcccctgacgttacccggatcggagaggttggaattcagattacggctgcgattcgggtgtctcggaccccggtgtgcaccggaccacggggaggcggctccaaaggcgcggtgaacgttggtgagggagggcagctctgcgcagccccaagacatggctcacaacaagatcccgccgcggtggctgaactgtccccggcgcggccagccggtggcaggtaacctggactggggggcgttcgaatccccacactccaacgtgcccgggggtgggccgactgaggagctcagcttttggtggttctgtgcccattagtggtatttcaggagcgggatatgctccgtcggattacgcttcgtggatgaatgggaacatgaacgggaggggatggtcggcggatggggggcacttgttactattcctgcaaggctaactgtgcgaatgtgaaggtagacaggaggttggtggcaggaggtgaggatccaggaatacagtgggcgtactttgagtcttagtagtttgcgaacctgttagggttcaaccttcccctcgaaagaagggatgaatatcagtattgagatggaggagggttaaggagggaaggggcggttcccagcggtgaaatggggtcacattgagactgggaatctggagggtgtttttgttagttttttatttttattttcttgtgagacagggtctcttgctcgggctggggatcctcccacctcagcctcccaagtagctgggactacatgctcctgccaccgcacccggctaatttttttatttattaaagtatatatatatttataatgtatatatttgagacatagtctctctctgtcgtccaggctggagtgcagtggcgtgatctcggctcactgcctcagcctcccaagtagctgggattacaggcgcgtgccaccacacccggctaatttttgtttttagtagagacagggtttcatcgtgttgaccaggctggtctccaacgcctggcctcaagtgatccgcccgcctcggcctcccaaagtgctgggattacagccgtgagccactgtgcctggccataatttttttgtttattttttgtggagacagggtttcactgtgttgcccaggctggtcttgaactcgtggactcaagcgatgctcccacttcggcctcccaaagtgttgggattataggcgagagccaccccgcttggccgggtttttgttttttttaattatttttcttgtagtttttttcatctttattgagcttgaatacaataagctttaaagcgtacagtttgataaattttgactgtatatacacaaatatatctctttcctaggaaacaaccatgaaacccctcaaagtttcctcttgcccctttttaaatccctccttcgcctggcagccactgatctgctttctgtaattatagattggtttgcattttctagaaatttttaaataaatggaaacatatagtgagtactcttcttggggtggaaggaagtgtgtgtggcttttttcactcagcataattaatttgatactcatccagattatgcatgtatcaatagtttattccttttttattgcagagtagtagtttattgttctgggtataccacaatttgtttacctgttcatctattgatggtcatttgggttatttccagtttttagctattacaaataaacctgctgtgaacattcatgtacaattctttgtgtggacatatactttcatttctcttgtgtaagtctctaggagaggaatggctgcatcatatggtaggtgtatgttttaagaattttaagaaactgccaacctcttttccaaagtggtaacacttgatagtcccaccatcaatgtattatacagaagaaattcaaaggacttaaaaactagcaaaaaatttggacacttcacaaaataagttatatgaatagccaaaaagctatgatggcgtggtggtatgtgcctgtaatcccagctactcgggaggccgaggcaggggaatcacttgaacccaggagacggaggttgcagtgagctgagattgcaccactgcactccagcatgggtgacagagtgagactccatctcaaaaaaaaaaaaaagtaatttgtacttatcgtgtaatttattagtaagggttctctagagggacagaactaataggaaatatatgtacatatatatatatacacacacacacatacatacacacacacacatacagacgtaaaggggagtttattaactgttaactcacacgatcacaaggtcccacaataggttgtcagcaaactgaggagcaaggagagtcagtctgagtcccaaaatggaagaacttggaatccagtgtttgagggcaggaagcgtccaccacaggacaaagatgtaggctgggaggctaagccggtcaagtcttttcacatttttctgcctgctttatattctagccatgctggcagctgattagatggtgcccacccagattaagggtgggtttgcttttcccagcccactgattcaaatgttaatctcctttgcaacaccctctacacccaggatcaatattttgcatccttcaatccaatcgagttgacactcagtattaaccatcacagtaatttctttgatattttgcatattgaggaaaatgttatggctgctcaaacttatatgttgtaaatgttaggattcactttactagtactagaagttcataattttcctgaatcagaaagaaaatggtactaactacatataatttgtttctctgtgaagtcactttctctgatgaaaccagacttgcaatgagagagagctcttggagacagggccaagctttattttctgaagaactgttttttcctccttctgagttaatagatttcaggtgaatacttggaagaaaacaaacttataatttcttttcctttttcctttttttcttttcttttcttttcttttttgtatttttagtagagatggggtttcaccatgttggccaggctggtctccaactgctgacctcgggtgatccgcctgccttggcctcccaaagtgttggcattacaggtgtgagctaccgcacccagccctccctagtttcttaaagatatatcattcaacataaaattatttcatatctgctatgtaaagagcttactaggaactgtgggaatgtaaatatgagacacagccaggtgcattggcacatacttgtggtcccaggtactcaggatagtgtgatggtgatagtgatggtgattttgaagtcattttatttagcaaatatttaaatgtctactttgtgctagtcctgggtgctagggagatggctaagatatattacccttaaaaagcagagtctcatgggagtagcaaaccatccattttaagcacagttctgttgtaaaaaatgtagcaatgactctattgtggtatatgatgggaatcagaggtaataaacctaattctttgaggttgaggaagaagagatgggaaggaagaaggagatcaggtgagacttcccagagaaggtcatacatgaattatcttcagtaaatagaagttttctagataaatagttggcagggggtgttattgaaagtttctgttaggataggatgatgatgggagagataatagactgaaaaagtgtctttgttctggaagatgtaagtgaggttaagaggttggagaatagcctgatcatacaggcaagtagggtgtgataaggtatcctaatatttatatgctttaaattttcagtggcatacaattgcagttttttttttcagcatcgagatgagattatttgaatccaagttaaaagcttactttgacttttctgtgtttaatgaattgatggagaaaagagtggaaatggagagactaattaggaacttgttgtagtccaggtgaaagacaatagtgatagtttaaaagtgacagatgaagagtagaaggctaatttgagagatattaagaagggaaaatggacagaacttgatgtcgtatttagaatgagggaaagagggtcaaaatttagtctcaaatgtctggcttatgcacatgagatagttgatattattagggcttactgagagagaagcaggttggaggagatattaagatcctgattgctcaaatagagatctttagtaaagatctttttaaaaaacatttttatgttatttcagtagtttttgggggacaggtggtttttggttacatggataagtacttcagtgatgatttctgagattttggtgcacctgtcactcaaggagtgtacactgtagtagtcttttatccctcatcccccctctccacacttccccctgagtacccaaagtccattatatcattgttatgtctttgcattctcatagcttagctcccacttacaagtgagaacacaggatatttgggtttccattcctgagttacttcacttagaatgatggggtccaactccatctaggttgccatgaatgccattatttcattcctttttatggctgagtagtattccatggtatatatacatatcacattttctttatccactcattggttcttgggcatttaagctggttccacatttttgcaattgcaaattgtgctgctgtaaacatgcctgtgcaagtggctttttcagataatgacttattttcttctgggtagatacccagtagtgggattgctggatcaaatggtagttcttctagttcttcaaggaatcaccatactgttttccctagtggttgtaataatttacattcccaccagcagtgtaaaagtgttaccttttccccacattcatgccaacatctaatattttttgatattttaattatggccattcttgcaggagtaaggtggtatctcattgtagttttaatttgcatttccttgatagtgatgttgaacatttttcatatgcttcttggccaactgtatatcttcttttgtctgttcatgtcctttgtccactttttgatgggattatttgtttttttcttgctcatttgtttcagttccttgtagattctggatattagttctttgtcagatgcatagtttgcgaagattttctcccactctgtgggttgtctgtttactctgctgattatttcttttgctgtgcagaagctttttagtttaattaggttccatctatttatttttgtttttgttgcatttgcttttgggttcttggtcacgaactctgcctaagtcaatgtctagaagagttttttccaatgttatcttctagaatttttatggtttcagatcttacttaagtttgagttgatccatctccagttgactttgtataaggtgagagatgagtttcattcttctacgcgtagcttgttagttatcccaggaccatttgttgaatagggtgtcctttccccactttatgcttttgtttgctttgtcaaagatcagttggctgtaagtgtttggctttctttctgggttctctattctgttccatgggtctgtgtgcctatttttataccagtactatgctgttttggttactatagtcttgtagtataatttgaagttgggtaatgtgatgcctttacatttgttcttttttgtttgcttaccttggctatttgggctcttttttggttcaatgaattttaggattgctttttctggttctgtgaagaatgatgatggtactttgatgggaattgcattgaatctaaagattgcttttggcagtatgatcattttcatagtattgattatacccatctatgagcatgggatgtgtttccatttgtttgtgtcatctgtgatttatttcagtagtgttttgtagttttccttttagagatctttcacctccttggttaggtatattcctaagtattctattgttattattttttttatgcagctgttgtaaaagggattgagttcttgatttgattctcagcttggccattgttggtgcatagcagtgctactgatttgtgtacgttgattttgtatcctgaaactttaaagaattcatttgtcagatttgggagctttttggatgagtctttagggtttcctatgtatacaatcatatcatcagtgaacagtgacagtgtgacttcctctttaccaatttggatgccctttatttctttctcttgcctgattgctctggtgaggacttccagtactatgttaaatagaagtggtgaaagtagcatccttgtcttgttccagttcccagggggaatgctttcaacctttccccattcagtatagtgttggtcatgtgtttgtcatagatgccttttattatgttgaggtatggctctattaccttgaggtacgtcccttctgtgccagttttgctgaaggttttaatcatgaagggatactggattttgtcaaatactttttctgtatctattgagatgatcatgtgatttttgtttttaattctgtttatgtgacgtatcacatttatttttattttatttagttatttttgagacagagtcttgctctgtcacccagtctggagtgcggtggcaccatctcagctcattgcaacctctgcctcccgggttcaagtgattctcctgcctcagcctcctgagtagctgggactacctgccaccacgtctggctaatttttgtatttttaatagaagcggggtttcaccacgttggccaggctggtcttgaactcctgacctcaaatgattcacccacctcggcctcctgaagtgctgggattacaggcaagagccaccacgcctggccaacatttattgacttgtgtatggtaaaccatctctgcatctctggtatgaaactcacttgatcatggtgtattacctttttgatatgcttttggatttggttagctggcattttgttgaggatttttgcatctatgttcatcagggatattggtctctagttttctttattgttatattgtttcctggttttggtattagagtgatactggcttcatagaatgatttagggaggattccctttctctgtcttttggaatagtttcagtaagattggtagcaattcttctttgactggtagaattcagctgtgaatccatctggtcctgcacttaaaatttttaaattttaatttaattaatttatttttgttttcttggacttttttcttggcagtttttttatgactgtttcagtcttgctacttgttattagtctgttcagagtttctctttcttcctgatttaatctaggagggttgtatatttccaggaatttatccatctcctctagattttctagtttgtgcatataaagtattcatagtactattgaatgatcttttatatttttgttgtatcggttgtaatatctcctgttttgtttctagttgaacttacttgaatcttcttcttttcttggttaatcttgctaatggtctatcaattgtgtttatattttcaaagaaccagcttttttttttttttttttttttttgagacagagtctcgctctgtcacccaggctggagtgcagtgatgccatcttggctcactgcaacctctgcctcctaggttcaagtgattctcctgcctcagcctcccaagtagctgggactacaggtggcccgccaccacacccggctaatttttttgtatttttagtagagatgggatttcaccatgttggtcaggctcaaactcctgacctcaaatgatctgcctcccttggccttccaaagtgctgggattacagacgtgagccactgcaccacatccagaaccagtgttttgttaatcttttgtggatgtttggtattttttgtttgtttgttacagtttagttctgctctgatgtttgttacttcttttcttctgctgggtttgggttcagtttattcttgtttctctagttccttgaagtgtgaccttagattttctgtttgtgctccttcagatgttttggtgtgggttttttttttttttttttgagatgagtctcactctgtcacctgggctggagtgcagtggtacgatcttggctcactgcaacctccgcctcttctgttcaagcgattctgctgcctcagcctcctgagcagctaggattacaggcgcccgccaccatgcctggctaattttttgtatttttagtagagacaggatttcaccatgttggccaggctggtctcgaactcctgaccttgtgatttgcccgccttggcctcccaaagtgctaggattgcaggcatgagccaccacgcctggtgatgtaggtatttaatgctatgaactttcctcttagcactgcttttgctgtgtctcagaggttttgataggttgtgtcactgttatcattcagttcaaaaaatttttaaatttccatctttatttcattgttgacccaaagattattcaagagcagaaattttaatttccatgtatttgtatagttttaatttttatttatttattttttctgagatggagtcttgctctgtcacccaggctggaatgcaatggtacgatctcagctcattgcaacctctgcctcccaggttcaaacaattctcctgcctcagcctccctagtagctgggattacaagcccgtgccaccatgtatttttagtacatggctggctaatttttgtatttttagtagaggcatggttttatcatgttggccaggctggtcttgaactcctgacctcaggtgatccacccacctcagcttcctaaagtgttgggattacaggcatgagccaccacgcctggtcgtgtatttgtatagctttgagggttccttttggagctaattttcagttttattccactgtggtatgagaggatactagatagaatttcaattatcttaaatttattgagactaaatatctgttaagtccatttgttctagggtatatttaactctattctttttttgttgactttctctcttgatgacctgtctagtgctgtcagtggagtattgaagtcccccactattgttgtgttgctgtgtatttcatttcttaggtctctagtagtaattgctttacaaattttggagctccagggttaggtgcatatataggattgtgatattttcctgttggacgaatcctttttttcattatataatgtccttctctgtctttttgaactgttattcctttaaagtttgttttgtctgacataagaatagctattcctgcccgcttttgatttccagttgtgtagaatatctttttctacccctttaccttaagtttatgtgagtccttatgcattaggtgagtctcttgaaggcagcagatacttggtttgtgggttgttatccattctgccattctgtgtcttttaaaaggagcatttgggccatttctattcaatgttaatacagtattgagataaggtactgttctattcataatgctagttgttgcctaaatacctttttttaaaaaaattctgttatcgttttataggccctgtgaaatttatgctttaaggatgttctattttggtgtattttgaggttttatttcaaggtttagaactccttttagcatttcttgtagtgtgtctttcatttcttgtagtggccaattctctcagcatttgtttatctgagaaagactatctctccttcatttatgaagcctagttttgctgaatacaaaattcttggctgacagttattttgtttcaggaaactaaagatgggaccccaatcccttctggcttgtaaggtttctgctgagaaatcagctgttaatctgttaggttttcccttataggttatctgaggctattgtgtcacagctcttaagtttctgtccttcatcttgactttagataacctgataactatgtgcctaggtaatgatctttttgtgatgaatttcctaggtgttctttgaacttcttgtatttggatgtctagatctctagcaaggccagggaacttttcctcaattatttcctcaaataagtttttcaaacttttatgtttctcttcttcctcaggaacaccagttattcttagggttggctgtttaacataatcccacatttcttggaggctttgttcatttttaaaattttttttctttgtttttgtctgattgggttaatttgaaagctttgtcttcgagctctgaagtactttcttctacttgttctagtctattattaaaattttccagtgcattttgtatttctctaagtgtgtctttcatttccagaatttgtgattgttttttctttatgatctctatttctctctggagaatttttcatccatatcttgtattttttaaaatttctttaagttgattttcaccttgttctggtatctccttgaatagctgaataatcaaccttctgaattctttatctggcaattcagaaatttcttcctggtttggatccattgctggggagctagtatgatttttggggcgttttatagaaccctgttttatcatattaccagaatcacttttctggttccttctcgtttgagtagactgtttcagtggaaaggtctgaaactcaaggcgtctgttcagattcttttgtcccacaggctgatcccttgatgttgtgctctctcccttcctctagggatggggcttggggcttcctgagagctggattggtgtgattgttattgctcttctggttctagtcacactgtggagttaccaggccctaaggctggtgctgaagaatgtctgcagagtcctgtgatgtaatccatcttcaggtgtcccagccattgataccagcacctgctctggtaggggtggcagggcagtaagtagactctgtgagagtccttggttgtagatatatttaatgtgtcggctttctcaaatgctggttatgctagtagtgaagttgtcatgtgaacagactcaggacctctggttagccaggatgttgcaggcagtggtatattagctgttattttatctttcctgggagcaggattattttgtcatgagttgctgtaatggcctgagttagttggctttcagccaggaggtggtgctttcaagagagcactagctgtggtgctagttgggggatctaagtttgtcttaagttggccagggttagtattctggtttctcaggcaataggtggggcataaagctcccaagaatttctgtcttttatgttcagcaaccagggcaggtagagaaataccatcaggtaggggaaggattaggtggatatgggctcagactctccttgggtggggcttgctgtagccactgtaggggatggggggtggttcttgggccaacaggttatgttccagagaggattatggctgcctctgctgtgtcatatagtttgccagggaagtgggggatagctggtaatgaaaggcttcacccagctcccatgcagttggtgaggctggtcttacttctgtggtgcaccccctcactcctcagaccttgcccctgaatgtaagtttccccactgagaaagcgagcatggctttcaggccctacccctccctgtctgcctccctgtctgcccactgggcagcttttgtgctcatatctgcagcagttcccgttcattccctggattctgcttaagaaaattcatgcctggtcaaaattattatgagtttcatttggaagcttttttccccccatgaccctccctaattctgctgtctgctttccccgagggcccctgtgagatgtagtcaggaatggcttccctgggcttgagctggagactgggagtgcctacaaggctcttcctgctgctgcttctacttttatatttcactcggctctctaaatccatttcagctgtaggtaagattaaatccttctcctgtgatctggattttcagattccccaatggggaatgtgtgttcagaggcaggttttatcccccctctcacactttgggagctcatggtttttcgcctgtctcgtggaatttacagcactgtctggcttctttcaacggatctgtttggctgtggcaagttcttgaaatcagagagcaatgaagtttgctacatagattgactcttcatgaaagatttctctgtagcattttagccatggtagaactttctttagccatggtagaactttcttcaggggtggagtcaattctccccaaccctgctgctgctttatcaatcaagtttatgtaatattctaaatcctttgttgtcacttcagcaatattcacatcttaactggggctagattccatatcaggaaaccactttgctcatttgtaagaagcaactcctcatctgttaaagttttatcatgagattgcagcaatttggtcacgtcttcaggctccactttaaaaaatgtttgtattggccaggtgcggtggctcacacctataatcctagcactctgggaggccgaggcaggcggatcacctgaggtcaggagttcaaaaccagcctagccaacatggtgaaactgcatctctactaaaagtataaaaattagctgggcatggtggcaggcacctgtaaacccagctactcatgaggctgaggcaggagaatcactcgaacccgggagatggagattgcagtgagccaaggtcgcgccactgtatttcagcctgagtgacagagtaagaccctgtctcaaaaaaaaaaaaaaaccaaaaacagttatttatttatatttttttgagacagtatctcactgtgtcctccaggttggaatgcaatggcatgatcatggctcactgccgcctcgaactcctgggttcaagcgattctcccatccccgcctcctgagtagctgggactacaggtgtgtgctactatgcctggctaactttcaggctccacttctaattctagttcttttgctatttccactacatctgcagttacttattccactgaagtcttgaactcctcaaagtcatccatgagggttataataaacatttcaaattctgttgatattttgactttctcctatgaatcatgaatattcttaatggcatctagaatggtgaatcctttccagaaagtttttgatttattttgcccagattcatcagaggaattactgtatatggcagttataaccttatgaaatgtatttcttaaataataagaccttttttagggaacccactctgtaaagacaaacaaaaataatataggacttgaaaattgaaactatcccttgatccatgggctgctatgttagtaggcatggaaccaacattaatctccctgtacatttccatcagagttcttgggtgcctaggtgcatagtcagtgagcagtaatattttggaaggaatctttttttctgagcagtaagtctcaacagtggggttcaaaaaattcagtaaaacattctgtaaacagatgggatgtcatccaggcttttgttgttcgttgatagagcacagacagagtagatttagcataattcttaagggccctagtattttcagaatggtaaacgagcactggcttcaacttaaagttaccagctcctaacaagaaagtcagcctgtcctttgaagctttgaatctaggcattgacttctctctagctatgaaagtcctagataccattttcttctaatagaaggctgttttgtctacactgaattcctgctgtttagtggagccatgttcatcaattatcttagctatatcttctggataatttgctgcagcttccataacagcactttaccttgtacctttatgttagagagatggcttctttccttaaaccttgtgaatcaacctctgctagcttcagatttttcttctgcagcttccttacctctctcagccttcatagaattgaagggagttgctgccttggtcaagattaggctttggcttaaatggaaatgttgtggctggtttgatctattcagaccactgaaattttctccatatcaacaataagactatttcacttttggccaggcatggtggctcacgtctgtaatcccagcactttgggaggccgaggtgggtggatcacgaggtcaggagttcgagaccagcctggccaatatggtgaaaccccgtctctactaaaaatacaaaaaaattagccgggcatggtggtgctcacctgtagtcccagctacaggggctgaggcaggagaatcgtttgaacctgggaggtggatagaggttgtagtgagccgaggttgtgctactgactccagcctgggcaacagagcaagactctgtctcaaaaaaaaaaaaaaaaaaaaagactgattattttgcttttttatcatttgtgtgttcactggagtagcacttgtaacagcctccaagagcttttcattttctttttttttttttttttttcattttattttattttattttttatttttattttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctactcacttcccagtaggggcggctgggcagaggcgcccctcacctcccggacggggcggccggccgggcggggggctgacccccccacctccctcccggacggggcggctggccgggcagaggggctcctcacttcccagtaggggcggccgggcagaggcgcccctcacctcccggacggggcggctggccgggcgggggggctgacccccccccacctccctcccggacggggcggctggccaggcggggggctgacacccccacctccctcccggatggggcggctggccgggcagaggggctcctcacttcccagtaggggcggctgggcagaggcgcccctcacctcccggacggggcggctggccgggcgggggggctgacccccccccacctccctcccggacggggcggctggccgggcagaggggctcctcacttcccagtaggggcggccgggcagaggcgcccctcacctcccggacggggcggctggctgggcggggggctgacccccccccacctccctcccggatcgggcggctggccgggcggggggctgactccccccacctccctcccggacggggtggctgccgggcggagacgctcctcacttcccagatggggtggctgccgggcggagaggctcctcacttctcagacagggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacatctcagaatatgggcggccgggcagagacgctcctcacttcccagtaggggcggccgggcccgaggcgcccctcacctcccggacggggcggctggccgggcgggggggctgacccccccacctccctcccggatcgggcggctggccgggcggggggctgactccccccacctccctcccggacggggtggctgccgggcggagacgctcctcacttcccagatggggtggctgccgggcggagaggctcctcacttctcagacagggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacatctcagaatatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgggaggtgtaggttgtagtgagccgagatcacgccactgcactccagcctgggcaccattgagcactgagtgaacgagactccgtctgcaatcccggcacctcgggaggccgaggttggcggatcactcgcggttaggggctggagaccggcccggccaacacagcgaaaccccatctccaccaaaaccagtcaggcgtggcggcgcgtgcctgcaatcgcaggcattcggcagactgaggcaggagaatcaggcagggaggttgcagtgagccgagatggcagcagtacagtccagcttcggctccgcatgagagggagaccgtggggagagggagagggagggagagagagggagagggagagggagagggagagggagagctgctgtcgagcttttcattttcattcacaacttggctaactggtgcaagaggcctagcttttggcatatctgggctttcaatgtaccttcttcactgaacttaatcatttctagtttttgatttaaatgagagacatatgattcttcatttcacttgaacacttagaggccattgtagggttattaattggcctaatttcaatattattgtgtctcaggaaatagggaggctccaggagagggagagagacggaggaatggctgctcagtggagcagtgagaacacatacagcatttatttattaagtttgccatcttatgggtgttgttcatggcactccaaaacaattacagttgtaacatcaaagatcactgatcatagatcactgtaacaaatataataataataaaaaagcttgaactattgtggaaattaccaaaatgtggcacagacacaaaatgagtacatactgttggataaattacttgatagacttgatagacaaaaggttgccacagactttcaatttattaaaaaatgcagtatctgtgaattacagtaaagcaaagtatgcctgtaatactagtttctctcataaacaactgcccaaaactcaggagttccaatcaaactatatttcttgctcatatcggaatgtgttgtatcaggcaactttcccaggctactcttctctgattagcaactcgctagagtctttccatctttgatgctgtcatcttaaacatgtgacttctaaagttgctatgaaaggggaggagcaggcatgggtgatctctcagggggttttatggccaggcttggtagtcgtatagctaactttggcccgtatcccattggccagaatccagatacatggccctcactcaactacaagagaaactgagaaagctagtctttcattgtgtcctggaagaagaaagtaaattgactgtgatgaacagatagtgtcatttctaccatggcaatagataaaacttctcccaggcagagaccgtagagagagtagagaaggtccacagtggaacccatagaaacctgacatttagacgttggttaaagaaaaaagagggaacaaaggagttgaggacgaatagctagaaattgatggaggtgttaggtgggtgattgaaactaacaagagtttgggtgtcatgtaaggcaggagagtttttcaagaagaaagaagttgtcagatacatgaaatgctgctgaaatgttaagatactagaaaagttggtaaaatctgttggtgactgtgacaaatattttcagtgggaatgtgagatcagaagccagattagagtggattaatgagctacttggttgcaagtctcttagagagttgtagtggattgctgaggaatatgtgtagatggctctgagacctgtctaagaggctaattgctacctttcctacctttcggatagagtggccaaaagaatggggatagcgtggccaaaaggaatgatcagaagtgacttgagaatggccagctgacctgagaaggaggcaggggttggaacattgaagatgtaggactatcttcatcagcccgtctaccaaggccgtggatggaccttagtcatatcagcagaagctgctgggatggaaactaacaatgcccaaagatcagatgcaatacagttcagtttactggaagcaagaggggaaaaagatggtgtacaaaatagcagttgcccccctttcccccaatgccaggttctctacctttgaggaatgtagtcacattcaggaggagaatcctgatttgactgtgggctatcttgaatgggagctcaaaaactaaattatgcacagttatagagaagtaaagtctacactcttgctcacacatgtatacataaatgaattggaggtaatgaagtaaagataggagtatgtgtattaaactttttaaaaagtttggttatgaagaggagtaaaaatgaagcataagttgggggataagggagagtttagggcttatttaaatgctgatggaaatgagccagcagatgtctgagatgctgaagatgttgggggtgggggttgggagaggaagaaaggattgattggtggcccttgaaaggcaagatggtaaggaaatcccgagcagaagggaggatttttaatgggaggaggagtatgggctgagatacagaaaggtttatagattaactgcaaaggcaaggcaagtttctgcctaaaggtggagaggcattgttgaatagcagtttcattcatggactctacatccgtagtcttcatttgaatcactgtttttaccatttattagtggtgtgacatgtggcaagttacttaatcgctcttgctttgttctcatctgtaaaacgaggaataataacaatacttattgttaggagtaaatgaatgaattatgtacagtattttaaacagtgtctagcatgtggtaaacatacacaattagctttaattattatggcttcttttgtttttttcttttcagtgaagtctaacttaaagttgtcagttgaaaaggggatgttttaggaatgaggaaaagatgtaaaatatttatcataaaggagagctaatggtgtgtggtaggattgcctttgatattggtgattatgaagtatagtgtcacccatcttttgtgctgtgagatttgctctaggaagcctcagctacatatgtgtaggcacaaagaagtcaggtggttaagttcattgaggtctggatttttctcaggtgagtgtgactgggtaatgggggcagagcaaggaggttaagggtatttacaggggactaattatgttgatccactgtgggctctgatgttggataagaaggaaagggaaccctgaaagagctgatggaaataggattggacttctgaggcagtagtaagagggagagaaagtctgatgggatgaatcttcttatttatttatttattatgtttattgctcatgatttatattttcctaatagaatataaacactatgagggcagggcttttctgttttttgtttgtgtgtgtgttttttttttccttttcactaatgtaatccgtgcgcctagaacaatgcctggtacatagtacatacccactatatatctgttaaactaaatgaagtaaaagaaacctaaatcagatgttggtggaggtggtgagaagtggtcagattctggatgtattttgaaggtggagctacgggatttgctgatggattggatgttgggtgtgagaaaaggagaataggcaaggataacctaaaaggttttggtcttgagctgctaaaagaatgatgttactatttgctgagatagggaagaccatgaagggagcaggttttagagtttgagtattaagagatgagatttggatatcaaatctgagacatctgttagacataaagtagaggttcagtaggcagttgatatccatctagagttaagggagtgatttgaactggaaatataaatttgtaagtcattagcacattgatggcttttaaagccatgagactagatgagacaccaagggagtgaatgaaaatataaaagaggtccaaggattgagtcctgagacaaaacatagaggagtcagggtgagagggggagccactaaagtagactgagaaggagaggccagagagctagaaggaaaaccaggaggatataatagtattctggaatttaggtgaaaaaagtggttcttttgtcaaaaagtgaccagttgttttatgttgctgagagcttaaggtgagaactgagagttgaccatttgatttagcaatgtggaggttatgggtgactttgattttgtagaaaacaaaatcttaaaaaattattttttcatgaaatttagcttaaagcctttggacagatgttaagacttcacttaggcagataatattgtttttattgtgtttgaaaatgtaaggccaggctcagtggctcatgcctataatcccagcattttgggaggccgaggtaggcgaattgcttgagcttaggaattcgagaccagcctgggcaacatggcaaaacctcatccctacaaaaaacacaaaaaattagctgagtgtggtggtgtgcgtctgtagtcccagctactggggggctgaggtggaaggattgcttgagcccaggaggttgaggctgcaggggctgacatcacgccactgcactccagcctgggcaacagagtgacaccctgtctcaaaaataatacgcatacatatatcagttaaaatagatgttaaaaaaattggttagaggtgacttcctctatgctatactgtcattcagaaaaaaaggtcaaaaaaagtcagtctttctagctgaaataaccactgatagttgtttgaaggatgattttggttagcatcctctcagaatgatatcatattctagcatggtctttatcctgagatatagaataaagcctacaactttttagtatcaggttggagaaagttccaacctgataataaaaaccatatagggcatataatcccagcactttgggaggctgaggtgggtggatcgcttgagcccaggagtttgagactagcctggacaacatagtgagacctgacaacgtgctccccccagcaaaaaaattagctggttatggtggtgtgcacctgcagtcccagctacttgggaggcttaggcaggaagattgcttatgtttttaagagttttaaattaataacttttttaatgtagtggtgtagaacttagataatggaagttctattcactggtaatttttcttttgctgttatatttgattgtcaatttttataatttttttgtccttggctgaggcaggagaatggcatgaacctgggaggtggagcttgcagtgagccgagattgcgccactgcacttcagcctgggctacagagcgagactccgtctcaaaaaaaaaaaaaaaagatgtagggtagtatctttgaaaagtatagtttaaattgagagtactttatgaacacttgcatttttagattgcttttccatttaaaatgttttaagaggctgggtgcggtggctcacgcctgtaattccagcactttggaaggccgaggtgggtggattgcttgagcccaggagtttgagaccagcctgggcaatgtggtgaaaccctgtctctactaaaaacacaaaaattagctgggcttggtggtacacacctgtaatcctagctacttgggagactgaggcaaggtaattgcttgaactcaggaggcagaggtttcaatgagctgagattgcaccactgcactctatcctgggggacagagcgacacttggtctcaaaaaaaaaggttttaagaaggtgatatttgagaattgttaattatagaattttaatctgaaacatttccttttatggaaatgattacctatctgtgttgtttaggaagattcttacctctgaagacaatgttaggaccaagatatgatagtcaagttgctgaagaaaatcggttccatcccagcatgctctcaaattacctaaagagcctaaaggtaagaaacaaaatttatttttgtcactgatttaatatactttgttcagtcttgttcttcaggtggcttttaaaaaaatcttattattttaaaataattaatagactcaagggaagttgcagtaattgtacatagaattctgtgaacccttctcccagcttctcacaatggtgtcattttatataattgtagtacaatatcacaagcaggaaattgacattgatacagtactgttaactgattgcagatcttatttacttttgatatgcatttgtgtgtgtgtgtagttcagtacagtttgatctcatgtgtaaattcatggtagtgattatagaactgctgcatctccacagaggaattccctcatgctacctctttatggtcaaactctctcctcaccccgtccctgtactcgccagagtagaaaaacaaaaatgtgtagtttttccatttaagagaatgcccacctgacatcccagcccccagcaaaacttactatagcctccactaacaaccacaccctgagctaccaaggaaactgactgtgtttacagttgaagaaaccatacagagactacactactgcatgcatccagaatcataaccaaagtgctttacccgaccaacaccacagatatagcttcaggaaaaagtccttccctccaaaagctaattccaaaaattgggactggggctgggtgccatggctcatgcctgtaatcccaacactttgggatgctgaggcaggtggatcacttgaggataagtgtttgagaccagcctggccaacatggcaaaaacctgtctctactaaaaatacaaaaattagccaggcattgtggtgtgtgcttgtaattccagcatactcgggaggctgaggcacaagaatcgcttgaacctgggaagcggaggttgcagtgagccaagatcacataccagtgcactccaacccaggcaacagagtgagactctgtctcaaaaaaaaagaaaagaaaaaaaaaaaagaaaaactggggctgggatggtggctcatgcctgtaatcccagcactttgggagactgaggcaggaggattgcttgaggccaggagtttgagaccagtgtgggcagcatagggagaccctgtctctacaaaaaattaaaaaaaaaaattagccgggcatggtggtgtgtgcctgtagtcccagctacttgggaggctgaggtgggaggatcacttgaacccaggaggttgaggctgtagtgagccatgattacccactgcagcctgggcgatagtgtgaccgtgtctcaaaaaaaaaggagaagtgagtgttacaccagatgtgcagatatcaatgtaaggacatggcaaacatgaaagagcaagaaatatgccatctccaaaggaacacaataatccttcagcagcagataaaaaattcataatccttcagcagcataataaaaaaattcatgaaatggtggacagataattcaaaattttgatactaaggaagctctgtgtaagaaagaagagaatactgaaaagcaatacagaatactgaaaagcaatacaaatcagaaaaacaattcagggtatgaataataagtttaccagagatagatatcagaaattcaaacaaattcaggaaatgaagaattcattgaatgaaatagaaaatagatcaaagcttcaataatagactagatcaggcagaagaaagaatctcagaacttgaagacaggtctttggaagtaacctagtaagacaaaaataaagataaaatgctaaaaaagaatgagcaaagccttcttgagatataggacaccagaaagtggccaaatattcaaatttttggtgttccagaagatgaagagagaacaaaagggttagaaaacctatttaatgaaataatagattaaaactttctaagtttaacaagaggtttagacatccaagaggatcaaagatcccacaaaagataatatctaaaaaggtcttctccacaacgcgttatagtcaaactgttaaaagtcaaagagaaaattcaaaaaacattaagagtgtctagtcatttataagagagctcccattagactaatagtggacttcacaggaaaaaccttataggccaagcgagagtagaggatatattcaaagttctgaaagaaaacgcctaccacccaaggataccatacccagcaaagttattctttcttcataaatgaaggagaaataaagtctttcccagacaagcaaaagctgagggaattcaccacaactggactggtcctgtaagaaatgcgttagacagtcctgtacctgaaattgaaagactagtaaccaccatcatgaaaacacaaaaatataaataaaaaccactgacagagcaaacacatcaacaatgaagggggaaaaactcaaatgttaccactacacaataccaccaaaccacaaagatgaaacaataagagagaaagaaaggacaaagaatatacaaaacaaccagaaattaataaaatgacaggaataagccttcacatattaataataaccttgaatgtaagtggattacactttccatttaaaagatgtaaactggccgaatggatatagaaacacgacttatccatatgctgcctacaagaaactcatctcaactgtaaagacacacatagactgaaagtaaagggatggaaaaagtgttccatgcaaatggaaaccaaaggtgagcaggagtagctaaacttatatcagataaaacagactttaagtcaaaaacagtaaaaggagatcaagaaggtcattatataatgataaaaggatcagtttggcaagaggatataacaattctaaacatatatgcactcaacatcagagtacccagatatataaagcaaatattattatatctaaatggagatacagtctcccgtataatagtagttggagacttcagcaccccactgtcatcattagacagattgtcaagacagaaaattaacaaacattggatttaaagtgcacattagactaaatggacctaacagacatttacagaacatttcatccagtagctatagaatacacatttttcttgtgaggaaatggaacaatctctaggatagaccatatgttaggacacaaaacaagccttaacaaataaaaaagtcaaaatcatatcacataccttcttagaccacaatggtagaaaagctagaagtcaataataagggactttggaaattgtacaaatacatggaaattaaacatgctcctgaatgaccatttggtcaaggaagaaattaaggtggaaataaacctcttgaaacacatgaaaattgaaacacaacataccaaaacctaagaagtacagcaaagcagtgctaagaaggaagtttatagcaataattgcctacatcaaaaatgtagaaggattcagataaataatgatgcaccacaaggaactagaaaggcaagaacaaaccaaaaatttgtagaaggaaagaaataataaagatcagagcagaactaaacaaaatagacactaaaaaaaaaaatacaaagaatcaacaaaatgaaaagttggtttttttgaaaggataaaccaaatcaataaatccattgctagaccaaccaagaaaaacaagacccaagtaaactaaatcagaaatgagaaagagaatattacagttgataccacagaaatacaaaagatcatcagagactattttttttttttgagatggagttttgctcttgttgcctaggctggagtgcaatggtgggatctcagttcactgtgacctccactcccaggttcaagtgattcttctacttcagcctcctgagtagctgggattacaggcatgtgccactgcgcctggctaattttttgtattttttagttgagatggggtttcttcatggtggtcagactggtctcggaactcctgacctcacgtgatctgcccgcttcggcctcttaaagtgttgggattacaggcgtgagccaccgtgcctggcccatcaaagactattatgaacaagtatacactaactggaaaacctggcagaggtggataagttcctagatatatgcaacctaccaagattgaatcaggaagaaatagaaaagctgagcagaccaataacaggtagggagatttaatcagtaatgaaacatttcccaacaaaaagtctaggaccggatgccttcaccaccaaattctaccaaacttttaaggaagaactaacaccaatcctcaaataatcctgaaaagattgaagaggagggaattctaactcattctgtaaagctagcattatgtttataccaaaaccacaacaaaaagagaaaacaggccagtatctctgatgcaatgatggttcagcatatgcaaatcaataaatatgatacattacatcaatagaatgaaggacaaacaccatgtgatcatctcaatagagtcagacaaagcatttgataagaatcaacatcccttcatgataaaaactctcaacaaactaggcatagaggaaacataactcaacataataaagaccatatatgacaagcccacagctaacgtcatactaattggggaaaagctttcagcttttgccctgagaattagaacaagacaaggatgtccacttattcatcatggtattggaagtactatctagagcagccaggcaagagaaagaaataaaaggcacccaaattggaaaaaaagtcaaactgtccctcattgctgatgatataatcttaaatctagaaaaacttaatgattccaccagaaaactctgagatctgatgagaaattcagtaaaggatacagaatcaacatacaggctggacagtgggtcacacctttgaccccaaagtgctttgggaggctaaggtgggaggtttgctttaggctaagagttcaagaacagactggaccccaaagtgagacccccatctctacaaaatattttttaaaaatgtaaaagttatccaggcacaatggtgtgttcttctagttccacctacacaggaggctgaagtgggaggatcacttgagcccaggtgttccaggcagtggtgagccatgattgagccactgcacttcaacctgggcaaaagaatgagaccctgtctttgaaagaaatacacaaaaaaagaaatcaacatacaaaaatcagtagtgtttctgtatgctgatactgaactagctgagaaagaaatcaagaaggcaatcccatttataatagctacaaaaatagtaaaatactcaggaataaatttaaccaaggaagtgaaagatctctgcaaggaaaactagaacagtgatgaaggaaattgaatggaacacaaacaaatagaaagacctccatgcccatggattggaataattaatattgttaaaatgaccatactttccaaagcaatctgcatattcagtgcaatccctataaaataccaatgacattttttatagaaatagaaaaaactcctaactttttaattttattaaaaaaaactttttttaaagatggggtttcactgtgttgcctaggctggtcttgaactcctgagctcaagcagttctcccaccttggcctcccaatgtgctaggattacatgcatgagacactgcaccccacctgaatcctaacatttttatggaacctgaaatgagcctgaataaccaaagcaatcttgagcaaaaggaacaaagctgtgggcatcacactactttacagtgtattacaaggctatagtaaccaaaacagcatggcattggtgtaaaaacagactaatggaacagaatagagaatccagaaataaatgcatgcatttacagccaactgatttagacaaaggcaccaagaacatacattggggacaggacactctttaataaatggtgctgggaaaattggatatccatatacagaagaataaaactggacctttatctctcaccatatacaaaatcaaatcaagatggattaaagactttaaatgtaagacctgaaagcagaaaacagtagttttgagatgaaaacatagggaaaacaccgtgggacattggttcagtaacaattttatggctaagacctcaaaaacacaactcaaacaacaatagacaaatgggatgatatgaaactggaaagcttctggactgggtacagtggcttacacctgtaatcccagcactttgggaggccaaggtgggaggattgcttgaggccaggaattggagaacagcctgtgcaacagagtgagaccttatttcttggtggcacatacctgtggtcccagctacttgggaggctgaggcaggatgactgcttgagcccagtaggtcaaggctgcagtgattcatattcacaccactgtactccagcctgggcaacgagtgagactctgtttcaaaaaataaaataaaaaagcttctgcacagcaaaggaaacaacagagtgaaataacaacctactgaataggagaatatatttgcaaactattcttctgagggattagtatccagaatatacaaagaactggaaacaacaggaaaaaaatcccattaaaaagtgggcaaagatgtgaatagacatttctcaaaagaggacatacaaatggccaacagatatatgaaaaaatgctgaaaaaaagctcaacattactaatcatcaggaagatgcaaatccaaaccacaatgaaatatcatcttgcaccagttagaatggctatttatgactaggtacagtggctcatgtctgtaatcctagcactttgggaagctgagatggatgggaggattacttgaggccaggagtttgagaccagccttgataacataacgagacaccatctttaaaaaaattcaaaaaattagccaggcatgaggtatgtgcctgccatcttacctactcaggagactgaggtggagggatcccttaaccccagaagattgaagttacagtggtgagctatgattgtgctactgcactccagcctgggtggcagagcaaaaccctgtctctctctcaaaaaaacaaaacaaaactattataaagacaaaaaccaacagatgctggcaaggatgtggagaaaagagaactcatatgctgttggttggaacgtaaattagtacagccaccatggaaaacagtatggaaatttctcagaaaactaaaagtagaactgctatacgatctagcagtttcactactgagtatttatccaaaggaacagaaataattttatcaaagggtggatgaatggataaagaaaatgtggcatatatacacaatggaatactatgcagccatgaagaaaaaatgaaatcatcattttgcagcacatgggtggaacttgagtttattatgttaaccaaaataagccagacacagaaagacaaattccacagtttcactcctgtgggagccaaaaaagttgatttcatatctgtagtcctagaacttaggaggctgagatgaaaggatcacttaaacccaagagtttgaggttacagtgagctatgattgtgctactacattccagccggggcaacagagtgagactctatctcttaaaaaaaaaaaactgatctcatggacatagagagtagaatgatagacgatagataccagagggtgggaagggtgtgtgggcaggaggagcatggtgaagggaggttggttagtgcaaacatatagttagatataatgtataaattcttatttttggtagcagggtaaggtgactgttgttagcaatgatgtattgtgtatttccaagtagctagaagagagaacttgaaatactcttaacacatagaaatgataaatattcaaggtgatggatactccagataccctgatttcatcattacacattacatgcatgtaataaaatatcacatataccccataatacataaaatatagcatatcaattaaagaaagtgcagattgtttctcttgcctttttttttcctgtggggacccaagggggaaagagggagggagtagaaactcaaggattaaagtggagaaagggtggcttttggaggaaagttggggtgctgataggagagaaaataaagatgaataccaggcaggaaaatttggggattgaaacaaccatcaacctatgtggtataaattgtcttcttttttatattagagtatatgcttcagaatgaggtggaagatgtatgaatttactattacttttttttagcctcagtttaggtgtgcgtttctaagtgagactatcttgctggctgattgtgattctaggttttaaagatttttcatactgaagggccctgaatgcaaatcaacttcttcagctcaacagaagtaataatggtttttgttccaatccagaaagaaaaattggctataatctgttgggggaaccagcccccaatatttcaacgtaggttcttttctattttccctaaatgtcggccggtctgagaaataaagggaaagagtacaaaagagagaaattttaaagctgggtgtccaggggagacacatgtcagcaggttccgtgatgccccctgagccgcaaaaccagcaagtttttattagcgattttcaaaggggagggagtgtacgaatagggtgtgggtcacagggatcacatgcttcatagggcaataaaagatcacaaggcagaaggtcagggtgagatcacaaggtcagggcgaaactagaattactaaggaagttccctgtcccactgtgcacacgttgtcaccgataaacatcttaacagggttcaagagcagagaaccggtctgactagaatttgccaggctggaatttcctaatcctagcaagcctgggggtgtgcaggagactagggtgtgtttcatcccttatctgcaactgcagaccctcctagagcggccattttagaggcctactcctgggaatacattcttttcccagggctgttaattattaatattccttactggggagagaattcagtgatatttctcttacctgtttttggcaataagggaaatatggctctgtcctgcctggctcccaggcagttagacccaatggtcatctcccttgttccctgaacattgctgttatcctgttctttttttcaaggtgcccagatctcacgctgttcaaacacacatgcttcatgaaaaatctgtgcagttaacacaatcatcacagggtcctgaggccacatacatcctcagcttacgaagatgatgggattaagagattaaagtaaagacaggcataggaattttacaatttatattcttctgccatggcttcagccggtccctctgttaggggtccctgacttcccgcaacaatggttgacttattgagatgggattaagcctccagtaatatgcatatggccatgtatactgttcttcattggttacttaaggaatttatgagagaattttgactgtacatacttttttaccctatgtgttagaatttaactgcccaaggtgtgattcttaggcatcacatggtacctaaaaatcatagtgatttttgtcattttagaaatagacaatacgttcacttacttcaaaaatccacaaaaaaaggttggtatcatgaagtctccctctcacttttgctctctatctgcctagtccctcaccacataccacacaggttccactgtttttagattttttaatacatcctttcagaatttctttatgtgtatgtaagcaactaaaaatacagattgctgtgttctcccctgcacactcaaggtagcacattatatatgctggtctgaaacttgcatttccagcttaatagtatactctgaagatcttcatatattagcacatagaacttcttgttcttttttttttttttttttttttacagctttatagtattccattaaagtatgtacaggttgagcatccctcatccaaaaatataaaatctgaatcttttttagcacctacatgatgcccaaaggaaatgcttattggaacattacaggttttggattttcatattaggattgctcaacctgtaagtataatgcaaatattgaaaaatctgaaatcttgaacacttcaagtcccaagcatttcagtttagggaatcttcttactactttacttggatggtttctttatggaactggaaaatgtgtgctgacattttctgaaatttaccagcatggggtcatttttactgcttttgtgtgtcttcattgcattttcccccttgtattgcttctgcttccctgtaatctgccccatcttctccagactccttagctcttgggtagatgagagataggtctgccactttatggtgagctctttcttaccggaaatgtatttttattggcattttcctaaaatctgctgctcctgggtctgcttctcttttcttcctttccatatagcttctgtagtgttcttaattttttggcagaacttagacattttttatgaatgtgtggattttatatgcgttcgttttacagaaaatgaaacttttttttaaacaatttaccttgtttttatatgatactgaaagaataggagaggaaaatttatttaattttttaatctttttccccccaaacacatggtttttcaagcgatcctcttgccgtggcctcccaaagtgccaagattacaggcgtgagccactgtgtctggccaaatttcccgtactaccatcttcttaataagattgtctctatttttaaccttgtttcttttcaaaaaatgtaacttgaggcttcagtatattttcagaaaatagaagagttgttaataacaaagaaagggacatatatataaaatatatataataagatacatgttttatatgtatatatgtatatatgtttatgtatatatgtatatacatatatgtatatgtatatatgtatgtacgtatatgtatatgtatgtatacgtgtatatatgtatacacgtatatgtatatacgtatatgtatatatgtatatgtatacatatgcatatacatgtatatgtatatatgcatatatatgcatatatgtgtatacatatgcatatgtatatatgtatacatgtatatgcacatatgcatgtatacatatgtatatacgtgtgtatatgcatatgtatacatatgtatatacgtgtatatatgcatatgtatacatatgtatatatgtgtgtatgtatatatgcatatgtatacatatgtatatgtgtgtatatgtatatgtgtgtatatgtatgtatatatatatacacatcatatatatgatataaatggattgtctcatcttttaagcctgggatataaaatggtgtagtcaatagatattaacagaattattggtggtggctgcttggaaggctggggtgggtgatttgtgccgagagcttgagttgtggtatacttcagatagatgccattcctgctctagcctcttgtctaataaatcacaggtgcagaggtatatgcagcaaacactagagaaaactctagcattttctcttttgcatagacttttgtgatgttggcagtagaatttgttttgcttatattcctgttctttccttagtttgggagttaatttattttatcaagtgcctgcttagttttagtgtcttgaataagactttgataagtgatacttttattatcaattgttcaggggcaaagtacatacagaatctccctcaatgtaaatgaatgaactgtagtattgccatttagtctacttatttgggaacaaattaagttactagtaaatttgccctttcatttttttttttttttaggttaaaatgggcttgttggtggacctgacaaatacttcaaggttctatgaccgaaatgacatagaaaaagaaggaatcaaatatataaaacttcagtgtaaagggtaagttatatattaagattctttaatattgaaacctttcatcacaatttgtaatctcttttttcaaaaaaactttttctatattactagacatggtgagtgccctaccactgagaatactgagacctttattcgtctgtgtgagcggtttaatgaaagaaatccacctgaacttataggtatgtttggctttactttgccactgttgaatattttattttgcagttaggtttctgttttcttgtttgcaaataagttgatatgaaagttttttctgttttaaataatgaccaagtagtgtttattaaaatgagagattgacttgtgaattatgtaataaatgtattttcataatttttacatttttctagataaagccctgatttcctctcttcaggtgtcctgttgggaaagtctatcctaaacactacatatttattttttatacttctacattttataattttacattttatactatattattctgaaacttcattcttttttattcaggatttctgagagcaatgtatggtgatgtaattgtagttcatttttgcttctatatagtattccattatacaaatacaccacagtttatactcttgttgatgcacaattccttcatcagatttttattgattgctactctatctataccaggcaccagctcgtggaacacatcagtgaacaaaatagaaaaaaacatcctgctcttacagagctcatattctagtgtgggctggaggctgagggaaggagggcaggcaataacaaatttaataagtaaattttcataaaatggcagttactgaaaatgacttttgagttattttcaggtttgttgttgttgttgttttgcttttataaacaatgctgctaggagtggtcttctagaatttttaaggtttggttttaaatttaatttttttttaatgaaaaattattttttgagacaaagtcttgctgtatcgcccgggccggagtgcagtgctgcgatcttggctcactgcagccttgaactcctgggctcaagtgatcctctcttctcagcttcctgagtagctgggattacaggcacacaccactacccccagctatttatttttatttttattttttgtagagacagggtctcactatgttgcccaggcttggtttgaactgctggtgtcaagtgatcctcttgccacggcctctcaaaatgctgagattacaggcatgagccactgtgcctggccaactttgcttttctgttatttctgttggtatatggtttaaattgaggatgcaatgtaaagtttccttttctttctttttttttttttttgagatggaatcccactctgttgcccaggctggagtgcagtggagtgatctcggctcactgcaacctctgcctcccaggttcaagcgattctcccacctcagccccctgagtagctgggattacaggcatgcactaccacaccctgctaatttttgtattttttttttttttgagatggagttttgctcttgttcccctggctggagtgcaatggcacactgtcagctcactgcaacctctgcctcctgggttcaagcaattctcctgcctcagcctcctgagtagctgggattacaggcatgtgccaccatgcccggctaattatgtatttttagtagagacagggtttctccatgttggtcaggatggtcttgaactcccaacctcaggtgatctgcccgcctcagcctcccaaagtgctgggattacaggtgtgagccaccgtgccgggcttaatttttgtatttttagtagagatggggtttcaccatattgactgggctggtcttggactcctggcctcgggtgatctgcctgcctacctcggcctcccaaagtgctgggattacaggcgtgaaccaccatgcctgcccaattaaatgttttctacataaccaaccatttgtttcagcacagtttattgagtagttctttctcttcttagggctagatgatgtaaattcatatatctactgtttgaaaatatttcctattcatctcattttaattttttggtaatattttaaaactttttttcatcaaatttttttgtgtcttgtttgattttaagtagctaatgtttttccttatttagataattaacggaaaaactagtagtaagaaaatttggggatatattgagaacgtaagataaaaaagaaaacatcagcaactttcctggaaacaagcaataattagttagaaaatataatcagaaaatagtcccattaatcttaacaatattggctatcacatattgaacatttcctccctgctagtctttgtgtaaaccatgtcacacacattgtctcattttcttttcatagcaattatattaggtagatagtattgttatgcccttaaactgagacttggaaaagttaagactgctgaagggtcactcacacagccagtaagggctagagtgtggattatatcctaagcaatctgagttgcatgttcacacttgaaactacctctctcttctataacagaagtacaaaacaccaaggaatttttactaataaatgtagatggtctttatgaagaaaatatatttaaatattaaaataaacatgaagaaatggagagacgttacttgtttccacattaatttcaaagttttaatgttgttctaaccaaaatcccaatgaaagttaggcagaattactttgaaattaatttgtaaaatccccacctctattaagtcactgaatattaccgagcacagaaaaaaatagtttggcaaatcagacatgcaagttatgagcaagaaaaatttgaaaaacaagagtaatgaggagatttttctttccagtcattaaatcatatggtaaagcaatggaactgatagcactagttcctggtggtaaaggagatgtttttaaattagagaggaaaggtgtgatttttcaccaaatggtgttccattagtcaaccacataataagtgaattttaggtgtattaaatatttttaaaaggaccaaaaagaatataggagaaaatagtaaatatttatttaattctggagtaaacaaagaaggatattccatgtatatcaccaaagacagaatccataaatgagtatttttcttttaggagtgctcctggactgcctgtatcagaaccacttgaagatacttgttagaaatgtatgttttagggcctatcctggacctacgtaatcaaaatgtctaaggatgaatgttaggaatccagatttttttttaagagacagggtcttgctatgttgcccacttggagtgcagtgtctatttataggcatgattatagcacactacagcctcgaactcctgtcctcaattgatcctcctgccttggcctcctgagttgctgggactacgtgcaccactgcacttttgccaggaatctagattttcaaaagaaaagtattaggtggcttttatgcagacttaaatttgagaactgctgtcagaatttaaagtatggtggctattaatgatgatagtaacagctagttgttttttttttttttttatgaggtaaggtcttgccgtattgcccaggctagagtgcagtggtgtgacttcggctcactgcaacctctgtctgcagggctcaagtgatcctcccacctcagcctcccgagtagctgggaccataggcgtgcgcaccaccacaccctgctaatttttgtattttttgtagagacactgtttcaccatgttgcctaggctggtcttgaactcctgggttcaagtgatctacccaccttggcctcccaaagtgctgggattacaggcgtgaacccttatttattaataagctagtattaataaatgcttattatttgttcagtggacttggggaactatagataaggaaagtgagtctcagagaagttaagtacttcgcccatggtcatgcatctaataagtagttgagccaggttttttctttttttttcttgtcactgctatactaacaaggataagccaggtttttaatccagtttctggctttaaagttgaaatctgtaattagttgctgtaattagtttctagttggccacataaaagagaaaaatttttgtcttaaaaaaaaacacaacaggtgggtatagtggctcaccattgttatctcagcactttgggaggctaagatgggaggatcacttgaagccaggggtttgagaccatcctgagtaacaaagtgagaccctgtctctgtaaataaaaaaattagccaagtgcagcagtgtactcctgtagtcccagctacttaagaggctgaagtgggaggactgcttgagcccaggagtttgaggctatagtgaggtatgatcacacctgcactccagcttgggcaatagagtgagaatctgtctctaaaaaaaaaaaaaaattggagaggagaatgtttgagggcaaagaaaaaaataaaacataaaacaacaacaacaaaagacacaacagaagggaggcaaaaagatgttggacaaattggggtctggcttggtggcacatgcctgtaatcccagctacttgagaggctgaggcagaaggattgcttgagcccaggagtttgacactggtctgggcaacatagcaagaattctgtctcaaaaaaagattttgacaaatttggaaaaatatctgaagcatatgtgacataaaaagttaataatcttatttatgaagatatcttatacaccagtaagtgaaagaggcattccttaatagaaaattatggaaaacaatgaaagagcaatttacagaatatgaaatacaagaagccaagaaacatgaaaaaaatttttctcacttgctaatgagatacaaattaaagtacatgctggtagctgcactccacatcaaattggcaaagattaaaaaaattatatttctgagagctcctaggggactttgccctgcattacctgggaggggtgtcagttcagttctgggttgaacaaggcccttgcacatggcatgttgggggaccagcctaaagttcttgtcacctcctcatgcgaagccagccagcactatcctggatggagccccccagcattgaggtggcccttggccacccctcctcagggcctccaggataacttgagtacccctcccggtggcttccccttcctctccctggggctgccaggggcacgttgctctgtgccatggactgaaaccagctcctggtgacagaatgacctgtttgttggaaatgccttgttgccagagaaaggaatcttggaacaaaactattttaattgtgaactggccatagaacacctgtttttttttaaatcaacttattaagttggagcactataatagctcttgctgatttagctacgatatgtttgttgaacacataatgctatgttttatgaggaaaagggatcgtaaggaagagtaatgttgcacctaacattaggtgggtaaaagtggccttgtgtttgtgtctgtttctacacagagcctttgggttttgttctcttcatcaggtaaatgtttgttgcataccctgctgcacagagaacctccctgcgtctgtttctctgctcctctgtggctgactcaataaacttttccttcttggaaaaaaaaattataatgtctgttagtgtcaaggattggataaaatgggtgcattcatacacttttgagtgttaattggtatagtctctacagagggctatgtggagagagaacatggtggtatttctcaagatccttaaaagtgtttctcttgactcatcaagactacgaacttattttaaggaagtagtcagagatggacataaagagttatgtgaaaggaatttcaccacagcttcccttggtaacaaaaaaacaacctggaaacaacaatcatcaatggtcagtaaaatcattaagtaaaatacaaaatggaaaactttataacagaagaaatgagcagccaccacttgaacccacttatgttagtaccactaaaagtgggacagccaaacattatgtgcttgctgatgtggtatgaaagaaaatacacagtaccatctataaaatattcttacctaaagtcttaaaagtgaatctaattatgtctctggatttaactatcaatttacaagacatatgggagataagagaacaagctaattgaaaccatgaggatgcaatcagataaatccagaatgtggaacatttcatagaacagtggctaggcttttccatcatattgattgcatttaaaagagcgaatcagggacacttgagatacctaacaaaaaatgcagtttgtaggtattgttggatcctggtttgaaacattaactttatcccagtactttgggaggccgaggcgggtggatcacgaggtcaggagatcaagaccatcctgactaacatggtgaaaccctgtttctaataaaaaaatacaaaaaattagctgggcgtggtggcggacgcctgtagtcccagctactcgggaggctgaggcaggagaatagcatgaacccgggaggtggagcttgcagtgagccgagattgcgccactgcactccagcctgggtgacagagcgagactccatctcaaaaaaaaaaatttttttttaaggtaattgaggaaatctaaaaacaaactaggttctagatgacgttaaggaatttataactcttcttttggtataattattgcatggtaatcatatgaaacccagagtccttattagagatgtgtattgaaacatttttagtgacatgacatgtctgtgacttgctctaaaatgtagtttaaggtcattaaaatgctaattactctgatttgatctttatacattgtagacatgtattgaaatatcacactctaccccataaatatgtatttatatatttataatacagttattatgtataaattaaaaataatagtaagagctgggcccagtggcacatgcctgtagtcccagctacttgggagctaaggtggaaagactgcttgagcctgggagttgaagtccagcctggacaacatagccagacctggtctctaaaaaattatttaatataataataataaaggcaaaaaaaaaattaatgtggttgttcctcagactcctcaggggattggttctaggatccccctcagataccaaaatcctctgatgctcagtgctcaagtgccttgtataaaatggcatagtatttgcatatgacctatgaacatcctgccgttttctttgaatcacctctaggtattacttataatacctaatacaatgtaagttctatgtgaacagttactatattgtatttttaaatttgtattattttttactgtattttttattgagttttttcccaaatatttttaatacagatataggaaggccaatttactccaaaaatattattaagggtggaggatgaaaaaaaatcagcaaaatgataattaccaaagagggatgatggatacatgaggtttcatttttctattctcactgctttgggtatgtctgcaaatttccataataaaaaaaaaatttgagagtactgccccagagaagctaacagtatggtaaaaattgaaaacatctggttctaagggtttcagataagggactatgaagctgtagttactgctaaggattagaaaaggtttcaagcttctgtgtgtttcaagaactttatatttccatgaagcctacagcattagcccacagcctcaccaattatcaactgataactgaatcagttgtcaactgtaattgataaattaacaattatatcagctaattcaaagattactttttttttttttaaagaccaggtctcactatgtcacccaggctgggatttttttttaaaaccaagacagctttgaaaagaaacctgagtctaacctttgccacatcacaaatgtttactactggtcacaaatattgatcagcaagagtttgtgcaaggctgataaaaattccttctctgaaactaaaaataaatgaaagtactataaaagcaggacagtattttcagatcctaagactacttaagcttgattctttagtgctttttatttagaaaggtgttatcagcaatcagttctgagactagtttctgttattgtctctacagtaatactataagaaataactggcaatacatcctgtgctccaaaatttggcaggcccaaagcaaatgtttccaattcaatccacatgaacagaatcactgccgggaatataaaacaaaatatatatatatcactaggttctataaattttataacctgtaaacactcaaaacaattagaagtttttcttatcagttcttctaagaatacaactgcacaatttataacaaggatgaatttgttttcctaaacctggagtatgaatctttctaaaatcatgacatctaatgccagaggttaaaattgcttgactgccctcctttgaattcattaagcatatttaatgtttacccctataatggcttctctcaaatgagaaaacacttctgtgagttgtttttacttattcagataaaggcctcagtattaccttaagctgtgtaggttctagtcatatacctcaatatatgtgtatgtatgtgtgactgttatatatattcatataaatgtatgaatatatatacacacatccttaacatatttcatgtatatctcataatattgttctgttaaataatagctgcatactgtaccatataaataacctgcttttttcaaaacaacaaatacagtatagtaactgttcacatagcacttacattgcattaggtattataagtaatacctagaggtgattcaaagaaaacggcaggatgttcataggtcatatgcaaatactatgccattttatacaaggcacttgagcactgagcatcggaggattttggtatctgagggggatcccagaaccaatcccctgaggagtctgaggaacaactgcattaattttttttgcctttattgtattatattaaataattttttagagaccaggtctggctatgttgttcaggctggacttcaacttcatcccacaaattgtaacaattaaaattgtctctagacattacaaaatgtcccctggggggcaaaatcttccccagttgagaactactgaatcctcggtgcagtggctcacgcctgtaatcccaacactttgggaggccgaggcgggtggatcacctgaggtcagagtttgagaccagcctgaccaccatggtgaaaccctgtctctactaaaaatacaaaattagccaggcgtggtggcgcatgcctgtaatcccaggtactcaggaggctgaggtagaggttgtagtgagccgagattgctccattgcactccagcctgggcaaaaagaacaaaactccgtctcaaaaaaaaaaaaaaaaaaaaaaaaaagaactactgacctaattagactgatcaaataattaggatttttagcattaaaaaatttatctagctagtgagatagaaataaaattgtgggccaggtgtggtggctcatgcctacaatcccagaagaccaaggccaaggatctcttgagcccaggagttcaagaccagccttggcaacatagagagaccctgtctataccccccacaccctccaaaatagtgtatgttgagatcaggctttatttaaaaagatacattgtcaccagcccctttataaactgccccaacatgtatagctatagctaatctctctgtctatttgttggggagtttctttccctagtttgattgtaaatgccatatacatttatttcattatattagcttgcctggaaaaatttgaatagaagttgccttgaaatagttaattgtgagctaatatttagttaaaaactgtggcttacttaccactagatggacccattctcatgatgaagaaaactgaaaattgctttaaacaaaaactgaagacgtatctaagcttgtagtatacctaattaatggattttttaatatcaaatacataatctcccacatttttctatagtggtttgttttgatggttttgtaactttataaccctatctataaatgttttgatgtataactgaaccattagactaagactttttgtatttgcatataaagaatattaaaaggaaaatggtactttcctagattacatatcttcacatgacatattagctaattggcaattattattacatttcctattcataaaaatatttaatcttgcaagagtaaaaattggatacaaaaacagtagcttaggtgagaaacatcgaaagttgaaatatttgttgcttgaattggtctgaaatagaagatagtaaggaaatttacatgttgggttaagatacatgaatacaaaaatgtgtttatagtgcacatctttgtgtggcttttttgaagcactttttcttacaaagcaatggagataatggaatttatagattttcttggtcatagctatttatttctaagtgatgtcttcagttcaaggctgatctctttgttttttattttcttctttcagaaacttaatttcacttatatcgtttctattattgtcaagctttgtggtttaactaggttcttgtcctgagcctgtaaacatacctaaacttgttaaataatcccctcccgctgaaaaaaaccccgtacccttctttctgttttgcattccctcttccctttctcagctgactttttaaaagaatctatacttgaatccattttttcctatccactttgttgcagtctggagtcctccctcagcactgttttttgtttgtttgctttttaagactgtgtctcactcagtcatccaggctggagtgcagtggtgcaatcatagctcactgcatcctcgacctcctggtctcgagcaatcttcccacctcaacctcccgagtagctggtactacaggcacttgccaccatgcctggctattttttaaattttattttttgtagagacagggtcatactgtgttgtccaggctggtcttgaactcctggcctcaagtgatattcccgcctcggcctcctaaagtgcagggattacaggcatgagccactgcacctggctagcactcttaatcaaatagtgattttccattctaatcattatgtgacatctaagcactcataacttagaaaatttcctttacttggcatacatgaccctgtgtttttgttctttgaagcccatcatggttcattctcagtcttttttttgagatggtgtctcgctctgtcgcccaggctagagtgcagtggcatgatctcagctcactgcaatctctgcctcctgggctcacgcgattctcctgccgcagcctcccgagtagctgggattacaggcaaccgccaccaaccccagttaatttttctatttttagtagagatgaggtttctccatgttggccaggctgattttgaactcctggcctcaagtgatccgccaccctcagcctcccaaagtgctggggtggggattacaggccagagctataatcagccgtgggagtggtttttctaaactctgataattttattgccatgcttaaaattctttactatatctccattgcctttataatctttagtatgtttcacaggtttttttaggattttgaccctttcattttctccaactgcatttggcatttcttaccacagctcatattctagccattctgatttatttatagtttgccatatgtgcttttttgattaatatatttacatttgcacagattgttcctactgtctgcagttccattgtataaatatccttttttattgagagttgttcaatgactaaggtttttattctaaatattaatggtcattttattataccaggaatgtagaaattggtgatttggctcaattgatagttgttttcaaaaaaattttaaaagtagcatgttttgtggtgggcaggcctatgcaaacctattctcaaagtccaaggaagcaaagaaaccaaagaaagagactgacaaatccggtttcttagaaagatatatttaatagggacttaaaaagaaaccagtcctgcttgtcaggtggcagtgagataagatggtggatccccaccattactcccaaggccagggcttataaaccacaggaaacaggtgattcagaagggttaagtagaacaagtaagtacaatcacatcaaggttgtttttacctttgggcaggatttatagttaggacatgctcttacacaaagaacagtagataaactagaaatcttagaggccttcccagaactggggttaatcagaagtcaacataggcagattagcatccaagatggagttgctttggcctccacatagtaaaaaatttttttggaaagaactcctaccataatatacaaatgagattaaagtgatttttttggcatatatttttaaatgtatcaaatgtataacctgggtttttgataaagttcattgctgagaacaaggccatattgatgaacacaaatatttggattatgttattaatacaaactacagacttataccagcatctcactttagcatctagctaaaaaaacaacatattgagatataattttatataaaacagcattcatttaaattgtacactctgatgatttattttaatttttgagacagtgtctcactctcacccaggcaggaatgtagtgacgccatcacagctcacagccccctccacctcctggactcaagcgatcctctcctctcagcctctttagtagctgggactacaggcacacaccaccatgcatggcgaatttttgtattttttctagagacagggtttcaccatgttgcccaggctggtcctgaacttctgggctcaagtgatctacccgccttggcctccaagtgctgggatcacaggcatgagccacctgcctggaagaatctgaggtttgatagatgtagatactggtaaaaccacagtatgagggttccagttcctctacatcctcaggaacacttgatacggtcactcttttcaattttagctattttaatgaatgtatactaggatctcattgtggttttaactcgcattttcctgataattgatgatgttaagcaacttatgtgcttcgtggtcttacatattttgttttgtaaagttcagatcttttgcccaggtttaaaaaatactgtgttatcttattgaactgtaacagttttaaaaaaaaatttttatttgtatcagcaaatattgcctgacaaaatagttctttatatattccagatataagtcctttgccagatatatgggttgcaaatattttctgtggctttccttttgcttttttaatttaaatttaaattttaggttcagtgggtaacatgagcaggttgttataagggtatattgtgtgaggcaggagtttgggcttctgttggttttattacacagatagtgaacatagtacccaatagggagtttttcagcccttgcccttgttcctctcttcctcctattggagtccccagtgtttgttcctgtctttatgtctgtgtgtacccaaaatttagctccagcttataagtgagaacatgtgataggtggttttctgtttctgcgttaattctcttgggataatggcctccagctgcatccatgttactgcgagggatgtgatttcattcttttttatggctgcatagtattctatggtatatatgtactgcattttatttacctagtccaccattgatggacacctaggttaattccatgtctttgctattgtaaatagtgctgtggtaaacatacaagtgcgggtatctttttggtagaatgatttgtgttcctttgggtatatttccaataatgggattgtgggtcaaatggtagttctatttttagttctttgtgaaatctccaaattgctttccacagtgactaaactaacttacattccccccaacagtgtataagcattcccttttctctgcagcctctccagcatctgttattctttgactttttagtaataaccattctgactggtatgagatggtatctcattgtggtttttatttgcatgtccctggtaattgatggtgagcattttttcattcttgttgggccacttgtatgtcctcttttgataactgtctgttcatgtccttttcccactttttaatgggtttatttgttttttgcttgttgaattaagttccttgtagattctggatattagtcctttttcagatacatagtctgtgaatattttctcccattctgtaggttgtctgtttactctgttgatagtttattttgctgtgcagaagctctttagcttaattatgtcccacttgtcaatttttgtttttgaggacttagacataaattctatgcctaggctgctgtccataaggctatttcctaggttttcttccaggatttttatagtttgcagtcttacatttaagtctttaagccatcttgagctttttttttgtatatggtgataaataggggtccagtttaattcttctgcatatggttagccagttttcctagcacactttatcgaatagggagcccttttcccattgcttatttttgtgactttgttgaagatcggttagttgtaggtatgtggctttatttctgggttctctattctgttgcatttgtctgtgtgtcttttttttgtaggagtaccatgctcttttggttactgtagccttattagcatagtttgcggttggttgtaatatgatgccttcagctttgtcctttttgcttaggattgctgtgtctatttgggttctttttttggttccatattttataatagttttttttcttctgtgaaagaaaaatgctgttggtaatttgacaggaatggggttgaatctgcagattgctttggacaatatggacattttaacgatattgattctttcaatccatgagcatggaattttttttatttgtttgtgttgtctgtgatttctgtcatcagtgttttgtagttctcctagtacagatctttcacctccttggttgggtgtattcctaggtattttatttttttgtgtggctgttgtaaatggaatcgtgtttttcatttggctctcaggttgaacatcattggtttatagaaatgctattgatttttgtatgtagattttgtgttctgaaaatttactgaaatagagaacatatgatgtcctctcttcctatttggatgccttttatttctttcttttgcctgattgctcttgctagcacttctagtactatgctggataggagtggcgagagtgggcatccttgtctggttccttttcttaaggggaatggttccagcttttgtctgttcagtattatgttggctgtgggtttagcatagatggttcttattattttgaggtatgttcttcaatgcgtagtttgtttaggattattatcatgcaggaatgttggattttgtcaaatgcttgttttgcagccattgagatgatcatgtggtttttgttttgaattctgtttatgtgttaaatcacacttactgattttcgtatgttgaaccaacattgcaacccaggaacaaagtttgcttgaagcagtgaattagctttttgatgtggtgctggatttggtttgctagtatttttttgaggatttttgtgtctatgtttatcagggatattggcctacagtatttttttttgttgtgtttttgccagattttggtatcacaatatgttggttttgtagaatgagttaggaaggggtcccttctcttcaatttttggggattgtttcagtaggattggtaccagctcttctttgtatctctggtagaattgggctgggaatccatctggtctagggcttttttttttttgttttttttttttgtttttttttgagacagagcttcactctactggccaggctggagtgcagtgctgcaatcttagcccactgcaacctctgcctcctgtgttcaagcaattctcatgcctcagcctcccgattagctgggattacaggcgtgtgccaccatgcctggctaattttttgtgtttttaatagagatggggttttgccatgttggcctgtctggtcttgaattcctggcctcagtgatctgcctgcctcagcctcctaaagtgttgggattataggtgtgagccactgtgcctgactagggcttttttggggttggtaggttttttataactggttcaatttcagagttcattattagcttgtccagggtttcagtttcttccttcttcagttgtgaagttgtgtgtttccaggaatttattcattttctctagattttctagtttgtgtgcatagaggtattcagaatagtctctgaggatcttttgtatttctgtgtggttggtcgtaatgtcacctttgtcatttcagattgtgcttatttggatcttccctctttttttttctttgttaatccagccaatggcctgtcaatcttgtttatcctttccaagaaacaacttttcatttcactatatggttttctttacatggctttttgggtctcaacttctttttgctctgctctgattttaggtatttcttttctcctgctaattttgggatttgtttgtttttgtttttctagttcctttagatgcgatattagatagtttgagatctatcttcttttcatttctttttatttttggtggcagggtctcactctgtcagccaggctagaggtcagtagcacgatcatagctcacagcagcctcaagctccagggctcaaacagtcttcctgccctagcctgagtagctaggattacaggtgcatgccaccatgcttggctgattttcagcatttttttttttttggtagagatggggtcctgctttattgcccaggctggtcttgaactcttgggctcaggtgatcctcctgccttggcctcccaaaatgctgggattacaggtatgagccaccatgcccaggcctttctgtcttcttcttcttctttttattttattttttgaggtagggtcttactttatcacccaggatggaattcagaggcacaatctctgctcactgcagcctcgacctcctgggttcaagcaatcctcccacctcagcactccccaagtagctgggactacagcaatttatttattttattttttgaaattttttgtagagacaggagtcttgctatgttgcccaggctggtttcgaactctagacctcaagccatctgcttggcctctcagagggcaagaagtacaggcatgagccactgcctccagccatttctatcttcttgatgtaggtaggcatttagtgctgtgaattttccttttaacactaattttgctgcatatcagagattttggtgtattttacctctgctttcatttgtttcaaagaatttttgttttctttcttaatttcgttgtttgcccaaaagtcatccaggaggaagttgtttcgtttccatgtaattgtgtggttttgagtgtttatcttggtattgatttctatttttatttcactgtggtccaagcacatacttggcatgattaagattaaaaaaaaatttattgagacttgctttagtacccatctggaagttcttgttttatgaatctgcgtgctacaatattgggtgtatatacatttaggatagttaagtcttcttgttgaattgaactttttatcacgtaatgatcctctttgtccttttttattgctgttggtttaaagtttatttatctgaaacaagaatagcaacccctgctcttttttgtttttcatttgcatgatagatctttctccatccctttactttgaggctgggggtatgagttagtttcctgaagatagcagaaggatgggtctttttttatttttttcatttttaaattcaacttgccaccctgtgtcttttaagtggagtgtttagactgtttacattcaaggttaatgatacgtgagatttttttcctgcggtggtgctgttggctggttgctttgtagccttgattgtgtagttgttttatagggtctgtgggctgtgtacttacgtgtatttttgtggtagcagatactgtttttgtttccatgtttagaactcccataagcatctcttgtaaggccagtctagtggtaacagattcccttagcaattgctaatcctgcaaagattttatttctccttcgcttatgaagcttaatttggtgggatatggaattcttggctggaatttctcctaggatgctaaatataggcctccagtctcttctggcttataagatttctactgagaagtctgctgttagcctgatgaggttccctttataggtgatatgactctttttctagttgtctttaagattttttcttttacatagaccttggaaagtctgatgactctgccttgatgatggtcgttttgtatagtaccgtacaggggttttctgagtttcttatattagcatgttgacctgtctagcaactttggagacatttttgtggattatatcctcaaatatgtctttcatggtgcttactctttcttctcaggaatatcgtgggttgtaggtttggtcactttatgtaatcctattatttctcagaggctttgttcatttgttgaagattctttttctttatttttgtctgactcagttgcttcaaaggattggtcttcaagctctgagattctttcctctgcttggtttagtctgttgttaagcatctcttataaggccggttgttaagatttttaattgtattttgaaattcctgtggtgaattgaatttcagattggttcttccttagtatagctatgttatattccaaatcttggattgtttttctgacttccttggattggatttcaaccttctcttgggtcttgttgagcttccttgccatccatattctgaattctgtgtctataatttcagacattacgttctggttgggatccattgctagggagtatatgcaatcctttggaaataacaaaacactctaactttttgaattgccagagttcttgcactgattacttctcatctgagggaactggtccttctttttgtttttgaatttgctgttgattgaatgggttttttttttttaaatattcttttttcccttgagagtttgatggtggtaaatgttgtgtatagtcagttggcttcatttctgggtgctttcagagggccaaggctctgtatgagttccttggttgtagataggtttctatgagggtttcacaggctttgcatgttgaagcagtgtattttgttttgctgtgtaattcaagctgcagttggtgcttaaatataagggcagataggctcttacacagctgcgcatgctccctttgtatttcattgtgtcctcagcagtgctctggagagaggacgcagggtaagagatgactttctctcatagtctgttcttaagccttggtggtatccccctcagctactggcactgtctcacgtttcctttgctctgtgtggggctttggtgggcttctcttcctgctcgcttagatatgattcaagccaagggttaggccaccaggagacctgaaactccttagggacctaccagtcccctgtgcttgtcagtaagagtgggttgtggggtatgtctgcaggtggtctggtaatgcagtgggtcaagcaagggtggtagatcctcaggcagggaagtggcaccgtatgtgtgtgtagccagtatagtgaccatggcccgggtttgcagcccagccgatggctgtgtggccctcacaacttgcactcccctgacctggttggtctctgtctgatgtctgtctcaggagcaggcgcaaccagactggccaggcttgtctcaaaagccctgcgtgcccagttcgttgagccatttcagatgctccaagccacggagcttcctggggaagaaaccttggctggctgtcaggccacacccatcctggactggtcttctgaagagaggttgcttagtttccatgccacactcttctctgtattctgagagtgaaggctcctttcctgcccaagctcaggccacagagcttaactcaatacccctgggcagtgtgcttgagtcctggggaagtgggaccaggcctgcacatttgtcctctggccccttaggatcagccagcaggctgccagcagaacactcaggcagggaagtggaggctgttctgtgggcactgtcttgcaggagcagccaggcaggcagtctttgaagagttggcaggcaaaggggcatgtggatcagatacactatggtcctatggcagtggcagtcttactctcttcgccctgcagatagcaggacctgcagccactcagtacaagctggagagccttggaggatgggccctatggtggtgttttgctgcagctgcaccgtggtctgtggggctcatggctagaatcttgtagctaggatcccagaggaccatggtgggagtgtggtgccccagggttcctttactcagccctcccttaggtccacactggaactgggggccagtcctggtgcctagttactccaagcagtctacgtcgcttcttccctcttcaaacactgtgtctgctttgcctctctattggctttcagtgttttctctcaaaagatctgttcaaagttgcaggattttgtattgtcaagttttggtggttcaaagtgtggtggcttacttgatattttggttccttttcatggaagaggcgtttttcagctgtaggtagttggccgtcttgcctagaactcttttttatattcttaatgatgtctttcaaagagcaaacccttgctattttgaaatagtctaatttatcagtatttttcttcattttatgctttttgtgttttatctaagaaactttttctactctaagcttgcaaagatttactcctgtattttcttctagaagttttgtaaatctagctagtttatttctatatttgatcttagttgcactgtatcagtatgatctatatatacagagaagaataatttgtagaaggtaatattagaaagatacaggctgggcattgtggctcatgcctgtaatcccagacttggggaggctgaagtgagaggattgcttgatcccatgagtttgagaccagcctgagcaacataatgagaccctgtctttaccatagaaaaaaattagctggggatggtggtgtgagcctgtagttccagctactctggaggttgaggtgggaggatcacttgagcccaggaggtcaaggctgtggaacctgatcatgctactgaactccagcctggttgacagaatgagatcctgtctctaaaaaaaaaaaaaaaaaaaagatacagcttaaatattaggatatcctttaattaaatagaaataacaggaaaagcttcattttgaagactgtaggagagtcagcaatattgtcatgttttaattactattttcaaactagttatattcgtctcttctcacataaagatactactcgagaatgggtaatttatgaaggaaggaaatttaatggactcacagttgtgcatgcctggggaggcctcagaaaacttacaatcatggtggaaggggaaacaggcacgtcttaagtggtgagaaaagagagagggcatgtgaaggaggaactgtcaaacacttacaatcttagtggtgagaagagagagagagggcatgtgaaggaggaactgtcaaacacttacaaaaccatcagatctcatgagaactcactcactatcacaagaacagcatgggggaaaccacctccatgattcagtcacctcccaccagatctctccctcatggggattgtggggattacaaattgagatgagatttggacggggacacagagccaaaccatatcagtagttaaaatgatcttgaatatgttctgagaaagagtttaagaaaataaattttctttcctagctggtttctttcttttaaaaatttatttagaaagattataacctaacttgaaaatacagttagttggtttctagagagcttcaaggtaacttaatttttattgtactatatatctatcagttaattattttctgtagctagtcacttttgttgattatatttaattagtatcaggccccatatgaatttatatttctattagtttatttgctctgttctagcttctggattttagaaaataggatttgactattttgcaaatatatgccattgatcatgaagaggaccgttttttttctactagagaaatttaaagtttgagggtcagaaggatcttgtgtgtatgtgttttatgtgtccttttgagttgtgtgtttgatgaaaatacctccttatttaaaatgcttggaatcttctagctttaggagaacttgttaaacagtagagacagttttacatcaataaacctatatattacacttaaacttctagctagttataaattagattctaagcaattcaaactgacaagttttcaagttataagggtgtttcaagttaaaaaattaaaaaatgtaattattttataaactagctgaaatgttttgattgcaggttggaattttaaagtaaatgtggcctctgcagtgatttgttaattttaaccaaagctactttattttctaggtgttcattgtactcatggcttcaatcgcactggtttcctcatatgtgcctttttggtggagaaaatggattggaggtatttgtatcttgttataatggaagatgtattttgtaataaaaaattttattgatattttagttgcagaattttgtattgtcaagtttttggtgaactcatgattaatgtaatttgaactgcttttcattttagatatggttaatctttatactaccattacttggtgtgtgtgtgtatgtgtgtatgtgtatatatgtatgctttgttttgttctttgagacaaggtttcctctgtcatccaggctggagtgtagtggtgtgatcatggctcattgcagcattcacctcttgggatcaagcaatcctcccgcctcagcctctcaagtagctgggaccacaagtatgtgccacccatgcctggctaattttttcttttttgtctagtgaggaggtctccatatgttacccaggctgatcttgaattcctgggctaaagttatcttccacccttggcctcccaaaatgttgggattacaggcatgagccaccacacccagccaggtgttttgcattaaccagcaaatcactttgagtgcttatgaatttcataaactgtatattcactttttcagatttttttcacctcttacagaattatcagagacagattcttccaatattttgtattttagtatttttgggagagtgttactccatttaagccaatcaacatgtctttattgagcatctgttatttttgaagtgtgtttttagatcctgagagattacgactttagtacccaatattcttaagagaatatattactaactgaattttcttgttgactgagggagcatcattatttatgtttacaaagattttcacatagtaggtccttttttgaatataatcagttgaagtacacatatgattttgaattttgcagtatgcattgttggtggttctgtactgcatgtactttctagctctgaccattcagatgctctccacaatgatctcagtttcctatgtcagatttagcctatgcttatcctctctttgatgatctagactcttagtgcctggatctgttgaaagttcctgtaaaatcaatatgcttttactttgctcacattgttgtttttttgactgatgttttgctgcagagtcagacctcaaccttcaagactaaattcttcacagaccctatctaggtctctactatatactcatagcaatttatttttagaatttcagaattttctgaataccttatattaaaaccttttcagaatgaatgtgtcccttaatagattgaatgacttgagggtgaggattgtgatttgcccattttataaacttctgttgtactttatatggagccttgaatataataagtgagtttttgataagcctgcataaatagaggatagcgaggaaattgcatggtgtttgtttcctatagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaacccgggtcaagtgcttcttttggcaaaaggagaaaagaacggttaaaactggtaatgtttaaaaatattataataggttttttttttcctttttctgcaagcttattgagatttataaaaatggaatattggccatgtttctttagctaggtttgtcagatgattcatcctagccctttctaaaaaaaaaattttttttttttggagagaaagttttgctctgttgcccaggctggagtgcagtggcagccttgaccttctgggctcaagtgatcctcccacctcagcctcctgagtagctgggactgtagacatgtgccaacacgactggctaatttttaatttttacattttctgtagagaaggttctcactttgttgaccagtctggatttgaactcctgagctcaaagtgatcctcctaccttggcatcccaaagtgttgggattactggcattagccactgtgcttggcctttaaaggttcttaatagccacgagtctgtcttttcaaagagaaaaattgcagttacgtaaatttttcctgtttttgtttcttatgtctttagatattagataatatctaaaagaacttttagatattagattgagaacttactatttctttacaaagtattgtgagatttcaactaaatacctagtgaatatttttactaatgctttacaaaattgtcacataattaaaataactttacatatgaattctgcatccccctccctgggtgatgctttcatggtttccataaaattaaatcaagaagactctcacttctctagccaacctttaataatcttctagaaataaaagagctaaccataaatatgaggagttatcttcttttactggaggataggggaactgttgagaggaaaagtattggttgtacttgtacacacacaagtatatgatataggccaaagggaaaagttagggaaagtatggaggtaattgtgttaatgaaattattaattaaggttcctagtatattatggttgagtggtatataccacgactcatttattagtaggcatggttcacaggcaaggaagtaaatgctttgttagtttatgtaaaccatgtaagttatttttggcttaaaaatttttttttgtttgtaaaacaatgttttaattgcatttacacattttaaatttcaagactataaggacactgaaaagtgtaaattgcttcgaaacatagaaattatttcaaaagtaatttattattttattctgatttattatttcctggatttagatatctgaaattactgagtcacatacctagaaaaataacaatcacattctaaggaaacttcaataagcagcatagcataaaatataggttttgtttgtttgtttttggagacagggactcaactctgttgctcaggcaggagtgtggtggcatgattatggctcactagtggcagcccagccttgacctccctgggttcagtgatccttctacctcaacctcctgagttgctgggactactacagtgtatctcttacaagcaccatgttgctgggttttatttattcaggcaacagtttttgccttatcatttagtccatgtacatttcatgtaaagattagattcaaattgtcttactctttttttgtgccactagtggtatgttcctttcttgccttctttatggttgcttttattcttctattaccccaacccattgcttgttgaccatacattcctttacttttcttttattagttactcaagatttcatggccaggtgcggtggctcacgcctgtaatcccagccctttgggaggccgaggtgggtggatcgtgaggtcaggagatcaagaccatcctggctaacatgtgaaaccccgtctctactaaaaatacaaaaaattagctgggcgtggtggcgggtgcctgtagtcccagctactcgggaggccgaggcaggagaatggcttgaaccccagaggcagaggttgcagtgagccaagattgcgccactgtacccagcctgggtaacagagtgagactttgtctcaaaaaaaaaaaaaaaaaaaaaaaaagatttcactatacatctttttaaaggctggtatatattagtacttttgtcactttttagacaatgcaaaaatcttatttgtttatttttgagacagggtcttactctgtcagtcaagctggagtgcagtggcttgttcatagctcattgcagctttagatccctggggtcaagggatcctcccacctaagcctcccaagtatctgtgattacaggtctgtgccaccataccctgctaattttattattttttttgtagagacaatgtcttgctattttggcagggatagtcttcaactcctggcctaaagtaatcttcctgccttagcctcccaaagtagtaggattataggtgtgagctgagccactgcgcttggccaagaattttacaatcttttattccatttacttattcctatcttttttggtattgtgttttttaattctatgtgtatcttaaaccccatgatgagaccttttatttttatttttatttttttttaaagagataggatctcactctgtcatccaggctggagtgcagtggtgtgattgtagctcactgtactttgaacttctgggctcaagctatcctctcatcgcagcctcctgagtagctgtgactacaggtgtgtgccaccatgcccggccatggcatttttatacagctattattggttaggtatacccacatatttaccctttctgctgctctttctttcatgtatttttgtggttccattttggatagttttccttctaactgaagagcttcctgtattatttccttccatgtgggtatgctgttgcacattcttttagtatttgtgtgaaattgtctttttcgacatcattttgaagaatgttttttctgagtataaaaatcagggtggttagctgggcgcagtggctcacgcctgaaatcccagcactgaggcgggcgaatcacgaggtcaggagttcgagaccagcctggacaacatggtgaaaccccgtctctactaaaaatacaaaaaaattagctcggcctagtggcaggcgcctgtaatcccggctacttgggaggctgaggcaggagaatggcttgaacccgggaggcggaggttgcagtgagctgagatcgcgccactgcactccagcctggtcgacagagtgagactccatctcaaaaaaaaaaaaaaaaaaaaaaaaaaaaagatcagggtgcttgacagttattttttttctagcactttgagtgtttcattccagaatttatttctgttgagaagttagctaccttgttgcttctttgaaggtaatttcttattgtttttgattttcagcagttttaccatgatatttctacttgtggttttctttgtatttatcctgcgtggtgtatgtaggaattcttaaatatatagttggagtttttttcctaatttgttttagacaatttttggctgttatctttttaagtattgtttcagatctatttgttctttcttctggagctcaacctaataccagtaggcctttaaatttttttttttttcttttttcttttcggagacagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaattaaggattgagctgttagaaactagactttagttttggggcagtggtctatttttgctctgctcttattcctatagcctgtgaggatcttcattgaaagtgtggggaattaaattggactccttccacttgaagacctgtaactccagcttttatttcccattgctgtgatattactgaaatttctgttcagcttcttagtgtcttagctaccatttttgaaacagtgcctctagaggagagtactagaaaggaaaagctgtagaagatgtctagctcacctctctggcctcccttcctcctgagtttttggcccttcaagtccttattgcctttctaattctctgaggtcttcaaatgaattctttaacattgtccagcttttttttttgtggctacaaagttagtctaattaggctgggtgcagttgctcacacctgtaatctcagcactttgggaggccgaggcggaaggattgcttgagctcaggagtttgagactagcctgggcaacgtagtgagacctcgtatctacaaaaaattaaaaaattagccaggtgtggtggtgtgcacttgtagtctcagctacttatgaggctgaggtggggtggattgcttgagcctgggaggttgagactgcagtcagtgagctgtgatcatgtcactgcattcacctgcacttcaacctaggtgacagagtgataggctgtctcaaaaaaaaaaagccgaaaccttctttctctctttttggagaaagcaattagtcttgatttctgttatgagttggtgatttttgagaatatttgtgcttatacctccaaaggccgaattaggaaaaaaaaaaagttctaaaaccttatgccttttggtagttttttcttttttcaaaccataattagtaaatcctaaaattattaaatattttactcatataagtaatatattaaagatgaaagaacattaatctttagtttattaaagaaagtttgaaaacgaaagaaaacttataatccttcaactttcatactaccattggtattgttgtctttttagaataatttttccctatttacttatttatttagctttaaaacatacacagatgacttaaagatgagtttttttttttttgtaaaatataaatgcaaacatctaggagtatatagagttaaaaggcaaaatatttcttcattcccaagccatttgctctgtactttttggttatttctttgcatatgcacagaaaacatagtatagaagaataacttagtgtagaagaatatatactggggagatacatatatataatatatatatatacacacacacacacagtatatatactaaaaattatatattgtaaaaattaagtcctatataaaagtaatactagatatactaagaaaggaaaaattaaaaatttttctatttgagaaagcaaatagaacctttctttagaagacaagagaggctatcaatccataaaataatagcaggctattaagaagaggaacaaattagagatcttggaaatgataagattaaaaaaccacttagtatgtgggatgagtagcagaatgaaattatcaagctagaggatctagctatgaaatccttccagcatgcagcatgaaaagacaaaagaaatgtaaaatatgagaaatagtttagaattaacttaaagggagcaatttaacagtatgatttcatggagaggacaaaattcaataaggacggaaagtatttatctgaggattattttctgtggtgcagtagggctgggtcagactggtaattttaagaagctaatggaaggcgagaaagtggagactgagttgtgttaggggttccctgtaccaccctcacttctggagatttattagaataactcaggactcagcatatggttgtactcataactcagatttatacagcaacgtactaaggatatacagctcaatcataagagacaaagacaagtagagtctcgggggagttaatgtgtaggctttcttgtgctctctttttctcatgaggggtcatcctgagctcactcttcctgcagcaatgtatttgtgatgtttctgtccatggaagctcattacactctcactgctcaagatttttattgatggccggtcatgtaggcactctgtgcttagcatgtagcaaaattccaggattccaggaggaaaaaaatttattcagcataaactgtatttttgggacaagtaatctaggtttggtgagccatccttatcagttgactgagaacactccaaaagtcaagttctcaggtgccattcaggagccaactttgcaagcactagtgttaggttaacccttttctgcacactactataaactattcattcaagtggcttggttatgataaaaaaaggagcagaagggtaattgatgcagacatagtcagaaaaggctttttagtatgggataaattcaagcatatttattagtgtggataaggagctagtgaagtcaatgaagttgaaagtaaagatttggggaataatgatagagaaatctctgaggaagtgcaagggaatggaggtcaaatgcagtttttggagtaataggtcttcagcaataggagggaaatatctttcttagtactggagatgtaattgagattgtgattttttcctcagtaagtttcagctgcctatgtatgagagtggaaaagactaacggtaggttgactcaaggctggagaaattcagtttgggtgtgatgaagaacaagagggtaaggggcactgaggctgtcagaggaaaaataattgaagtaatcagccataggttctaggctgaataggaagtaaggtcaggatgagggtgctgttagaatatgtaaaggagaaatgaagggactgttagtcttggtgaaattgaaaagtgagcagagtgacagtaaaagagtttatagtgacatgttagttttagaatgctgtcggcactcaatcaatgtgagttgtattgaatcaaaaggtagagtggtttgaaatgattgtggtagtgccatggagcaggatgttccagttggacaaagatgagggtcattgtaaatgagatgacctattgtaaaggttgtacaacaggtcgagttatttcaatggatgttgatgttaccaatataatgatagaggttagaatagtcagaaagaccaactttttttgatgaatgtagggcaatatctttcaatacacaaaggatagagggttttactagtttagactctctgactgtaaacagcagaaaataacttaaactggcttaaatattaagggtacttattcatgagtaaattagtggaactcaggcactggaatgtgccagattttaggacaatattggaacctggacctggaaagttacttagaacctagtttctgctctttcttcttaatatcgcatctctgcttttgtccctttatttgtatcagtcttctcattgtctctgtctctcaagattggctcttcctgattcctgattttcctgggagatcattaactgtctcgaagcttctaaggtaacctgttataattttagccacatgcagagactaactgcttgtctcggaatcccaattccaaattaccaggagagagaatctgatggcttcagattgagttaggggttattcgtgctcccatcaactttggctggagtaggatgttatcttgtaatgtcatgtaaaatagctattaggccccatctttgtgggttgggagggcagcccttaaagagagttgttatgccagtacccacagtggatttctgctttactacagctgagtggtatagctgaaaggaattagtgtaaacacaagagggccttttgaaagagattaggaaagcagtgaggaggtatagaacagtagtttaaattactgccatggatcttgggctgtgggagaataagtagctttaagatgacatgatctgtctagggagagctagcttttagttgagacacggtacggggtgttcaagaaaatggttgaggtgatggggaaggttatttatgaaaaaggaattccagggtttacattggaactctttgggaaggtgattattgataagatgaaccaaggaaaaggggctttaaagcagtgagtacaaaaccatcagagaagaaaggggactgaagagttgaattgtggatggtgtcaactgtagttgacctatggttgacagggatgagaagcacagatataattacttattacatttatggttggaaaagctttcatttttcttttatttccatctgaggttgaagatagttaacagaggcaatctaagagtgactattttatagatcacatctcttgacataatgaaggtatttttggtttgagactttatttttgttaagtacagtcttttctgattcttatattgatataactatgtattcaagtaatggactccttgtaattaattctgatagttctctttgggtttataactgtggcacatgtccgatgctgtgcttggccccttacattcctaagacaccttctttattcatcttttgagtacatgtgttactaagttggaagagtatgacttacaggtatgttgcttactccttgaactgatgtctgagatcatttctttgaatacaacgatgaatgtattttcctcattatgaaaatatgcctgttgtacgtatattcttgtatacattttctctttacacacacacacacacacacacacacacacacacacacacagagctctctctcacataaattgcctccatcttctgtaatatttactaaatttctgtctaaaggatcactcatttctgttgtgatagccatgcagattttaattttaaggctagctgactctgtttatgaaatatatttctataaacatacttttttaactttcgatttttctttattttcacaaacagaaataatttgttgaaaagtgaaaataaatgtcagtgactttaatactcaattatagtatgttcacaataattccagaccgaagacattgctatttaaaatttatttttaaaattaattatttattttttatttttataaatagagatgggtctcactgtgttgcccaagctggtcttgaactctggggctcaagcagtcctcctgactcagcctcccaaagtgccgggattactggcatgagtcaccacatctggccactgtttagaattagtgatctttccattataaagatttaactattttatgctgaagtggccatattttcaaggagtgaaaccatctcatacataacaatgaaggtagtcagctgtagacttggaatgagatcacatatggggatgatatccttctagttagcctagtactgctgtactggtctgtgtgtacatgcggtccttcaactcaggccttgcaaggcatgccggctgtgccatgtttgtaaatggggcagaggaagctacaacaatggaaaactaagctgtttatgttaggtacagctattaaaacaaggtagggatgaggctaggcccttaacttccctaaggcatacttttctagctaccttctgccctgtgtctggcacctacatcctggatgattgttctcttttatccattgtggatttttaaaataaaataaatatgaaaagcatcttgatctcttgtttgtgagaggtgatgccctgagatttagcttcaggaatatgtcatggctcatgcttcccatatttcccagggagggaaatacaggattttctaacactggttaaaaatgcaaattcaagatttggaagggctgatataatgaaataatgagcagtatcagcacgtgcaaagcttgtttaaaagattttattttctcccctcttagaccttttgcacatttagaatcttgaaacagtttctagatctctaacatgaaaatgaagatgggtattttcaggttgctttcagctctaggtagaaataaccagaattggcttacattaaagaaactgcatctagaaataaataaaaaaattagtggtctttcttggagttatataattttgaataatataaaaatggtattttgtcagaactattgtagtaacattaaatagcaaattatgttagcctaaagttaccaaggatgatttgtgtatgaagtgtatcatacttttttttattggacttctacctttctttttacttatttgttgtggaagaaaatagaggaagttaaaaaagaagttgatgcatggtaggaaagattaaggaagaagaacaataaatggatgacagacatttactaggtgattggggttaacttttataaccagactcagtagttgttagatctgtactgatgctcagtatttattggctctgttaaattaaaaatattcagctttttcaaccccatagaaatgttattaaaatatttctgtggtaatattgtgggaaagtgcttggttgaatgtgatcatattttctatgtgttagtcctttttattatatgttaaaaatataaatagtgtttgtgtttttagtagtaacttaggttaatttggcctttgcttttattttgcccatttcagaagttaatgtaaatttcttaactttgcataggaaatccacgttgataaatgaagctagagactttctttgtgtaaaacttaaaaagaacatctcatgctgttaataccatcagaattaggatgcttaatattgaactctctaaaaagaagtgttcttttttaattagcataagaaacaattttttaaggatattgaaattatctgagcactcaataagtaaatatgttacaaacctcatctatctggttgagctttcttttaaaaatactctttttttcctttagctgttgtacttaatgataaaaatggttttaaacagaaatgccattggctagtacagagaaataatggtataatagtagagggatggtactctttgatccttgggcttatgaaattcctaaattttggttatttaaggaaagcaaagtagaagacagataagtacaaaaagtgcttcaaaattagggacaaaaagtaggactagtgtctgctggaaggactcaggattcttccagatttgacaagaatgtatgtggatgaagtattaattgttctttttttcttttctcaagtggctcagattgccaggtctttgccagaaggttgaacgttgtagcttgtagactaacttttttattgcctaattacattaacagctagaattgttttatagatttttcttaagactgatgccagtccctttatggaccttaaaagaactgtagcatacatctagactattttttttaggtttaaaaatttccagaagggttccttatttgtttgatattctctgtctgctttacttcgctgtgatatttcaaaatatgtagttctgagttaaaaaatttagattaaaaattccatgatgagtaatattttgttctattagtatgttaatatatccaatgactgtggcttagccactttgcctacactcttactctggtttacaaagatagaggttttggtgtttatccccttaaagtccatacttcattcatagtaacacagctcctttccccttctctccattggtggttggtatagtgtaggcctgttcaaattctgtcttttaccacttgatttacataaaatctttgtgccttatttactcatctttgaaataaatacagtacagtctattttttcagtgttgtaaggattagagagaatgtttgcaagatgccagacattctgcttggatctcaataaatggtagataaattattattactgttatgatttgagaagtgcctatagagtacatacgtatattgaagaaaaccatgtgctggatttaggaaaactagtgtacaatcttaggggagtttatacagcagaccgtttctgttagatatattgacttgctaagatttgtgagaacaaactaatttatctctcagtctcttctttgtaaatgaatttgaactctaataaaatatttttctttcccttatttttcttattttttttttaaagggcgctattttcttggaaggtgttactgttaaaggtgtaactcaagtaacaacacaaccaaagttaggagaggtacagcagaagtgtcatcaattctgtggctgggaagggtaataaatatttttaaatttttaaataaaatttgctcttattttacaacacttaatacaagcattgacatatcttcttggctccttgaagttagtatgtttgcaatagaatactttaaaggtgtcagatttcgttcaagacaatcaatgcaataaccagacagttgagtcaaaattagatgactcacatattttcctaaagtaatagaaaattcttgttttcactgtctagtatttgtttcgtgtctttgactctactgctactgattaatgtttgagctagtctctcaatttgataagagggaagaggtgaaatttggatctgcctcattttccagtttttctgtaatcagaagtctaggaaaatcagctttaaatataagcagtgaatgccatgacttgaaaatatctttcagacatttcgtagtggattcaggagagcatacattgctcttatctgttgctctcaggtcttggcctatggtcatttctgctgatcattggtatctgtggcagagaactgtaatacagttgaatgtaaggaaaaaggattattgttaattcctaatataaattcctaatgaaaagaacttttattactgttacataaatactagataaatcatctagaagtagttttaactaaaatatgaaaacaatgaagaaataagatcggttttaatgttgtgttaaaccttaatcttgacctacacccttggttttaatgttgtgttaagccttaatcttgacccatatttctcctgttttgtcacttctgggtatcttttgaggagaaagttgccaaccttgcagttatgtcaagttggcagtctcacgttggggaaatatggggtctagaatatcatgtaaagtaattaagccaagatttaaacttcttcctgaagtacaagacttgtaaacatacctgctttactatttagatcatatatactaatattttaaaattagctcagtgattataccatagcagtggtaatttagaactctgttaacttgcattctaaaatgtcaagaaaatgataatcttttattagtatttttgtgaaagcggatgttattccagctgacattaatctcatcatagggagaacattgtgataaatgtgtgattcatttgagattggtttaagacatgtattgctttgtatggataccagccacgatagtaatactgtgttcttctttaaggtctggattccctggagcacagcctgtttccatggacaagcaaaatattaaacttttagacctgaagccatacaaagtaagctggaaagcagatggtactcggtaagttagacttctaaaaaaattacacaaataaccctaatgcttgaagaatattgttttattgttagaaaagtttacactccttgagagtgtgaatttctaatgtgaatagcaaaataaatgtttcaaaaattatatatttttggttttgctagtgttctaagctgtatagcacaagttatctctcattctgctaaatttttggtttcagagcttagctagtttaacataaatctataactagatgttaagtttgaaagtgtttttctcttaatgatatggtttttggtatgtctgctgcccactgccttgttttttaatgatattggacatgttgaggttaatagataaattgccagtttgtaatctaaaaatgatgaactctctctgattcattctgtattctcctttgaataatttgccttattctctttatatactcgcaaggttgttgcattattacaacaaagcttaatttcaaattttatatttctaagttttaagatttttttaatttgagacaggatcttgctctgtcacccaggcggcagtgccttagcacgatcaaggctcactgcagccttgaactcctgggctcgagtaatcctcccacctcagtctcctgaatagtagcttagcctcctgagtagctgggattatgggaatgtgccaccctgcctggctattttttaaattttttgtaaggatgaagtctccttatgttgcccaggctggtcaagatattagtagaaattttattcttcctcagcaacattttatttttttcttttgtaatccatatttttttgcatctattacagttttgctatatgtatgtattcatttagcaagttgaaataattattttaacagatattaacatagaagtcattaactatttcataataaaatgttttggaataactggcagtacatatatattagcttttaagtgttattttgaagatgacagattctatttaatttttatgagttttggaaagtcttaagtggcagttatactctttgtatcatgccatctccatctccatttaacatgtagttaccttaaaagatatatatggagaaaagaagtggagcagatacaacctattttcattattaggtgactataatgatattttaacattatatgctttctagaatgtttaagtattttattatatttgatttttattgggaatatttaaaaatattttcattcattttaattgtctgcctctgttggaaacaatttttcccctcagtttagcattttttagcttttttagggtattttataggtaagacatattcatttgacaaaattcagaaaataacattaaaaaagaagaaaataaaaaagaaattttatcacctagagattatcactactgtccttatggtattgacctttttctctgggttatatggcaggtgtggtttttattattattattattttttgagacgggttttcactcttgttgtccaggctgaagtgcaatggcacgatctcggctcaccacaacctccgcctgccaggttcaagcgattctgctgcctcagcctcccaagtagctgggtttatggcatgtgccaccacacctgggcttattttgtatttttagtagagacagggtttctccatgttgggtcaggctggtctcgaactcccctatctcaggtgatccacctgccttggtctcccaaagtgctgggattacaggtgtgagccaccgtgcctggcctgtggtttttattattaatgctttgtgtactaattcaagtagttaaataacaagtatttgatatttatatgtttatttgttcatattattttgaacttccttaatgaactagccttaaaaattaataataatgtataatgcaaaattgaaacagtgtagaaatgaaaaaatgtgccttgtgtgcttgcagcagttatacaaagaaagatatagatccataaacagaatttggatcatttacccattctgcacccttccctgtggatatgtgtttttgatggataaatgaaaattagcctttctgcttattttcagaatattaaaattatatttatttaatatgttgggttagattatgttcagaatctattaaattggtagtaaggatgttaaggatgttgttgagacatacattttaatagatacgtaaaaatgtcttaacaaatgtcttacttctgtgggtggagaaagagtggaaaacgtgaggtcaaggtgtctatctctaggctttacactacgaaatgaactggggatttgggattgaggcatacatttaacctcttaggagtttcatattttaggtactcttttttttttctgttgaaatttattttattatcttatttttttgagacagggtcctcactctgttgcctaggctagagtgcagtggcacagtgattgctcactgcaaccttgacctcctgggctcaagtcattctcccacctcagcctccagagtcgctgggattacagacatgcaccactatggccagctaatttttaaaattttctgtagagatgtgatcttgccatgttgcccaggctggtcttgagctcctgggctgtagtgatcctcctgccttggcttcccaaagtgttaggattacaggcatgagccaccacatctggccttatatactctttactttctgcattgctttcttcacagtatcatggtaagctttgggcaaaataataaagcctgcaaaatttgtctcttgtttctgccatccaacttttgttgattttgttcctcctctgtagttgtgtacccctttctctgtgtgttggtattgttagacccctagatgattggctaaagtaattttttatgaagtaattggttaagatgtttttgattgctaatggaaatatctaatttctcctagaaccaggctccaccaaaaacaaaaggaaaaccctgagtatttattgaatacctactctgttttaggatacttttttctgggagagaaaaaattttgcaaggtgtttctgggccagtgtaaaatctatcttttgcgcactaggatttaagtacagtagcatggaagagggactttctgtgattgaataaggtgaaaagagcctgaggaggctgtagaatggtcttagaggctatgaaataagagtaactgattaatagctatgagtcctggactccatcgtcgttaaagctatgtcaggatacagtgtaggatttctttttattatccttatttcataatttaatggcaatttattatatctcgtaacaatatttaaaccaaggatctctgaaattgagtgtaataggaaacctggatatagttaacagtaaaaggtattgtgtaagaattttgcattagcctgaccaaggcctgagggcctggagataacagtaagtagagtggctttttttttttttttttttttttaaagaaattgtgttttgctatgttgctcaggatggtctcaaactcctggcctcaagtgattcttccctgttggcctcctgaagtactgggattataagtgtgagccattgaaccctgcctggagtggttttgacaggaaactttaatggatttgaaaacattgtagaatagggaatatttctgaaatgtaaagccaggtaatagaaacagaaatatgaaagttattgaaaatgaaacagtgagaaatttatattagttgtaataggtgaattgatggagactaagccactgtaatctcagaaacagatgaaatgaaagtttgtttgatggaagaattaattgtgtttcgtgtatttcaataaactcatacttttaaaaatgagatgtctttagtttttatagttctgagtacttttggttgcagtttttgatctctaataattaagcatttaaaaaatcttctaatttggaattatgtcagacttagtaagtcttccaaaaatagtacaaagaatttccatgtgcccttaaccagattcctcaaatgttaacatcttatattattacagtacaatggccaaaatcaagacattaacattgatgtattgattattgacgttattcagatttcaccaaaagtgtcaatattatgccctgtttctggtccaggatccagtccaggatcacgtgtttcattaggttgccatgtctcttcttttttctgcaataattctttttttttttgagacggagtctcgctgttgcccaggctggagtacagtggcgcgatctctgcttactgcaggctccgcccgctgggttcacgccattctcctgcctcagcctcccgagcagctgggactacaggcgcccaccacctcgccaggctaatttttttgtatttttagtagagacggagtttcaacgtgttagccaggatggtctcgatctcctgacgtcatgatccgcctgcctcggcctcccaaagtgctgggattacaggtgtgagccaccgcgcccggcctctgcaataattctttaggctttctttcataactttgacacttttgaatagcattggccagttatcttgtagcttgtctctcagattgagtttgtttgatgtttcctcatgattcaagttgggcatgcttgcaagaacatcacagtagtaatattcttcatgtcatttcaggaggcacataatgttgaattctcctattagtgatgatgttaactttgatctcttgatttagttggtgtgtgccagattgatgaagttatttctgtttattattttatttttggtttgtactttatttattgataaaggcatgtctgccatgataaagttatttttcctttgtacttaagaagctgtgagggagatactctgagatcatgtaaatatcctatttcttatacttttcgccattatttttaacattcattaatgattcttacctgaaacagttaccactgttatgtttgctaagtggaatagtggaattcagctcttaggaagaactttcccttctttctcatttctttattttcttgctttttttattcctatcagtgtggactcatagacacgtattatattctgtgggttataatctgttttagtaattattttattgctccaaatgtctcatttgaccgttgagagccccatcaagtgactcctgtcttttgacatctctccctcattttttgagtactttcttgtttctggcacccctagatgttgtggacttaccttgtacttttcctaccccagccctggaatcaactgtttctctaaggagtggtatttagaaaccaatttttgtgcacaagttgggctcattagtactgggatgtcatttcttctaggccctctcagaagatagagctaggaaatatgtgtgtgtgtgtgtgtgtgtgagtatatacataaatacacacctatatctatttcagtatctgtctgtatgtatgtgtatgcatacatttttttttcaaaatcacgagttcgtactgatacttccaaatctaatgcactgccataggatttattgaattttttctcattttctatttgtaactcctctctctgatagggagacacttggttttcattatccataatatttactataatacacataaagtagttttggaattgctatccaaagccactgtgagaaatccatttgaatagagtgtaatatttgtgaacagttggtctgactttagccttagggtatataaagtgtactgtgttccaaagttacttaattattttctctcttcctgccaaaccctttagtgtagatagttttcatttgtaatacaattagtttcatttgtttctgcttatattctgagtttgccctcatcctttgttgattttaatttttcatttttctgagtgtgtgaaactctactatgattcagagtatgctctgagaaatgttactttctcctatcccttttaaccctttccctttctcttatcttttcattctgttcctacccacccccttaaataatcagcctcatcattttctgatttacccttcttgcatttctttttgtacagatgagcagatgcacttttctttttcccctttcttttaggaaagataccatacactttagaattagatagtcttttcaccttgctttttccacttaacagtatgttctagaaaccactgcatttcacttcagatattctcattctttttttacagctgcattgtacccattgtgtgagtagtttattcaacgactctcctatatagagatatttagattgtttccagtattttgtaattacaaatgatgctgtgatgaataactgtgagctgactttccctccatattgttgaaagtctaacctcagggtcaatttctagaaagaaggattgctgagttgaaggctgggtgtatatgaagtttagttagataccacgagtttctgctccaaaagggtagtgccagattgtattcccacaggcagtttgtgagaatgcctgtaccaccacagccttgctaacagaatgtgttggcaaattttttcaccaatctggttagtgagaaatggtatttcattctagttttaattctgaatggagtcaaacatcctctcatatgtttaagggctatacttatcttttttgtgaattatctgtccttgtttcttttctgttgtcttttgactttgttcatgtttttttgccatacaaaattttattatttttatgaagtcaagtttattaatttttattgcctcttgattttgatttatagttagaaagcctttccttatactgagattgaagaagaattctctcatatttcttctaatatttgtatggtttgatttttttaatctggaagactttttaaattataggcaatctaacatttctacaaatttaaaaactccttttattgtcattgttattattattactttgctgtgaagaattaatgcataaattcattttgagtgaaggctgtcttctaaggttggaactgagtcatgctgatccacttggaagtatgtcatcctgatagtgaccaccttgcctgtgtactgggtgttaatatacagaaggcttattttaaatgtactattcagcagtgtgttttgttatttctttgcagtatgttttataataatggaaggcttttgagatgagaaatatatggttttggtaggagttgaggtcaaaaggaaggcctagtatctctaattctgatccacagggttctaacttaactttgcaaagtaagacatggatttacaactgttttatatagtgcatgctgtgcacctacttcccaaatgcacttcgatttttttttttttttttttttttttgtcataaagagtctgggctccttcctgttcttctctctacaactcagcctgtacctgagtggtactagctattcttatattgcttttctatggaggaaaacacagtcttctagagctgaaatcttaagaatgttttgggaagattagagagcttctttagaaaaagtttccaggcatttaatcatacttagtatcttagttcatttgtgcggctatagcaggatacctcagattgggtaatttataaacaacagaaatttatttttcatagttctggaggctaggaagttcagaatcaagatgctagcaggttcagtatttggtgaaggttgctctttgtttccaaaatgatgccttgttgctgcatcttcccatggctgaaggggcgaatgctttgtgctcaaatggtggaagagcaaaagggcctggctagttaccaccagctcttttgtaagatcactaatcccatgcatgagggcagagcccttgtggcctaatcacctcctaaaggttccatctctcagtactgttgcactggagattaagtttcaccatgaattttcaaaccgtagcacttggttatattttaacttgttgaatttttgaatttttaaattttatttaactttttcctgagctttgaaaattatttcttgttacattccccaccactaagactttagtaatacactaaattatagtttctgtttcttggattcctctgtgtgtcaggtactgtgctaggttctggggaaacagcagtgagcagtgtggatactgtccctatctcatagaacttgcagataactatttaactaataataaattatttgtggataattgattaacagcttggcacaaattcaatttagagcttcagcacatatctcatagccagataaattcccagttgattaaataagtgtaaataaaatttattttctgagaaaacaagatagcagaataaattaggttaggtatacctctggcacatgtttcctcagcattctttggatatttaggtagttggatcttgggtttaggagaagaatatggattgaaagtacagatttgggagacaatagtatgtgatagtaaagacagggatgtggacaggctgttgagtagaggaagcaatggtgactgagagtaggggaggtgggagaaaaccaggagaaatatctgtcattcaagctaagggaaagtaaaaatgtctccaaagaaaggttaaatcttatagagaattagtaatctaaggagtgaaaagtgtctgttgaatttagcaacaagatatttgggattgggttgggatgttctcagtttttgtatagtatagagtagggcagtgggagtaggttgaaagtgatgacacttttcctttaaacatttcctctctttcttcctttggctgttgttaacaaatgtctctcctgagggagattccaagacagcaaagagaacattattaagagttagtgaaagtaccttatttcatccaagagacaggtatggcagggctttttatctgtcagtgtctgcctgcctgcctgtctgtctcacattgaaattcaaatgtgagataattggcaaaaattgttcattaacttgtgtatttggaataaaaatgaagttggacttttcctatcagatagtgggactttcgatttggctgaggttttgctagtgagagttggtcaaatgagttttacatagcaagcatttttgtgtagattaaatcagccaaaactgcagttttgggattttgatgaaaatagacttcaagcatttgataaaataaaatcattttatttagccataatattggtgaaggtgtattgaaatataacactccctctgccccctgcccccactttcagagttaaacaaaatgattctcaatgaaagacttgcagttacacttgatagtcgctttactatgtctttatgcctccttgattagattgtccttcaattttgttgaaagctgccaaataatcaaagtgtattttaaaggaactcgttgaatttctgacattccctaaaatacatttaacttttttcttaatatttcttttgtcttgagtactcttgtttcattattttcatggctttccccaggaggggggagtcagttctacttgagtgtaaatataataccaggaaaagtgatataatgttactacagttacagttggaattgaactgtcttgtaattgtgaaatctgctttttcacacatattctgggaaaagatagaattttataataggatttatctgtgtacttagtttattagcagattttgtaatgcaattaaataaattgtcttcaaaataattcaacatcaattgaaagtgatgaagacttagaactatataaaaattttagaattaattttcatgccttttattttaattctttctgctgagagtttgagtactataaatttaatttcaactattattgaatcagtaggtaaaaaccaaatggttttaataagtactgttgtaaaacaaatagtaaagtaaaagataataactcagattatgctcgacacaggaaaaatgtaaggctgtgggaataatgtaacagaccaacaaaagggctggtgctatggttgcaatttttacatatgtatctatatctgtatttatatcttttgacttacatatttatataatacacacacatatacaagcataccctgcttcaagaaaaactgaatataaaaggtaaatttgggacttgctttataaggaaaattattgcagggaataaaaaagccacttaggcatttatggaaatgtaatttatattcagctttttataacacatctgtttaagtaggtgaggtacatttgtataatacttctttgaaggaaattatagacaggtttattttcctgcatcctggtctgggaatttcctccctccctcccttccttcccttcttcctttcattcattcattcattcattcattcattcattcagaaattatattggaaacttatttacccctagggctctgtgttaggtgctgcatggattaggactgcttaagacagaatcctcagctttaagtttttcctgtaatccagctttaagttttcgttctaaactttttctgtgaaggacgtagtagtaaatattttatcatttgtgggttgtgtggtctctgtctcagataaaaagcagccatatccccctgattttacataaaccaaatgatgtatttcaataacatttggtgggtgtatttcaataaaattttatttacaaattagcaggtcacatttggcttttggatcatagtttgacaacccatcattgaatacattctccttaaaagacagtctttacatcttaaatgttctttctttgtaagaaagtgtaaaaagtgagcttaaggtagggaaacatatttaatataaagattttttaaaatttgcttttttaaagttttgaagtaagatttcttcccattaattgtaagttcatgctaagccattggtactttgacaagattttttatgtaatttactaaatgtatacatttgaaagacaaattttttttttctcatgaaaatcgtgtcctatgcctttgttagagcagggtgctcaatgtgtggtcatactacatgtgccctaacaaatacacttcgtgacttgtgaatagcgtgttgtagaaatagttgttgtgtggataaactgcagtatgtttaggcagcttctgtatttgctgctgtaacagtatttatttatttatttatgtagagacggagtctcactctgacacccaggctggagtgcaatggcgtggtctcagctcactgcaacctctgcctcctgggttcaagtgattctcctgcctcagcctcctgagtagctgggactacaggcgcatgccaccacacctgtctattttttgcatttttagtagagacagggtttcactatgttgccaggctggtgtcaaactccttacctcgtgatctgctcgcctcagcctctcaaagtgctgggattacaggcatgagccaccgcgcctggtctctaaaggtttttatacagaaacatgcagttaccccaggtggttaatagcttgcttgggtcccttgatatgtatctcattaataatgtttgtagtgtatgtttatgctaatgactggagccgaatgttcagacaggtatagtgtggataaggtaatgagatgctagactagaaaagttttacatgctgaggagaatattaaagaggtttcagatgtctctggaataattttcagtgaactacaaacaaaaaagtatatcttatttaggaacagaatgagtcaaattatgatcaattaggtattgtgtatactgctttcatttagatttgttcacttagctctttataaatttctttttggctctagttttcttctgaaagcaaagcaaatagctcctgatatgtaacataagaactagagatgaaatgaatattggaattaaataagaatttatctcctatcttattatttacaaacaaatatcagttatagccatgacatcatatctagtattcaggaattcagcagtaaataaagttatgtctgggaaggacttttacttttttaattgttctggggaaacttagagtttttgtggaggtgtctgagggaccagactccacaaaagtaaaatatttgtttcaaatcatgtaagtagatagtggcaaaatcagcatcattctgtattctagtacttgggcttttataattaggttttggctgggcgtggtggctcatgcctataatcccagcactttgggaggccgaggtgggtggatcacttcaggtcaggagttcgagaccagcctaaccaacatggcaaaaacctgtgtctactaaaaaatagaaaaattagccaggtgtggtggcttgcatctgtaatcctagctacctgggaggctgagacacgagaaacgtttggacccgggaggcggaggttgcagtgagccgagattgtaccactacacttcagcctgggctacggagaaagatcctgtctcaaaaataaataaataaataaataaataaataaataaacaaatgaaattaggtttaaggtagtttttcctcataataatggaaattatactaactatactaattttaggactcagttaatgtttagtgtcatacctctggtgataaccaaaactcttagagagaatgtaagccagatctcgtcatttaaagaccccagccctgtttttaatagtagtttcatcagaactatagttagggatccaggccagtttccttgcaactggatgggacacaataaagctcctgtgtttcttttttatcacggggaagtgagactaccagagaatatttagaggtcaactcagaaacactgtttattgatctgaagctacgtttgatggtatcttgtggtaaattggtttaaaaagaaggactctttgactccctccccaagcctaaatctttctttaagtccccctatatgaaacagataaaagcagtaatgctttggttgctgcaaattgaggaaagcatatggggttgcattctggtgtggcgtctgaggttaccatggaactttttagggcagcatttccagttgcgctaccatcataggaaacttttattaaaaaaaaattcagagattcaaattcattaagcctggattggttctgagaaaatgcatttttgaaaagcaccccgattacttgtgatttttaacctgatttgggagccgctatctgtagtgcctcatggaacaaaatttaaaaatcagtgacccaattcaaagtagtatttagccagctattgagttaagaacatacctgagaatttctctgttagttggtggagacccacataaaatgcttattatacagcactcaatgcatattagttattgttgttataactgaagactgttttgaaaaccattattacatgagaaccaacattgatttcccagagttcactcagaattcttttagggtgtggtatagttattgcacaagaagaaaattaagcaaaggcaaaacaatctaacattttaaaaccaaatctttgaaatacccattggttagtagtcacatctttaggatttactaaaggataaaaaggtcccttaaatagcagtttctttaatcaaatcctaagtatgagagttactactagttaatagagatactgtctttgaaatggtatttaaaaataaaaaccaaccaaatttattacctattaccaaaatctgctagagaactcttagagctgagcagatacagataaaactttgattgcaaacataggtgcaaccctaactcagaattttcagttggccaggttctgggggcagcaaacatgtgaagctttgaaagattaaaacaaatgaatttttcgttaatattttcaaacattttttcccctatatagagctgggctactggacccaaacaaatgagaaacaaggaatacaggataaagagattgaatttgtctctttgttcattcatgtagttaacaaatatttattgaacatttaccatatgccagagattgtgctagctatgataggcttagcaggtaattagaactaaactatatgatgatgatgatgattgttttttgagacagggtctcactgttttgcctaggctggagtggagtggcacactcatgcctcactgcagcctcgacctcccacctcagcctccagagtagctgggactataggcgcgtgccgccacacccaactaatttttgtcttttttttgttgttgagatagggtttccccgtgttgtccaggctggtctcaaactcctgggctaaagtgatctgcctgccttggcctcccaaagtgttgggattacaggcctgagccacaatactcaggcatgattatttttgtatgctgctttttatcttaacatgagtatatttcattgttataacatgtatttttaaaatgacttaattgctgccaagaaaaaatagttcaccctcgattataggggcatttagactccagtttttttgttgctataaataactgtactgatcttcttatacccatctttgcataaattttgacaaaaatagtattacttagatatagtatggaaacctttgaagtccttgatataccttgctagaggttgtagtgatacactccgaacagcagtgcttgagtgtacatccttggcaatttggggtagtttcacttaatataagtaatgtagccaagttgacaattggaaaatgaatttttttcttaaaagattttattgatgtaaaaattaaaggaaaatgaattttaaaattgctttgattagcagttttttttgaatactagtgtggttgcacaagttcattctgtattttggctatagcaacagttataacaagtaatacttgttgaacacttaatgtgtattaggcattgttctgagtactttacatagaacatttatctcatttaatactcacaacgctgtaagatagcattgtgaataagtagctttttcaaggtcacagacacagttattgtaagtagcaggactgagatttgaatgcaagtgatctggccccagagcccagaatcctttttgccaggtcatgtcctcattattttttcaatattttgatagttatttttactgttttatgctaatagatgaatttttctgtcttaaaatatattttttctgataatgtcttctgtcttcctcataaaacattaaaaagaaattaaaaagttctccctgtgagaacttttatcccaccccttgggataatcaatattaagagttggatgtttggtttctcgagacattataccttcatcttcttacctgctgttttctttccttactttctgatcctccatataatgggatatgatataggctgttctcttataaataaataatagaaaaactctattatttttttttcaaattgctttgtgatggtaattcaaattgcattgctcctttcacttaatgggataataaatatatttgcagacaatatttactgctttaatagataactgttaagctactgtaagctttagaaggtctcaaagacaatacaagacactagaggaaagtaaaagtacaattcctactctcagcaggaaaatgaagtacaatttaagatgtagtaagagatataacaaaactatgtatagtaccagacaactaagtaagagatactaaagagctaataaagagcattacttgatactgtatatgaaatatgactgcttgttttgattttaagagtgtgatattgggtgttcatagatggatttttaaattttatataggaaataagtaagatatatttagtattgaatattgatatttagtattgagtagtgctgctgaccagatggaagaacatttgctttgacccatctcagcagtagagcttatctgttagatgaggtgttaactggattttcatattttttttttttacgattctgtgatactttcttaactcattatttgctcacatactcttattcattatgtgtgattatggaagtggcaaatgctggcttggataaaaaaggggaaaaaactttatcctctttgtgaatctgtgaaaaattgtttgaaataattatagttgatttttctagaatgcatgctttatacaaaagaaaactgaaagtaatcagcgagtcagggacaaatgtaaaataaaacttttgggaaaattcttttgatcttttcttttcatgaagatggattactttataaaaattaaaacgttgtttacatgcctctgtgataggtagtgctgcccagaatacgttaagtggcttttaaattttattccatatcaaggtaaatctttagagcaataaatgtggcataccctgatggaagatcacttaaaagaatgctgtattttacatatttaacttgtattgctacagagttctgaaaagcataacctgttacataaatggtaattaatgcaaatgagtatatcatttgattttacactttgaagtctaatgaagacactgtacattctcattatgagagctacttaatctgaaagtaactaattaaaataaccaagagaggcttcttatatacagaactggttgattcatgagatttatttactagtattggaaccaattacctgatctgtgctacgaataataagtttgcagtgtcctgttattttgcaagcttttcaaattctcttaattaggtcaagatcaatgagtatgtctatatcttactaaacctatcttattattaatggtagtagttgaaactttttctaacttggacttgataagcattttagtaaaaatttcttttttgccttgtgattctggtcttataatgaaaaaatgataatgtcttaaaaatgtgtttccccattataaaagtcatttgtattcattgtagaaaagttagaaaatgaagataaggaacaggacaaacacgaaaaacatatgtaatttcaccagttagagatggttgctgcttacattttggtgtgtatgcttttagacttttccctctgtctatatatattttttgtttcattgactaaatgaaaaacatattcattccacaattttttaagtgtctgttatgtgccaagtaccaggttctcttattttcttcctttctttttgttgaattacttattctggtaattatgcttttgtcaatagtacatacattcttgttctctgcctgtaccttttcatgacaaattgttcttggtttatggttgtgatagcttcttgaatctctatgagaatactagttaaaagcatatttaaagttatctttctcttccttgaatcatctttcttctttatgtttctagtttcttcaaatgtgtggtgatccttggttggctgtgcatttgaaacgaggcagagaagctgcttggaagctccatgaatgtgggctgggtttgtcaatttctgacctttgctttatgataagcagttgtgcttaggtgctcttccctcactacccatttggttcagtttcttttactttctttcttttttttttctgttcaccctcccaccctgtttcagtttctttagagaagagctctctgatttttcttttcttttgcttgaggaataacctgtgtgttgtgtgtatgagttgtgagaatttaattgttgtacatagctaaaaataaccaatccctccttttcagtccatatgtcactgtagtcatcctgtgcacttgatgtttctgggtctggatcttctttggggttttgtaaaataggcacctccatctgtgaatcctgctacctctgtgcatgcttctcagcacttttcagtacttctccgtctatttcttgtcaaccagaaatttattgaaatagtgcatctgctgatgctcttttctccttcccttcattatcttcattgttatagccatttctaataaattaccctaaaattaccccaaaatataacagtttaaaattcaaatatttactgtctcatcgtttcttgggagcagtgtggttgggtgagtcttttttgtttttcttaaatccatagcctcaagcatttatcccttgttacaagcaatccaatgatactctaagttattttggaaagtacagttaagttattgatgactatagtcaccctattgtgctatcaaatagtaggtcttattcatttattctttttttttgtacctattaagctgggtgattatggttcaatgtcgtctatcagattgcagtcaagctgttggccagggctgttgtcatttcaagggtccacttccaagctcatgtgtatggttgatggcaggcctcagttcctcagctggctgttggcatgagacctccatttcttaccagtggggaggaaaaactttcctgtacccacttaggttcaatagttaggggcctacaaattaaactgacaaaacatagattagcaagagaaaaaacaaagtttatatgtgtatggaagcacataaaagaagtggcttacaagatggttgaagttagtattcctaacttaatgggactatgcctaaagtttgtattcctaacttaatgtctcaagtttgtatgtctaatttaatggtggaaagggaaggtggagaataggcttcagtgtaagaaaaaaaatggaattctttaggaaggataagtggatttttagaggaacaaataggaggtaagaaatgtttgtttttatgggggggaatggtcttttccatcttcttcgtggccataaactcctggagaggggatttatgatagttttactctcagtcttctttctgggagtgaagccacctagaagaaaggatttatggtagcttaattcccggaagtttctgcttttagtcagataaggaaagctctgaacagccacctttctgcatttgttgactctcaaatgtcttctggttaaaataatcttcataccagctctggggttccgagtgggttctcacagctgcctgagtgtcctcaccatatggcagccagctttacttatagcaaatgatctaagagaacacccaagataaaagtagtagtctgtttataatctaatctaatctagcccaagaggtgacatacaatccacttctgccatattctatttgttgtaacgtataagtctagcccaaacttaaaggaggggaattaagctccatctcttgaggttaagagtgtcaaataattttgtggactttcaggacatatttttcaggaccatatagctttatacttaaaaaaaaaaaaactctgctattatttcagtagtgtcttgggaagaatcattctattgtatggaacattccattgtataagtgcatcatactttgaaaatttctgtgtggttgtaaatttagcttgttttgaaagttttgcttttataagaataccatgataatattattctaaataacttttttgaatgagtaattattcatctgatagcttattataggagtttattgctatggtctgtatactctagaatacatttatggaaatatgcatacattttctttggagcaaaatcctccagtatatttattattgtagcagtttttgtagtaaaaactacaaacagcattttctgaaataattaatgtattttaatgatttattgaatagatctgaacaattgtcacttttgatttcattttgggatcttatgacttcgctagatggcagcagaggaccaggtttaattcagactgcttttgtgaagcagtagaattctaatggtatccagtgcattggacatctattttataatacaacccagaatattagctggggattattaagaatttagtaaggattagtgggatcatatatacagcattactgaaagcatagccattttgacaatgttggtatgttcttttgtgcattgcatctgaattattatatttgcaaatgaccttaaagtgccattttggaccttttttggtaaaaacaatgtagccgtattaaagtccctagaagtgttttttctgtatcaggaaactgagacattcttaagttgaaatctcagaagggaagaatgatatgaagattctcttttatcccatttggatttttttttttttttttgctcttaattgtgttgggagcaaaggagtctaatagaaaaacatgatgttggaatgtagctcttttatttataggcagtgaaatttatgttcataggatagaaaagttatttgacttgtatgtggtatatgaggaacagtaatttttatatatgtgccctaatgatatattttggggaaaaaattctataaccatatgttttaaaatcatatataggatttttattttctggaggaactacatttggtttttgcatgtttgatggtaatttgcttctcaaaaggcagtaacatgtgaactaggtaaagaaatcagaaaatgagcaattctgacagtgcttttaaattgtgaagtctgatttgaagattatataggtggcccatcttagtatagtatcactctggctttcagcccagatttaatgttgctgctatttttgctggcaggtgagcttccttggactcattttattttagtaacatttttgaatttagaaatttaatttttaaaatacttttgcatgggcagaaaactaaattttgtctccctatgaattatctagaatggcatttaggtcttttacatcttatgtcagcctgatagaatgtaaactactggctagagttgcaggatataatatataactagaacaaatcaaattgctgcataaattacagcctttaagcagctgaactttgagactgctctatgatgtggccttggtagttgccttaatgttatgagtccataatatatttatttttatagtctcagtagtattagctgttgaaattggtgcttctaggatttctcctggtacttttatgtgaacttgaacaaagactagtagcaaccagttaatttctaatagtttgattcattaagaattacttactagtgttaaaaggaaaataaaaatggaggtcacagtttagatagatcccaaggccaactgcctataaccctgtaacccaaactcaagtcattctgattcccctgaaacactatctctacttataaaagaaccacaaagcatgaggtttacatctttgccagcatgattcagtgaaattaaaccaatcagctatagacaaatataaacagctccacttgcattagaataatgttagtgtctaatggccagtcacgaaaaaggtcaaaatactttctcctttataaactgctataactcctgtgaggaagcttcttatgacttgaagtttcagatctcaatctgtactttttgcatgacagtgagctttaaaatttttcctaacttgatctaattttatgtttgataccagtaaatggagaaattacaactctcttaaaacatttggtgcacttagatacggttttgttatttagatttttcctttgtgcatgaagcaatattaaataaaatcaagcatcatcatgttgtacatcttctacatgtgtttttaattctctttcttaaaaataccttaattgtgttattagcacatttctaaatttaaaataatgggtgatctttatagtaaaatatttatggtaaagtataatgcctgtgttaaaagtaaatttatttcaagtttcttgtagattattaaaatccctttcagtaaaatttttttctgaaaatgttcattgttctatagaaataacatgagagtatgaaaaagatggtgcttgctttaaaggaaattcctaatttctgacaagttttaaatggctgctgttttgactacacactcagagctgccaaatacaatattttgatatgtggtcaatttcaatggcagtaaagttttaaaaggaaaaagagtttgtgtgtatttaagaaaagaaaattgaagatgtggttcatgccctaaaataggtcaaaatctaatgaacaatatgaagtataattgcatataaatgacatgacatagactctaataatgtgggagttcttaggaggatgatgagtgaaggatgagtaacaggggtgaggggagcaatgtgaagaaagtcatgaggtagaaacagcctgagctggaccgacctgattaataattgatataaatccacaatctttgtaagctcttacagttaaggcagttaggtgcttatgagaaaattgttacactggtggctgcataaaccctttgtttatattttgaagcatgtcagagttttaatgattgctaagccataagcttctgatttaaactttgactatgatgtcaactcccactccttgaattgttcttaggaggctattaaaatgggagatcctttatctcaatcttcttgaagtttaggaccacctgatttgctgagtcagttggttagccccatagcctttgaggccttaaaagagctgtttttttttttttggaaatcaggtaaagagtgtggtaagagactattttccatagtgatacagaaggcagggaaatgaacactctgaggaatagttgctgtggcagtggaagaggaagcacttcacctacttatgtgactggaggaagaaaaaggttgtgatggcacagaaagctaagcctaaggggctttcccagccggaggcacaggaaaaccctatagtaattctctcccagtcatccttcccaacactttatttcccattttcagtataattaaaagactgttaggtgaaccttttttgggacttagtgaaaattttactcaaagtagcttacttttagcattcattcaatgagtctagccaatagtgaatttcaaaggttgcataatataaaatgtgaaaattagaagactgattagaattaacttgtgatcatacttagtttttcttttcttcttcttctagtactctttgctctttttaatcctagttaggatcaaaacaagcacatttctatagctaagaagagaaaatctattgaatataacttttggacagattcttcagtgaaaactttttttttcagattaaaagaatttttaaaattcttttgctttttttggacatctgctgtcaggctttccattttcattctctctctctctttttcttttttgagatggagtctttctctgttgcccaggttagagtgcagtgccatgatctcggctcactgcaacctctgccccccaggttcaagcgattcttgtgcctcggcctcttgagtagctgagactacaggtgtgtgccaccatgcctagctaatttttgtatttttagtagagatggggattcaccatgttggccgggctggtctcaaactcctgacctcaggtaatctgcctgccttggcttcccaaagtgctgggattacaggtgtgagccaccatgcctggccctggcttttctattttcttttgcaatttgagtgttaagggtggcttgaggttatttagtctagtgcttctcacaattctatgtgtatgtgaatcacctggaaatcttgttaaaatgctaattctgattcagaaagtctaggctggggcccaagattctgcatttttgacaagtttccaggagatgctaatgctattggtccagggaccacattgtaagtagcaagaattgactccgttttctcaggttatagatgaggatatcaaagctagagagaccaagtggtttttacaaggtcccatacctagttagtaagggtggacttttaatttttaatccgataaagtcatatttttcagcataaggaaatacttaaaaccaagagaaatcttcctcttcccctaaatagatggcagctcatttgttaaaccaactttattcaatttgaatctttaagatgtgtcttaagattttctcttccatccttattgcttttgaagatttgaagaaaaataaataaatggatacattgatttatttgaatgtgtctgtatccagttattagagtccttactttctggactttagatgatcaggaaacaggtttaagtgaccttaggagatagtaaaatatattatattcaaatctagtttttgaggtagaagcttcttgctatggtagggtaaatcatgtttttatttaaagtgactgttaatgtacactttgttttcagacatttacaaactggaggaggtaatgtaactagttttttgtgtctttggtagtgcctgtatgaatactttttgctcttgtctgtgaatctagtctggtttttcttgtgccttaggaaattttaggattgtcgcagcactggaggtggggtataaacgtgtgtaagtgcatgctacttgggagatatgggactacataagaaccctttcaacccttgataattccataattctctaattctttgaagattggtgaaaaggaggaggaagcatattctatcccacggaagtggcagttaatgagatgcatgttgcccttagcaaatgaatttagtcctaacttgacaattcttttcaaaaagtgaaagatatgctttgataatttgctcgttgcacttccccaaactgttagttgattttataaatttgtagagggtggagactttatcagtcaatttttattgttatgacagttattatatttctttttggtagataaaggaaacatgaacccaagtagatttaattataattttatttaagttatcattttactaatctttattttaatgagatagattgtgggaccaaaacatggtcaatgataattttccattgtgtattatagctttcgggtttattgtgtatgtaccattattgttagtaaatcttaagaaattcttttggtatattgggatatttcaggctctgggtttgtttttatcattctaatgtttagaaaacaagctcttagacagattgagacctacctgattcaagtttttaaaatatgaattctctgttttgagttatcgctcattcagtgcagcgtctgattttacaaaatttactttggttatacctattcatagaaaaatgaattaaggaactattttactatagttgttgactgcctttgtgtaaatatgtttatatgtttgggtgtgtggtctgtgggtaacctttaccaagagttacctgtgattcatttctctatgtttcaaaatttctgtgttcacttatctctttctcttctgtgttcaaaagggatggcttcctgtttcctgtttatagggttcttaaactaatcctttctgttttattcagggttttgttttatcattaaccccaactctaactcttctttggattgtgtaaagtagtactagtagcagctgtagttgtagtggtagtagtggtagtcgtagtactaatgatatctagctttaattaagtacttaattaagtactctgtgccttggacataataacaatagctgatactatattactgtgtattaatcactgttctagtatcttttatatattaactcatttaattcttttctttaatttttaaaattgtggtaaattacacataacataaaatttacattttaaccatttaaaaatatgcagttcagtggtattaagtacattcatattgtgtgcaactgtcaccaacatctatcttcagaactctttgattttgtataactgaaattctatactcattaaacagtaacttcctattctccccatgccccctggcaaccactgttctccattctgtctctgattttgattactctaggtacttcatagggaatgatacagtgtttgtccagttgtgactggctaatttcacttagcataatgccctcaagtttcatatgctgtagcatatatcacaatttccttccttttaaaggctgaatatctttccattttatgtatatgctgcattttgcttattcatccctccatggatacttggattgcttcagtggtttagctattgtgaataaggctgctgtggacatgaatgcagtaactcatttaattcttaaaactgtcttaggacagtttaaaacttctggtgaggaaacagacacttagtcaagtaacttgtgcaaagttacataattagtaagagctggtatgggatgaatggttcttaaccactatagtagagtgccatataattttctatgctggtaccttctcttttgcctacagatatcttcacccctctttgctatatgttaacatgtaattaatggtatgtagtacaaatacttttaatgctaatgttggcaaatgaacagttcattttatttattagtgtttgttgcatttcaactatacttcaacccaattacaaaatgaagttgaaactccttaagctggattttaacactcctacttgctccctgtatgcttctctttcaccatgatgtgatcatttattatatgtagtagctatataattcctggacaaattggagtgatagagtgctttgactaggacctgttaattggagtatgggagatttcatgggagttttgaataggaatttgaagatatgtattttgagacaggctggtgtagtagtatagctacatgggcttagaaacagacatatacaaattcctgagcagtggaggatggcaaaatgagaggagaataagcaagttgcaactgtgaagttaaagcatatagttaggagttggaccttcataatattggatgagatttttggttccagtctgcctgcttgatttttagggatctagatagcaagcactattgagtctggaattacaggctctggaacttggatttttcatcagagcccataattatagcagtcataccattgacagtttgcaaattaattttttaaaattgttgagtagtttggaaaaaatttgctccttccttacacttggtatttaatatgtcattaattttgtggaataagagagaggaatctagaaactgacactgggccccatgccctgccaaactctgtcatagtgttgctttttaaattgacagatttacacaagactctaaatcttgatggttgaagggactttcttgaaacagactttgaagacgattaataatctgttaatagaaataagcacacacggtactttgataaggcttgagattttttgattctttatggtaggtatctctacgtcttcaaaatttacttgtgatgaattaactaaaattaaaatgaaagttacagtcttttgactgtcgacttttctatagacataatttacccagtactgttcattaagattaaactgtttagataaacaggacatagtaaaaaatttgtggtagaagccacatataaactaaagatggctatgcttatgtagaagacatttaaatgttggcaaattgtccaaatcttcagtggcatgctgctggcctgccgtttaatatacaattaacattctaagatcaaagactagttagattaatttgacaattaaattggtgaagaagtgaataggctttgcaatttaaaattaaataatacatgttgtctgcttaattactgttgtgttcatgtaagtgatcacataatagaagggagctgtgggcttaaagtgaatttaagaccataaagccataatcagtcacatctgtttcatgactttaagttgatgtggtacgagtgtgaaagaagagctcattctttgaagaggcctgctgtacttacagaatcaataagtcaaaacaaaaataactgtagggttagaatctcttatattgccgaatgaaaattttgatagtttttggtaaagagattatgttagagctatgttgtcatttcactgactgttagcagcagtaaaaagtcaaaaaatggttagacagtgttactgtgtgtgtgtgttcttttaaatttgttaatgtgaaactgaggatcttaatatgagtccattgaatttctgggaagatgacataaggtaaagtcctcaagactgccccctcttcagacacagttgcaagtcttagcctccagaacttctgaccagctagcttcaatttggagttctcacaaccccctctttggattcaattaatttgctaaagcaactcacagaattcagggaaacttacgtttactggtttattttaaaggatattacaaggaatacagatgaagagatgcataggatgaagcatggggaaaagagtgcagagctttcacgtccaccctggatgtgccaccctccagtaacgtccacgtgttctgctgtctggaagctccccaaaccctgtccttggtcttttgtggaggcttcattatgtaggcgtgagggagtaaaccattgaccattggtgatcaacttaatcttcagcccgttctccttcctagaagatgtggggtggtgttgaaagtcccaacactctaatcttgccatgttctttcctagtccccatcccgaagctacctagagctgccaaccatcagtcaactcattaatatacaagaaagcatcattttggtgtttctgaggattttaggatttgtatgccaggaaacggttgaagaacaaatatatgtatatttcacaatatcacagatgcaaacaaatgatgtttaaattatctggtctttttctgagattcattaagtttagattgtatttctatggaattatagtataaatcataattaggtgcctaaactagcctctaaagcttattcctaaggtagctaaattacttattatgtatatatactatgaaaaatgacaaaatgtactgtttcaacactggtaattaagcaaactgccattgtaacataagaagtttatgaaaactattttgaataatttaaaaactttggggaaaactggattttataagataaggagatagagactattatataaggaggttgtgaaaggggttttgacactgattctttattgtctagatggattaaacaacttattactttaaattttgctttatacagaagtgtcactagctttgatcagagttttcgttggttcatgaatggaactaagttaaaggaggtgagaaggagaaatacgttttttctttttaaaaagttgtaaaatatacttaagatttcttatttaaaaaaaagagttgaaagaaacaggaaaaaatgggttaaagaagacatgggtatatcttgcaaaagaggttatcagaggcagaatttactgagcagtgaggtaatgagagaaacaggcaaagtgtgcatgagccccatggggaaggaagaaagttggagtttggcaagtcagctgttcttgtattgttttttgaacacatgacaggtgttggtgagtagggggcatggtgtgaccaactgctcctatgtgaggaaggtttatatattctgtctgggaaagtggtctgaattttctttataagaaattttagtatacttgaatttatttctgtatactaatacaacattgagaattagctttcagggacttctgtgccaattctattgggaataaaaatgagaagaaaggtagcttgtatagaaatagcagaggtttggtagtgaattcttatgagagaaaagatgtacagagaaagtaaactctagaattagcattatacacttgtctatgttgaaggatggtaaatagatggtgtgtctcttggcatgaagttaccaggtaaagggctagtattatgtaacccttggtattaaggatatgttagggacattacagtgggatttcatcataggcacattaaacctccttacatttagctgtatatattgaggcaaaaacaacaacaacaaaaaacccattaacatgttttttttttttttaagttaaaaaaaaaatagagatgtggtctcactatcttggccaggctagtcttgaactcctggcctcaagtgattctccgctttggcctcccagagtgctaggattacagacgtgtatcactatgcttagccttcttgactgtaagcaatagaaatcaactttggctaatttatgcaacggaataaataaggagaaccacttttggaaaatggataggaatcaagggaagccagcagcaaggaccagagccaaggtcagggcacaggaacactttgattaggaagccaccattagcacttgctgacaatgtctttgctgttgctataaataattctgcaactattcttgtgcctctctgtcactcaagttaaaagttttgggaaaggaacatggatagtctggtctagatcctgagcctatttccagcctgctaggggtagggaaaatctgggcctttggtttccatctaaactcatggtgtccatcgtttcttccaaacaaaatgggacaattactgcttccttcttaaatgccccatggctcagtaaatatgcccagttcctgaagccagaacttggaacttctctcattttctcagtcacatatccagtaaatagcatattgaattactgtcagtctgcaacttgaatatcttgagtttatctatttatctctaaaattattgttactactgtcgtagtcactgtgatttctcacatggtctattacagaggccttataatttctcttgtctacagattgacccctattctgttggggtatacattatgtggtgatgaacttttaaaaatgcaggtgagattatgtcattagtttgcttaaaacattttagtggtctgcatttatttacctcccatctctcagttcgagtccacccttttattctgtgttaggggctgggactttgcaacctacatttcccagactcccttgccagcttacttcgtgttaagttttaccactgggagcacaggcaggaatttggaaggtgagagaagggactactcttattcccagtttctgtaaggacacctccaaaagcaaaggacaactattactccattctccaacttcttttgtcactctctgcaccagtcttgctgtttcctctcagagataccagcttctgggcaaggcatcctaggtagatagagtgccacttgtatcacttcctaacctgctggactttattcccttagtggtttgaccatcctctattggacacctgttcatagggattcaaacttaagctacagggccatttgtgaccacctccttagaggttagagcattctgccacatggacctctttcaccttcttccaggcatagccctataatgcttttcttccaagctcctagcttttcaataacagacctctttcattttgttcccctagtcctgcgggtcatagtgcttcctgcaactattaatctctgagttatttcagccttcctgttctatgttctcagctttccagtatctttgtaaccaatgtgctgtattatatatatctcctgggtttgaattctgcattatggtttctgtttgtctcatacaagtagttttttgttttctaagataaagttaaaaaaaaaagttaaaataactagtagctgggggtggggggattaaacagattttcagactgagtacggtgacttatgccggtaatcccagcacttttggaggctgaggtgggaggattgcttgagcccaggagtttgaggctgcagtgagctatgttcacaccactgcactccagcctgggtgacagagtgagatcctgtctcagaaaaaaaaaaaagttttcataattcctatttgtctgttacttctttagtctcatttcataccattttcctgctttctctttacacttgagtattctgaaccttttttagttaccagaacattgctgcattctatcttgtctgaaggacattgcacctactagtctgtgtactccaaccctcccatccctcatttctcttcttctctcacattacaacctgtgctgggttgactcctacatattgaatgtgagggttagtatactgtagagggtgtacaaacaaactattgtctaaattttaatatcagcgttgccgttgtgtcagcgttatgacattgggcaatgtctcagtttcctcatctggaaaatggggataataattttactgacctggtgaggttgttgtaaggattaaatgagttaataaatgagttaataaaagtgctcttttcttcagaacatagtaattgctcagtaagtgtaacctgttgttattatcagctatgcatgaattcctctggaatgccttccatgatctccaaactctgacaggctctacctttgtaggctcctgtaatagcttcttcttcactgttctaatatgtattatggttggaattatttaatatcttgttttctttttaagagtgtaaatgatgtgaagttgagaagagagtctgtgccatttgctgttataaccctagcatctagtactgcctagcatctagactggctccaggtcggccctttaacttatattttaaaaaataattgattaaaaaatttaagagaaaagccataataagtttgataggggctaggaaaaatggatagagatagagatggtggtgaaataaatcaatgtaaatgatcagcttttctgtttttattgcccatcaaaatgctctagtatggaggctgtatgacagaagaagaggaatatctgttgttttgaagccactgtggtacaaagaacaagggttagaatcctgtcttaattcattgccactttgcaaagggaaaatgtttctctgggtctgattatagactacatttctggcttggtggcttttttcccccttgtaaagctttaattttgccccctgtgtctaaaagcaatttgtgtttatttctaaaaattttgaaagtacagaaaagcttaatgaggaaagcaaatatcattgataattctaatacatagagatggggcagctcttactattttggtataggctttactctatatttacgatatacatacagttttgtcctcctcctttcctctgtaattatttaatgtattctggttttaaacttgcttttttcccactaaatatattgtaaatctctttccatattaatgaatatttttatcattgtttaaaaaatgcttgactagtatgcttttacatgaatatgcaatatttattttacctatttgctgaatgatggacatttgagtttttatcctttcactgttataaaatattatgatgaactttgttgtacatacagctttgcttaacaaatattgagtgccttcctttagtgtgtattcaggtagactgtgcaagatacttaagctgtgagaaggaacaaaatagataggatttctgccttcatagagtataagataaattcctgaattgatgatcagagttgggtctaaattggtgataactttaaattaccaggagtttaacgaccattttactctcagactactgggaggaatgtgaattaggactctaaggtggtattagttaccattgttttctgtcagttttccttctctttaattatgtacttcctaattttattaatgtatatttggttgttttacttaattatatatctcacatctcagcaactgctctgaaagattatttccagttttggtagaaaacctgcatttacagtaaagtagtctatacatctggcttttctgtaatccatatacctttggtttatatactttagcattttctatctgggaaacgtatactgaattaaattttgccttttaatgggaatgaatgaatataatacaaatacctattgataattctgaatattaaatttgcagttgagataatttcctaattaataagaaattatattgcatcatagttatatactaaggcagtatctgacagtttgtgaggtagttgcttctttttaaagaatctggctgctttcagggactttggagtgatgtggaaatatttccacattccttacatgaaatagctccttactttttgttagtatcgcataacaaaagaacatatgatttggaatgactggagttcaaactaaaaatcatagctcaggaacttgtgttccaaagcctgaaaatttatgtgtgcagaagaatccctaaataccaagtgctaaataatttctctggtgtttctgcagatgcagaagctatccttttgtaaatcccgtcctctaaagctttttcttccttagtcttttaaatctgtttatacacatgtgtgcatagaaaatattttcttttgattgatactctacttgatttaaaagaaaaggtctgatactaagatgtgtgtgtgtgtgtgtgtgtaaaataaatacatcttcaccctgggataatacctattgtgtttaaacattaaatttaaaattctcaacttctgggcagtcagtgaaaggggaaatataatttcagttatcattattacatgatcataagagtaaaccatttcttttttctgaattctaacatttattagcttaagtcagcttttctcaaattgtaagtatagaataccaattctgtcaaattttaacagatatcaggattaagtttaggaaacaatggactaaataagatgaacagatttatttatatattttatcataactttaaatatcctaatatatatcttgacgttctaagagaaagatacagtggtttcctaacttatttgccttgaaatacccttttggtgaatatcagctttgcaaaatgccagcctaagtccttaacaacatgatgggttgtgtgtcttccatgccatttttgcagatgatgtcatcattgctttttatttgatcttcccttttgttgatttaaattccttttgaaacataatccaaggcaaagcttacttcttccaagtagcttagattctctctatccaccaggaattgctgcttttgaaaagcatgtgccagagggtcttgcgaactaagtattcctgttgtctgtgtgccagctggcctggcatttggtctaggagtctttcagatacacagtcagtccagactgaggctgaatttatttttcctagtgaaacctgagtccccacactccccatctactagggctgcagctattatagcaagggcctgagctctccatctgctccccagacacctgctggaactaattatcattattattaaaactttaaaaaaatttttttctattatgttgccttttttcctttcctttttcttttttcactttttttttttttggaactgattattttggaaacagcaaagaacaacatacttcacaatctaatccaaaaacataagcccctttggtcttccatgctgctcttttccattttgtttgtacacttgttttcccttcatcagctctcctatttctcctcacctatcctaaacatgtgtactttgctcttcagaacattggtttgtggttagccagttatccactattatattagcttccatatactctgttagcttgcatgtcttcatgtaatatttcttctgtcccctaatcttaacttgattcagctgcatctttcagtcgttgctgccttttttttggacatacctcaggtactttgcgggtaggaggttgggcagtctggtcagtgttctctttcattttcgttggtacctccagaccactcttcttccattctttcatttaacaccaaacaccaaacaaaaacagcctaacaaaatgattctgtttctttgaggcttatgccttttaactttctaatcttttttgctataaattttttctcattctttgaagactttggttcttggatttgatcttcattttcaccccaagtcttcttattatccatttggtagcatagcttcccagactgtaatgtcttcaacatcagtccatctggactttatatgtggtgtgaaatagaactccattcttgatttgctgatgggaaatcagtgatgataacctaaccatttgaagaatgacaggttgttaagtgtatgaattcccccatatgttgattgagtttaagaagataagagataattgaaaatcttatggctgtgtttaaaaatattttaattttatagtcataaatgagaagaaaagttatacctgatattgtggtacctggctatatcatgatattgattcaaagagagggattagctgttttgctaacaggtatggtagaaagagcactggataatttaaagtctggcaaatggcaaatcacttaatgtttttcactgcttttttctattttgaagtggagagaatacctaatccatatagttattgagctagtaaagtacatttatatatgtgtatatgtgtattttgtaaactttgaaaggcttcaatgtttaagatctcataaaaattagagaaccattctctgttaggatggattcataaggttactcctgaatatcacattatctccataaaaaacttagaattccctatactctgtgttttctataggaaatgaaaaaagttaaaaaaattattatttgtggactaggcgtggtggctcatcgctgtaatcgcagcactttgggaggctgaggtgggcagatcacttgaggccaggagttcgcgaccaacatagtgaaaccccatctctactaaaaaaaagaaagaaaaaacaaacaaattagctgggcatggtggcacacacctgtaattccagctactctggaggctgaggcacaagaattgcttgaacctgggaggcggaggttgcagtgagccaaggttgtgccactgtactccatccagcctgggcaacagaggaagactctgtctccaaaaaaaaaaaaaaaattattatttgtgatactttaatctacatgataaagagactccagtgaacattagtctacagatgtttaaggtctatggaaaaccagtatgttatttctcatgaccctgttcttgatattatactgtaaatattagctttttaatgtttcatttacaggtacatgatgttgattgatggcacaaatgaagtttttatgattgatagagacaattcagtatttcatgtttcaaatctggaatttccatttcgtaaagatcttcgtatgcatttatcaaatactctcttggatggcgtaagtcatatttatgtatactataaaattaaacattgccatttttcttttccttgtaagtaaatgtgtatttctgttggttaagaaatttcgaatgaaatctaacttttttttttttttttttgagacggagtctcgctctgtcgcccaggctggagtgcagtggcgggatctcggttcactgcaacctttgcctcctgggttcaagtgattctcctgccttagcctccccagtagctgggattacaggcatgtgccaccacgcccggctaatttttggatttttagtagagaaggtgtttcacatgttggtcaggctggtcttgaactcctgacctcgtgatccacccgcctcagcctcccagagtgctgggattacaggcatgagccactgcgcccagccaaatctaacttttattaggatgttaaatttcatttatttcttatgtatacttatattgaattaaggtcctcttaaagagagatctgccaactgaatctttgagcataagtaagactttgagatattttctttggtggagaaatttgttaaagatatgtaaagggtgttaaatgagtgctctggtcaaatatgtatacatatggatagttatataattttgcatgaagagaaacaaatgttacatgtggttagtaacttgtctttttccccacacttagcaatgtgttttggacatctttttcacataaatgtctgaatggtttaccattgtgtatatagagaccataaattggggtttccaaactatcttgactgtgaaaattgtagggttaaaaaattgcttgtttaaaatatgaccctttccaatagcatatcctagaccatatgaattggaatctcccaggggcctacatgtccgtacaagtgaccaagtgattgtaattaggcaagtttgagaaatagttctgtaatttatttaaccagttcccttttgttggacattttgatttttgtattttttcctgtatctagtaaattttcattcctgtgacagcatgagtaacaaaataccactttctaataaaaatgatatatatatacatatgtacatgtatatgtatctatatgtgtatagatttaactatcatagttaatgtgactggtacccttggggttgtatagtacataaaagtcatagtcatttgtggcagctctggtagttggttcatgggaacagcaggaacattttagtttttgttatctttatttaaggtactttttttagcattataattaataaaatataagaaaggaaaagacttaagtaatagcatttgtcaaagtttagtatagtttataattgaactaatgtttgttgagtgcctattatgagttgctataccaagagtacgggtattgcttagagggttgaggagaaggcctcacccttgaaacattttgcttaattgagcagggtggagaatgaatggtaatgatggaagagacctttgaataaaacaataacccaaagagaggtatttaagtcctgaggtagtttagaggagaaataaatcacatctagttagttaggaactaaatatgttttgtgtaggagttggcattagaaacagaaagatttctatagaaagatttttgatggacgtgggctgagggcattctaggtaggaaataatgcttaaaaattagatatttaaccatctacagatttaacttagcaatactatttatttcacctcaaacttggataactgagagcggcataatagattcttgtgaagttttaaaaatagcagtatgattcatgatgtcaatttacttgggctagaattatagttgccatatctgtttttttttgttaattaaaacagtcctgtagtttcctgtttcttctacattttcatgtgcaaattgtttttgtaaaattccaaatccaagaataattcaaaccacctaattgtctgactgtcagatgtgagcattgaagcttttgttttgctttgcttaactatgttctttgacctataaaatgtggaaaataggaatttagaaatactgcattaattcacttgaaacacatcagtgaaatttaatcaacttaatattgagactaagataagaatatagcagttaatcattaaagttaatggcaagaattttggaaaaattccatgtctttttcaactattaattttttataaaacactacatgcttattgttgaaattttagaaagtctgtaaacttagaaaaaataaacaatcaagagatgacattttatattttgatgttaaaaggaaatatccttttagtaactttgttgtgctaataattatataacatgtataaccaatatgtatatagctgacatttaatatatgttatgtatctggggttctgttattcctcttcaatctgaagaactgcttttaggattttttttttttttaaatttagttctttttttaaaaaaaattgagatacaatttacatactatgaaattcactattttaagatgttcaatctagtggtttttagtcttttccacaaggtcataaaatcaagaccactatctaattccagaacatttcatcacctatatggactgtgatgattagaaccaagggagccttatatgaaagatttcaaggaatgagttacagagatgagccttgaaggcccacaggttttgaaaacccttcagtggttccctgttattcatagcacaaaagccaaactgttcaatataatattctttatatctgaagcgtgcctgtgtcttcagtctcatctttgattgtgattgctaatcacaaatactcagctttggacaatttcatgcctttgttataccatttggcctatccactatcctgctggaaaatatactctgcatctttcaggatgcagctaatggtcatgtaccttattaccaaactttctcttattcttcaagtagaaataactacactccttgtacttaggcttaggtaatgctttcttacaacaacaaaatatatttttcctaaatcagtgtgttttttttgtaattttagatggttgtacatggaatttctgttataaaattagatagcaagaaaacctatctggtttcctagtaagaatatgaggaaagaaaaataattttaggtcaaaaacatattaataattaaaattttaagtaatactgcattttatacctgtagtcatcctttaatgtccttatcttgttctgtcagactgcattttttttgactttttaatggctatggtagatttgcagtgatctgttcatactcccttgccctgttccctttgaacaaagcctagtaaagtggtatgaaaccaagaaaggccacatggctcacatgggaattaaatctataatgaggatgccatttattgtcatagattttatgattaaagtaattggtgtataacaaaatttaaagcattaatgattaaacaaaaatatttttaaaaaagatcctgacgtttagaatttaaaatttgtagtcttcctacccttaattgtcacttagtaattcaagcataaagcaaaatgtagcatggaaattcaaatatgaaaaatatgatgagatattgtcaggtgattctatttcagtatagaataaatgcatgatggggatggggggctaacagtttattgatatgatctgggtacaagtgtgttcactttgaaatttcatcaagttgtatatttatggtttatgtgcttactgtgtgtatgccatatttcaattaaattaaaaaaaattgttattaaagtatgaagaaacttaccttcttttctctttcaaggagatgattattgacagagtaaatggacaggctgttcctagatatttgatatatgacataattaaattcaatgtaagtacctataatttataaaatacaagttattactgaaataatgaatgtatttttgacaatagtctttggtgctgccttagagatagtaggaaagaaaatttgtgactcaggttactcactgggaatcttttttttaatccttttatatctccttttctttctcttattgttaattttcacacatttctttgttttaggtttctttaacttgcaagtgagtaaagaataatggcataactctgataaaataagacagcatttcataaaatgaacatttctgattttaattatcctgtacttttttcttttaaatctcatgagtttatttctgtcaccaaaacagcaacaaaacaaaagagaaactgattatgagctgttgaatgggtaataaattgcagtattaattcaggattgcattaatccaggttattaaaagacatttttttctggacatttttaatgcacacatctaattttttgattgaaattctgtatttaaaacaaagaacttcaaatttaagagcctcagggccagaaaacatcaagttttattttgttctgtttgactgtattcctcataagtactgctttccagaactggcttaatctcatcacagatcttggaataacattcattggcctataactagacataaggggtggcggggtggctttgtttctttgtgagtagggaagttctgtctcctttacttcttgacactgagctctgctttaatacatgttcagtctgggcttactctcacttcttagctgagtactgtctcttagatagcagttttctaatactttttaaaaatatgaaaaatttcaccatatagaagagtctgaaaaataatgtaaggaatactcatgtactgaccagctagatttgttaaaacttcatacttttggtccactttctttttaataagacatgattcattacgaatccaatagaagtttcttagttacacctctctcctaatctcaaatctcttgcccagaatcagcctctaccctgaatttggtgtgtttattgttcccatgaatgtttcagatacttttactacctatgtgtgtatccatgaaatatatatgatattcttttgcaaggtttctggtgttatataaatgttattgtactatacctttgctgacctttgctcaacaagataatgttgagatttatttgtactaatatgtctagatttagttcattcactttaattaccattgagtattaaattgtataaatatacagaatttatcctttttccttttgatgaacattaaggtttccattttttgcttttatattactactatattgaacaattttatgtttttttcttgtgcgcacatgaaaatttcgctaggacagttgttctcattcttggaatgtaattacctgggaagtgtttttaaaaactctgttccgtcattagtgtatcatggagatggtgattaaatcagcagcttcagctatattatctgcattgctaaatttctctcagaaatagttgtttcagtttgccaaagttcgttttatcacacatttatattattaccaatttgatgtgtgtgaaatggtatcatcctgttttaatttgcttttccttgattactaacaaggtttaacatatttcttattttttttttttacttgtttggaatttatatgatttaattgcaagtttgtataatcttataatacaatcttctgtttttcctatttggttgtctgtttttttccctgattaccaatgaagttggacatatttctgaggtttatttttatttgtttgtatttttcttttgtaacttaattgcaagtttgttctatttggttttctgtctcttttttttcttcttaatatgtaggagtcaattatctttcctagattctagtcctttcctggttatatgtgtggcaatatgttttccaaatcagtgtttattaatgcacagaagctttaaattttaataaagtcaatctcatcagaccttcccaaatattatactttttgttttgtttaagaaattaatctatattttattctaaaaatgattgttatgctttttgtccttaggtcaataattgtttattcaatacatatttattgtgtgcctattaccatattttatgattttaagccacgtatatttttacatttctgatattgggatgcatttataattgaaagtatcgtatatttaattctttaatttactatggagtctttatggatgattaacaatattatttattttgtatcaccaaatcagggccactgttagaaaaagaatttttttgaaataatatttaaaatcttttcagtcccttagtttattagcttgtccagaaagaatttcatcaatcatctttttttttcaccctctgactctcagcatcgatcatcttttatatgtcaagtacatatgtactgggtatacaaagatgaatgagacataatttcttgcctttaaagaattcacatgctagtgtactggcttccaaagaaggccatttgcacagcgtttcattggaatttgggaagaacacaggagaacttaaaaaaaaatttaatattttattttgtcagttttataacattttacattaaaaacgtaacattttgtaatattttacagttgtgtatgtatacacatttttaaaaaacaggcattttttaatgtatttgttaggatatgtgtttagattggatataaaattaaagcaaatttgcagactattgatgaaatataaatgtaaagaaataattataactttaaaatcataaacataacaaaggtatataaaagatatagtggtattagagaggtgagagtattccaacttccctgggtatagttgagtcactgaagcatggaattgcagaccgagaaagtgacacaaattagttttgaaggattgagtcatggaggtcaggagcattagatggtttgttagcatacatttttttttttttttttgagacagtcttcctctgtcacccaggctggagtgcagtggcatgatctcagctcacagcaacctctgcctcccgtgttcaggcaattctcatgcctcagccttccgagtagctgggaccacaggcgtgtgccactacgcccagctaatttttgtatttttagcacaaaaatacaaatacatgaggttttgccatgatggctacgctggtcacgaacttctggcctcaagcaatctgcccgctttagccttccaaagtgctgggtttacaggtgtgagccatctgcacccggcctgctagtatacttgacggatggtaaggtgtgggacatagcaaaaaatgagaatggattgttaagtagagggccagattacttgaataaggcattttaacttagttctttatgtaataaggcattgttaaagggttttcattatagtaatgatatgaatatacttttactattttgaaagataactagtggcagcatggatagtgttttgaagggagtaagaactgaaaacagggagacaagctagtcaataattattgagtgtttcctgtagtctcttctcagtaattcaacacctatctgttgagagcttaactttgcccataggcattgtggatttgaaggtgaacttgctttcagtctattcttgaagtttggtgaatttatgtataaaggtagaaagcttctaggagggaatttagacatttacatatgttttaacagttgttagactttttttttttttagaacataaaagagggcttacttattctactttaattttataggtgtctgaattcttttaataactctaataaaccagcctaacgttttagatttttcaaccttgttgatgatgttgattgcatagaagagatgacacatggactgtatggttatttactagcatttccccaataaatatcctttacagatggttgtatgcctttatgtaaagagaacgtgtgctacctcatacctctcactcactttgtctctctccttattctttgctgaatatcaaagttgtcatccttctaaagttgagaaaaagacatccccaaggtatatttaatgtttactccttaagcaagtgctgccacccctatgtaaacattaggttgagtaaatgttaggttggagaatatacattggagaagaggaaaaagacagaaaagatgggggaaaaatgcacttaaggtgtgtccagttgcaaaataaaagagtagcttatgtgccattgaagcgataattactaatctggatggttactgtcaaccagataatatgttataactgtgtttgtatatgccacatggataggacgagacttatcctcaattcatacaaaagtgttcatgtactttttatttcacagttcaaaccatatatgctttaagaacattcaagggaaagtgtatttgagggagagtactatttctttataactgtataactttgaacatattatgtaaacttctgtgttagcttccagagttgagggtgtatttgatacatgtcttctacttgctgatgtctatagcattagcactttaaacaacaaaaaacattgtaggtaactgtgcgacctattttggtgtgttactcgcttgtacttttctgaattctgtggattttagtttttatactgtaatagggtactgttaaagggtttcaactaatttatataaataattaaaaaagactagtgagtatatattttttctattttaaaatgattctgtacctataaatagtaagtatattaatactttaattcagatgtgaaattgtttattttattttttattttttaaaatttggaagtggtggtcttgctctgttgcccaggctagcctcaaactcctgggctcatgtgatcctcctgcctcagccttccaaagtgctgggactacaggtgtgagccaccacacccggcctagatgtgaaatatttcgatcaacttacagtagaattgtgccactttctcatactgttttatacagttgtattttaaaataagtctctttgtgtgtttagatagttgtattgttagtcaaactaattattagggttggtatatatgtttgtgcacgctgtgcactgaataactccagaggatgctgtttacacagactattatgtacattgtggcagccttgataattatgctgataaaatagttgttagtgttgaaatttaactaattctttatttaattcagtcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaaggtaaagtttaatttttttttaaattagtgctaataatgtctcataattcagcttacaagatgaatatgaatgacattttgctgcccagttgtcttgactttgtcagaaaatactcgaattgggtatagcgctgttttggccaaacatggtacgactcctaggctttttctcttgaataagattctcagtggtggcacctgaaactaggctgtttccctttttctcataatagtttttgtttcatggtcattggtcatactacgttttttaaaaagctataagcaacatagaactgtattgaatgaaaatcattaggcctgctcctacacatcctgaaggtaaagtgtttggtacgtactcttattaaaaagatacatttatatatatgtgtatgtatatctatatatacagatatatatatagatatatatacacacacacatacattgaaggttttcttttagtatttttgttgtttccacttaaaatgaatcatatactaaggccaggctcggtggctcatgcctgtaatcccagcactttgggaggccaaggcgggcagatcacaaggtcaggaactcaagaccagcctggccaatatggtgaaacccgtctctactaaaaatacaaaaattagccgggtgtggcggcgcatgtctatagtcccagctactcgggaggctgaggcaggagaatcgcttgaactcagaaggtggaggttgcagtgagccgagattgcgccattgcactccagcctgggcgacagagcaagactctgtctcaaaaaaaaaaaaaaaaaaaaaaaaaaaagaatcatactaaatattccaagatgttggttctttttgttttgctttgttttttcacttaacagtatggcttggagatatttccatgtcagtgtatagagatttgccatgttatttgttaagtgctgcatggtaatgatagtaaaggtgtactatacattatgttgtaattgatgggtttttagattgcttctagtcctttgctattaccaacactgtttcagtgaacatttttgtttatatgggtggatatttcttcagggtaagtagaatttttggtttaaagattatgagtaatgttagtaactactgccaaattcctttccaaataaagcaattttgtctccagcagatgagagagctcattttcccattgccagcactctttttttttttttttgatctgtaggcaaggcagtgtattgtaatgggaaggtgagtatgagttttttgttttgttttgttttgttttgttttgaggcagggtctcactcttgctcagcctggagtgcaatggtgccatctcggctcaccacagccttgacctcctggggtcaagtgatcctcccacctcagcctaccgagtagctgggactacaggcgcatactaccatgtccagctaatttttttgtatttttttctagagacgaggtttccctgtgttgcctaggctggtctccaactcctgggctcaagtgatcagcctgccttagcctcccaaagtgctgggattacaggtgtgagccaccatgcctggctgaaaagttcatttttatgtagttaaatttggcagaatatttcttgcatcttctggttttctgtcttgcttaagaagcccttcatctctaaaatgtttttatattatgttctaatattgctatgattttgtctgatgattacatttagatgctctatttttactcttccattccttcagggaattgtcttctgtttgcatagtctatttagcatccagtttcttctattcactgtctcttcttcatgccctgtgttctcacatgaacatactaattctgtttatgcctcatcttctccattttccttttcattctcttttttttctttgttattatttttagtatcactcatatgactactgttattactggtactactgttattgctgctgcatagtttgttttcagtgggatatttaccagatctagtgtttaaaagcaattgtaccttggtatttctgttttttttaagacatataaactgcatattgactatttcctaagacttttctccatttctcatttgtgcttttggtgagattcttatttctttgtatataaactatacatggtgttttctgtgtgcctgttatgtgttaggatgtctgatttattgaacccaccttttaatttgtttttcttctctgacttcccgttttcctttcttccttgttttataatttgtctgcagttttgaatattcgtaagacattcttgcttttggtagtggttaactttcttagcaaaccgattgatggttctaattcatagatatgttagttggcagtcataaagctctgctctccttatcagaatttaaatgtattttgagcctgcataccacatggtcccatgcttgattgtatactgataaacatttgaaatgttttagaagttttagaagggataagggggcacatttggcattcagaagaaggccagctggctatttcctaagaagcctgaaggaatgttacaccttttgtgaaatttgtcatattccagaatcaggtttgtagcttcacagattcagaaactttgggaggcatttgctctttttatatttctctattgtgagttgaatttatagttcagctttgatactgggttatgagtacttttacattaaaattgcacgtggcatccaagaagttgcattgtggtgggattttattttctaaaccagtgttttatatgcctggtttagggcatttgaaaaattggtggccatgaagaaccatggtctgtttacattcaacccagggaatagtacccaaataatttatattttttgggaggagggtggttatgatagaattgtacaaaaatatagcaacatatgcaatcatgttttaaactcttcacctgctcctactctagtctgcttaatttggtgtcagtctttggatatgatattagctgtaagtaatcctagcactattgagtggctatctttttcattcaacaaatacagagtaatcatcctacttttattatgattttgtgtaacacctgcttggcatgggaattttggttgacctctgccgctatgatctttcgactgttcactgcttgccttttgtgtctgttttggcagcagggatattaagggggtacctacaagagcctgtgtactactgtgccctgtccaataggttgggtaaagataaagttaatatttaaccatctgctctgtccacggtggaagtctattaactgaaactgtgttctcttatgagaacattttctaaattgtaaatacagtataaaagttgggcaaaagccagattcctttggtttgtgttcatttttaaaaaatgaatttcacaggttgtgctgtcataattcagagttcagcatttaagaaaatgtgtttagatagtataatttcattagtcaaatcagtactgcttagaaatatttgctaatgtgtaatatcagaactattttttagggatttgaaacaattatgtggaacaacttgttatgtagtttttcactagaaagacagtgttcttactatgtttttctttatacttagcttatgtaattccttaaaatcataggatatttcttttttaaaagcaattcttgctaggcgtggtggctcacacctgtaatcctggcactttggaaggccaaggcacttggatcgcttgtgcccaagagttcgagaccagcctgggcaacatggcaaaaccctgtctctacaaaaaatactagaaaattagtcgggcatggtggcacatgcctgtagttccagctattcaggaggcggaggtggaatgattgcttgagcctgggagtttgaggctacagtgagccaagattgtgccactgtacttcagcctgggtggcggagtgggacactgtctcgaaataaataaataataaaagcaattctaatttttagaattttgaatagtctcctctcctcactttcagttcttattattgttttttgtccttaatgtctcttactgaagtattttcggttgtagaatacaaaaggaaaacacactttatagcagaattggcataacatgtaagaccttagtaacaccagttataggataataactacaattgacaggttattgctgtggagatttttatctttgctaatgggatggtaaaatagtgatattacgaaccttacagcattttcagggaagtatagatcatttattttaagaatggtagcttttatgaagttttaaacaaaatttacagctataaaacatgcatactaattttgtagaaaaataatagaatttcatatgtgtatctttaaaatctcaaagatgattctgattttaggaatttattaatattgctctataactctttgttttgtttaatttgatctgttaaacacaataaagggataattgttcagtttttaactttaatatacagtcagaatacaacatccaaaatagtaataacaagctgtttttcaaattgcgattctatttacatttccagtttgaaggccaattcaaaaagaattatttgaacagactatatatgactaacaaaactttaaaaacatgcagtaaaaagtttctctgaaagctccccatccatttatcaccttctcagtaaccattgctgttagcttttagtgtatccatccagaatttctttagcaataaataaacacatttatttatattcttactatctccataaagtgatgatttttttttctttttttcgaaacagagtcttgctctgtcatccaggctagagtgcagtggtgcgatcatggctccctgcatccttgacctcccagactcaaacaatcctcccaactcagcctcctgaatagctggaactatagaccggaaccaccattcctagctaattttttaattttttgagtgatgggattttgctgtattgaccaggctggtctcaaattcctgggctcaaacgatctgcctgcctcggcctcccaaagtgttgagattacaggcatgagacaccatgaccagcatggtgattttttaatacactgttctgtcgttttctttttttctttaaaaaaaacttgacagtatctcttaagtctcttcactccagtataggtacacagagattagatcatcttcatttctctttaacagttgcacagattttcattgtatcagtatgccataacttagctaacatcatagtcatagacatttgggttatttttagtctgttgacatggtttttttttttttgcatatagatattcagttgtttctataccagttgaagagactatccttttctcattgaattacttttgcacattcataaaaaatgaagtttgttgtgtatgtctggttctgtttctagactgtctgttcagttctcttgatctatttggctgtctttactcaagtaccatactgtcttgattatttttggttgttgtaaatcttgaaatcagatagtattaatgttccaactttgttgttcttttctaagttgttttggctattctaggcctttgcattttcatgtgaattttataattagctgtcaatttctacaaaaaagcctactgggattttggttggaattgtaatgaatatataggtcaattttggggaagaactaacatcataacaatgccaagttttctagttcatcaacctggcatatattttcttttatgtaggtcttctttattgtctctcagcaatttttgtagttttaagcatgagattttgctcatcttttttcagatttatttcatactttttgatattgtcataaaagtctttgtaaaatttccgtttctgactattggtagtatatagaaatatacttttttccccaaaggagtacgttgatttttgtattttgatgttttatcttacagtcttgctaaactcaattattatactaataattttttgtgaatttcatcaaaattattacatagacaactatataagtgaaaaaggtgctacttttccctttccaacttggatgcttttaattttattctcctgccttactgcactgactagaatctattgtttaatgttgtatggaagcagtgagagtgaacagccttgtcttcttccacatctatagggaaggaaaattttgtttttaactattaaatatgatgttagctataggactctaggatagatgccttttatacatggttaggttttaaacttgaaagctgataattttgacatacaatcttatttatcgaactctcttacttttgttattgcttgcaataattttgcaatttttttaggtattcatattaagtgtaaatagtgatatttttacttattggatttttcatacattaacttttgtctagtttgattatacataaatacagttttaaattgtggcagtagttatggggattcttttttcctgatttgagtgggaatgcttctggtgtttcttcagagtatgatatactgcctttaattctgagatctgttttatcaggtgaaacaagtatgcgtttgttttatttttaaccaagaatgggtgttcagtttggtcaaatggcttttcatctactatagatcgaatactatttttttttctgtttagatctgtttatctcaggaattatatgaaaatatttcctgatgttgaatcattctctcattcctgggataagccctactttgtcttaatatattattttaaaaattgtactgcccagtttttttttctaacttttttaaaggatttttgcattgatgtttataaataatcttgatatgttgtaaatctttggaaactttttcatcagtggtacactctgttatactctgttttcatcagtgtaataaaaaaacttggtttaaaaaaatatgttctagagcttttttttgttgttgttgttgttttaagacagggccttgctctggtacccaggctggagtgcagtgacacaattatagctcactacagccttgaactcctgggctcaagtgatcctcctgcctcagcctcccgagtagctgggactacaggcacgtgccaccacactcagctaattttaaaattttttgtggagatagtgcctctcagtatgtttgaccaggctggtcttgaactcttaggctcaaggctgtgctctggccttggcttcccgaagtgttgggattacacggtaagccaccatgcccggccagagcagttttaataaaaacattggaattacctgcttttttaggtttttgaggaattcctccacggaattatttggattgtagtgctttgggtttgggttaatatctttttcacttcctatgtgaaaattggtacatttaaatttttctctccctttgagtgcaatatccatttattaaaatacctgaagtttcttctttcttttttttggggggtatttttttgcacttgatcttagccaagaagttgagaactgatttttaaaaatgtgatagctatttaatttttttctcctcccatgaacttttagattaattttttatttctgctcttttcctaagccaagcctagttctgtttttattttattttagagataggatcttgttctgtcacctagtggagtggagtggtttgatgacaactcactgcagccttgacttccttggcttcagcaatcatcccgccttagcctcctgagtagctgggactataagcacgtgttatcatgcccggctaatttttgtatcttttgtagagatggggtttcaccgtgttcccctggctggtcttgaactcccgagctcaagcagtctgcccaccttgacctcccaaagtgatgggattacaagcgtgagccaccacagctggcaaatatctgataatttatttgtcatgttagtaagggttttgcggttttggtttattttttcatctttcccaggattgtgagagttttaaaatttctagtggaagagtctttattttctgagtttattcttaatttaaaaatttttattatagtgacatgagagaatattatctgcacttttctactttttggaatttattataaagtgtcatcaattatatatatatataaatctcattcatatgtcatttcagagggaaatttaagaaaatcatataatgcatactaaagagaattcatactttcatatggtgaacctaaagatttattgtcccagataacttcctttggagtagtaaatcatatatatatatgtaaatcttatatatacatgtaaatcttatatatatatatatatgtaaatcttatatatatatgtgtgtgtgtgtgtgtgtgtgtgtgtgtgtgtgtgtgtgtgtgtgtgtttttaatagagacagagtcttgctgtattgcccaggctggtctcaaactcatgggctcaagcaattctttcacctcagtgtcccaagtagctgagctgcaggcgtataccactgtgcctggctaattataatactttctaaaactttctggtacagatctatcaccttaaaattctggtagttactgactttttgtcctgctctgaagtttaatgtttttatacgatgtttttcataggcattttagtagatgttttggaaagtttgtaccaaatctgctagacagacaatattttaaactacaaagctctgttattacttgcttagtctgagaagctgctttttatgtttcataattattttccccttattttcagggaataggttatctgtgtatataagtagatgggaaagaccactctaaaattgctcatttgtggagtgataacatttcctgatatattcttgtctaattgcctatttttctgcccaattggcaaaaataataatgcattctcttctttgacaaatttctcatgtttacttttcctgttgaaatagtatgttgtctttctttattttctgcttgtctgtgtctggaactctgtacatttcccttagagggagtcagttgtgtatagttaggatctagtgaaagaacatgcaaagaatcactcttgagtgattttaggaaattgtgcttgattaaaaaaaataagcaagtccctgtcccctttcccccatttcaaaagctagaattaaaaaagaaaacaaaagaacagataatctcttgaagttcctagtggcaaagcttttctctgcttggagtcattttactttctactgtctaattagactagaaaaattttatgtggaaaatatttttaaataatttgcttattgctgtttcaaaagtaaaatgtttgctttataggatgaaagagtagtaaatgttaagatctcctttctaataactgttgagagtattaaatagacaattacaaaggttattcttttactacatttaatttttcaagaacacatctacttttaaaataattttattaatattagttatttgcatgcttcgttaggcaggaatttaaattttatgtttatttatgtatttcatttggcattcagatttattttctatgtattgcttttcttttctttattttcttgtttatcactaaatataaatttataagttcttaagtgtctgttcaagactagtagttcataaaaccataaggcttgttatttttatatcactgttctatgactgtatcagtgttgtattgtttgtatcatagtaaaagaaacagaacctttgagagtttgttatggcaactgtggttgaagagaagaaagaatttttgcataaacatgaagatctattgttcacacatagagattttcagtgattatgcctaatttttaatgaaattacagatataatggtgcaactgcattttgatttgaaagcagatgcaagataaaatgaggatgaccattccttatcatgtttgtggtgttcagttttgcattatctagtctattaatatgtcattcattattgattattgaatatggcctgatggatcctttcaatctcattcatatgtcatttcagagggaaatttaagaaaatcatataacgcatactaaagagaattcatactttcatacggtgaacgtaaagatttattgtcccagataacttcttttggagtagtaaatcttattcattgacacatgaagaaataattgtatctcatgccatatatatttgaaatatttctatgaaagatttttaattgtaacatggagaattttctatgtttgctaaatatgagagctaattttttttataattaacattcaaaaaaatacctatttgtagattcagaggaaaatgatgattattattttattttattttttattcttttttttgagacgaagtctcgctctgtcgcctaggccagagtgcattggtgctatctcggctcactgcaacttctgcctcctgggttcaagcgattctcctgcctcagcctcctgaatagttagatatcaggtgtgcgccaccacacccggctaatttttgtctttttagtagagatggggtttcaccatattggccaggctggtctcaaactcctgacctcgtgatctgcctgcctcggcctcccaaagtgctgggattacaggtgtgagccaccatgctctgtcaaaagatgttattggcctccaaaataattaagaggcagttactttgcctaaatctgatcaattaattgttctgtgattgtgaatttgctgcaggttaacaaagccataggattgacatagatcacatgactgtattcacattcagctgaatacttttctaaaaattatgctttaagttctgggatacatgtgcagaacatgtaggtttgttacatagatgtgttacacacatgtgccatggtggtttgttgcacccatcaacccgtcatctacattaggtatttctcctaatgctatccctcccatagcccccaacccccaacaggaccccatgtgtgatgttcccctccctgtgtccatgtgttctcattgttcaactcccacttatgagttgaagatgcagtgtttggttttctgtttctgtgctagtttgctgagaatgatggttttcagcttcatccatgtccctgaaaaggacatgaactcatccttttttatggctgcatagtattccatggtgtctatgtgccacattttctttatccagtctatcgttgatgggcatttgggttggttccaagtctttgctattgtgaatagtgctgcaataaacatacatgtgcatgtgtcttttagtagaatgatttatactcctttggttatatacccagtaatgggatggctgggtcaaatggtatttatggttccagatccttgaggaatcgccacactgtcttccacaatgatggaactaatttacactcccaccaacagtgtaaaagcgttcctatttctccatatcctctccagcatctgttgtttcctgactttttaatgatcaccattgtaactggcatgagatggtatctcattgtggttttgatttgcatttctctaatgaccagtgatgatgagcattttttcatatgtttcttggctgcatacatgtcttcttttgagaagtgtctgttcatatcctttgcccactttttgatggggttgttttttcttgtaaatttaagttacttgtagattctggatattagccctttgtcagacggatagattgtaaaaattttctccattctctagatttcctcttcattctgatgataatttcttttgctgtgcacaagctctttagtttaattagatcccacttgtcaattttggcttttatttccattgcttttggtgttttagtcatgaagtctttgcctatgcctatgtcctgaatggtattgcctaggttttcttacagggtttttatgggtttaggtcttatgtttaagtctttaattcatcttgagttaatttttgtataaggaaggggtccagtttcagttttctgcatattgctagccagttttcccaacaccatttgttaaatagggaatcctttccccatttcttgtttttgtcaggtttgtcaaagatcagatggttgtagatgtgtggcgttttttctgaggcctctgttctgttccattggtctatatatctgttttggtaccagtaccatgctgttttggttactgtagccttgtagtgtagttttgaggtcaggtagcatgatgcctccagctttgttctttttgcttaggattgtcttggctatatgggctcatttttggttccatatgaaatgtaaagtagttttttccaattctgtgaagaaagtcaatggtagtttgatggggatagcattgaatctataaattactttgggctatatggccattttcacgatattgattcttcctatctgtgagcatggaatattttcccatttgtttgtgtcctctcttatttccttgagcagtggtttgtagttctccttgaagaggtcattcacatcccttgtaagttgtattcctaggtattttattctctttgtagcaattgtgaatgggaattcactcatgacttggctctctgtttgtctgttactggtgtatgagaatgcttgtgatttttgtgcatcgattttgtatcctgagactttgctgaagttgcttatcagcttaagttgatttggggctgagacggtggagttttctaaatatgcaatcatgtcatctgcagacagaaacaatttgacttccagtcttcttatttgaatacactttatttctttctcttgcctgattgccctgtccagaacttcaatactatgttgaataggaatggtaagagagggcatccttgccttgtgctggttttcaaagggaatgcttccagcttttgcccgtgtagtatgatattggctgtgggtttgtcataaatagctcttattattttgagataagttccatcagtacctagtctattgagaggttttagcatgaagaggtgttgaattttatcgaaggccttttctgcatttattgagataatcatgtggtttttgtcattggttctgtttatgtgatggattacatttattgatttgcgtatgttgaaccagccttgcatcccagggactaatccgacttgatcgtggtggataagttttttgatgtgctgctggatttggtttgccagtattttattggggatttttgcatctgtgttcatcagggatattggccctgaaattctctttttttgttgtgtctctgccagtttttggtatcaggatgatgctggcctcataaaatgagttaggttggagcccctctttttctgttgtttggaatagtttcagaaggaatggtaccagctcctctttgtacctttggtagaattcagctgtgaatctgtccggtcctgggctgtttttggttggtaggctattaattactgcctcagtttcagaacttattattggtctattcagggatttgacttcttcctggtttagtcttgggagagtgtatgtgtcgaggaatttatccatttcttctagattttctagtttatttgcatagaggtgtttatagtattctctgatggtagtttgtatttctgtgggattggtggtgatatctcctttttcatttttttattgtgtctatttgattcttctcacttttcttctttattagtctggctagtggtctatctattttgttaatattttcaaaaaaccagctcctggattcactgactttttttgaagggttttttttttgtgtctctctctctctccttcagttctgctctggtcttagttacttcttgtcttctgctagcttttgaatttgtttgctcttacttctctgtttcttttaattgtgatgttagggtgttgatttaagatctttcccgctttctcctgtgtgcatttagtgctataaatttccctctaaacactgctgtagctgtgtcccaaagattctggtacgttgtgtctttgttctcattggtttcaaataacttctttatttctgccttaatttcattatttcattatttatttcttccttaattaacttctttatttctgccagtagtcattcaggagcaggttgttcagtttccatgtagttgtgcggtttttgagtgagtttcttaatcctgagttctaatttgattgcactgtggtctgagagactgttatgatttctgttcttttgcatttgctgaggagtgttttacttccaattatgtgctcaattttagaataagtgtgatgtggtgctgagaagaacgtacattatgttgattttgcttggagagttctgtagatgtctattaggtctgcttggtccacagtttgagttcatgtcctgaatatccttgtcaatttcctgtctcgttgatctgtctaatattgacagtggggtgttaaaagtctcccactattattgtgtgggagtctaagtctctttgtaggcctctaagaacttactttatgaatctgggtgctcctgtattgggtgcatatatatttaagatagttacctcttcttgttgcattgatccctttaccattatgtaatgcccttctttgtctcttttgatctttgttggtttaaagtctgttttatcagagactaggattgcaacccctggtttgtttttttttttttttttttgctttccatttgcttggtaaatcatccctttattttgagcctatgtgtgtctttgcacacacataggagctgggtctcctgaatacagcacactgatgggtcttgactctttatccaatttgccagtctgtgtcttttatttggggcatttagcccatttacatttaaggttaatattgttgtgtatgaatttgattctgtcattatgatgctagctggttattttgcccattagttgatgcagtttcttcatagtgtcgatggtctttacaatttggtatgtttttgcagtggttgatactggttttttccttccgtatttggtgcttccttcaggagctcttttagggcagccctggtggtgacaaaatctctcagcatttgcttgtctgtaaaggattttatttctccttcgcttatgaagcttagttggctggatatgaaattctgggttgaaaattctttcctttaagaatgttgaatctctcctctggcttgtagggtttctgcaaagagatctgctgttagtctgatgggcttccctttgtgggtaacccgacctttctctctggctgcccttaacattttttccttcatttcagccttggtgaatctgatgattatatgtcttggggttgctcttctcgaggagtgtctttgtgatgttctctgtaattcctgaatttgattgttggcctatcttgctaggttggggaagtcctcctggataatatcctgaagagggtttccatcttggttccattctccctgtcactttcaggtacaccaatcaaacataggtttggtcttttcacatagtcccatatttcttggaggcttcattagttccttttcattctttcttctctaatcttgtcttcaggcttcatttcattaagttgatcttcaatctctgatatcctttcttctgcttgatagattcggctgttgatatttgtgtatgcttcacgaagttctcatgctgtgtttttcagctttctcaggtcatgtatgttctctaaactggttattctagttagcaattcctctaaccttttttcaaggttctcagattcgcattgggttagaacatgcttctttagctcggaggagtttgttattacccaccttctgaagcctacttctgtcaattcctcaaactcattctccatccagttttgttcccttgctgatgaggagttgtgatcctttggaggagaagaggcattctggcttttggaattttcagcccttttgggctggtttttcctcatctttgtgcatttatctacctttggtctttgatgttggtgaccttcggatggggtttctgagtggctgtccttttgttgatgttgatgctattcctttctgtttgttagttttccttctaacagtcaggcccctcttctgcagctctgctggagtttgctgggggtccagtccagaccctgtttgcctgggtatcaccagcagaggctacagaacagcaaagatttctgcctgttcttcctccggaagctttgtcctagatgggcacccaccagatgccagccagagctcccctgtatgaggtgtctgttgacccctgctgggaggtctctcccagtcagtaggcactggggtcagggacccaattgaggaggccatctgtcccttagcagagctggagtgctgtgctggagatccgctgctctcttcagagccagtagtaggcaggaacgtttaagtctgctgaagttgtgcctatagctgccccttcccccaggtactctgtcccagggagatgggagttttatctataagcccatgactggggctgctgcctttctttcagacaccctgcccagggaggaggaatctagagaggcagtccggctacagcagtttgtggagctgaggtggggtctgcccagttggaacttcctggaggctttgtttacactgggaggggaaaaccacctactcacgccttggtaatggcagacgcccctccccccaccaagctccagcatcccaggttgacttcagactgctgtactgccagtgagaatttcaagccagtggatcttagtttgctgggctccatgggggtgggatttgctgatctagaccacttggctccctggcttcagccgcctttccaggggagtgaacagttctgtcttgctggtgttccaggtgcctctggagtatgaaaataaaactcctgcagctagctcggtgtctgcccaaacggccacctagttttgtgcttgaaacccagggccctggtggcgtaggcatccgagggaatctaccggtctgcaggttgcaaagactgtgggaagagcgtagtatctgggcctgagtgcactgtccctcatggcacagtccgtcatggcttcccttggctaggggagagagtgcccaaaccccttgtgcttcccaggtgaggtgatgccccaccctgcttcagctcaccctctatgggctgcacccactgtctaaccaatcccaacgagatgagccaggtacttcagttagaaatgcagaaatcaccgccttctgcattgatctcgctgggagctgcagactggagctgtacctatttggccatcttgccaggcctctgaatacttttttttttaaagtgtgtaactcaacaatgtgagccactactttggcattgtctgacttagtaggttttttagaattttaaagtgaaatatggcagttaaataatagcgtctgccctttccacttgcatagaagcttctgttggtcattgttgaaatgatggaggtatttagttccagcacattaattttaaagtaatttttatagtatattatatatatatatatacacacacacatatatatatatatatatacacacacatatatatatatatatattttttttttttcttttgagacagggttttgctcttgttgcccaggctggagtggaatggtgtgatattggctcatcgcaacctctgcctcccaggttcaaatgattctccttcctcagcctcccaagtagttgagattacaggcatgtgccaccatgcctggctaattttgtatttttattagagatggggtttctccatgttggccaggctagtcttgaacttccggcctcaggtgatctgcccatcttgtcctcccaaagtgctgggattacaggtgtaagccaccgcacctggccgatgatttttatacttcgagcagagccagtcttactaaaagtaaaatatagaaaacttgtgtgttattattgaattattgcaataaaattttaaaatactttgagaaattacttcagtgaagccgttaaactcgtaggtttaagttaacttctctaaggcatgagtgtgaagacaaatgcatgaaaacaaactgtaaatcacagatatgattctagtacacaattggtgatggtgttgaagaagggtgtcagacaactctgttgtttatatggaaccagattttctgtaccttgtttaccaaataagatgctatcggttgtaaaccatgccccctgcccacctttttcttttcatacctttggaaatctcttacccagtggtacatgaaatcaactgtgatttgtcattgtaagataagtgctgttttcagacatgtgaacgtgtgggctgtgaaatggggaagtatatatttcccaaaagagggaagaactctatattttctatgctaattgtaaaattggtttgaatgaaccaggcatttgaatagattagaaagagatcagcatcaatttgtttgtgttctaccattgtgccatcagtcttgccttactttgttggacacgggtgcagagtgaggagaaggatagtggaaaatgcaaacaatttatatgaacataaggaatatggcaactataaggcatacatttaaaaataatggtcataatcagagcaattttgtatattagtgatagctgaaaagctctaatagtgaactatttcagtagaagaccaatagaacacactgtgctttgcagtggaagaaacagtaccactgtataacaaagtttggttgtagacacaaaacaaaggcaaggtttacatgtattcaaataaacatttttaaaaaaatatatgtatgtcaaacatatacacactgatttggaaaataggctgtatttatttaaaagtaatggttttcaagttagtatctctgattagatgtttagaatgctaccaaaattttgttactaatgtttcgatgaatatctctttagataacttagtgaaagttcatgagttatttccttaggataaattctaaaaatggaatctatgccaccaaatattcttgaaagtttgtgctactgtgtacctccacccatgtggtaggcagaattttaaggtgaaccccaatgcctgttgtgtaaccccctcctcttcagtgtgggtgggatctgtagcttgcttctaaccaacagatggcaaatgtgatgggatattgtgtcaattattaatttatattcttagttctcagtgtacccttcagtgtatgctctatgataactgacagacttcctttaagcattttcacttaagaattttggcattttgtaaataatttttggttattcttttcctttcatttttacttacatgttttttagaaaacagacagaaggctgggtgtggtggctcacacctgtaatcccagctctttgggaggccgaggtgggaggatcacttgaggtcaggagtttgagaccagcctggccaacgtggtgaaaccccgtctttactaaaaatacaaaaattagctgggcgtggtggtggacgcctataatcccagctactctggaggcagaggtaggagaatctcttggacccaggttgcagtgagccgagatcgcaccactgcattccagcctgaatgacagagtaagacgtctccaaaaagaaaaaaaaaaaaaaaaagaaaacaaacgtgttttcaatttattgcagggtcctttttgttggcgtcttgtttatatgtgttttctttcaaagcagacctgtccaacggaactttctataagatgaaaatgttctgtaatctttgctatgtactacagtgcctcctagccaaacatggttattgagtagtgcttgaattgtggctagtgcagctgagggaactagatttttaatgtcatttaatttaaattttagtagccacatgtggccattgaatagcacagttttaatatatagttgtgtgccacttaacagtgttttggtcaactttggactgcatatataatggtggtcccataaggttataacaaagttgccctatacaggtgtaccattttttatcttttatacataaatacttaccagtgtgttagagttgcctacggtattcagtacagagtatagttacatgctgtacaggtttgtagcctaggagcaataggctgtatattgtatagcctagtgtatagttggctggaccatctaggtttgtgtaagagcagtcggtgatgtttacacaatgacagaatcacccaacaatgcatttttttcagaagacactcctgttgttaaatgatgcataactgtatttttaaatttaatttgctggtatgtaggatttttgtgcctatatcatagattctttttacatttaaagcaaaataaaacttatcttgatgtatacctgtatgatctagttcctgcccaccttgctgctaattttctatgattttcttttacagttactgttcactagtgtttttatttcttgtatttccacatatgatattttatagttcatgttaagacatttgcactctggaactgtgcttagcttttatagctgcctctttctagttctcagctaaatctcaactcttttgttagcctgatctttgattttttttccaacaacattttatttagaaaaaatttaaatatacagaaaagttgaaagaattttattgtgaacacccatgaaggcctagagtctatattttcctgtaccagctctaacacatattaattcatctatttctctatccatccattagtctattttttggggtgaatttcagagtaaattgtaatcttccatttattttcagttttattttttactgggtttatctctttattttgttggagaagttctttacatatcttggatattggtcttttgtcagatatatttttctgatatattctcccactttgtaatttgctgttttattttcttaacagaggcttttttttttcttttttccttggatggcattttgctcttgttgctcaggctggagtgcaatggtgcgatcttgactcactgcaacctcagcctcccgagttcaagagattctcctgtctcagcctcccaagtagctgggattacttacaggcacgtggcaccacgcccagctaattttttgtatttttagtagagacggggtttcaccatgttgttcagtcaggctggtctcgaactcctgaccttaggttacccacctgcctcggcctcccaaagtgctgggattacaggcgtgaggcaccatgcccagccaattttcttaacagaggcctttgatagcagaagttattaattcactcgtttgatttatgaattatttttcttttatggatagtgctttcttgtgtcttgcgtaaagaaacctttgcttgcctaacccaaggtcagaaatatgttctcctatgttttattctgagagcctgtggcttagtttttatgtttgggtgtattatctgtctcaaattaatgtttctgttagtaatgtggagtaggaattgagattcatatcaccctccccgcttgttattctagcaccatttgttgaaaagacttcttttcctggacacctttgtcaaaaattaaatcactgtattataaatgttgatgtatttgttggttgatcacctgtttttaattgccatcctatcaatgttcactctttttatgtgatacagacacactttctgataaaataatgtgatagatttgccactattgcaaatgcctggaacgacggaatgggtgatagaggttggtctgtagttgacagtagatggagaatgattttgtagttgtctgtttttattatgtaaaatgaatcaggggatttatacctatttttctatgacagagaatagtttatttacactgtagtgaattgttctgtgaaagcctgaatgaactcagtcctaaaataacttttaggatatttttaaggaggaaagtctttgaaaaacatagttagcaacttttaacatttttatgcgtcacctttgttaatatgtcatttttagaaaattatcaatgtcattaaaatgttcaaatgtattatattggtgttggacatatattttcttttaaattttgttttctacgtatctgtgtaactttagcattgtgctatcatctcgaggggaaatccaggtgtatgtttgaatcccttcccaaatgtgtctctctaattccctgagcccactaaaatctctacttgtttccttttcccttagcagtggccttttgcctagggaaaaaatatggattttctaagttttgccatatgttaaaatcaggaaatgcccctagagaaaaactggctgtataaattcagttcactttttggcccttcccctgactgcacagcacttaacagaatgttttaaaatttgaagtttatcagcttttcccatttgttttcaacttatttatttttcttagttctaattttgttgttgtttgtttggtgactagggaatgtagttggtatgatttctaggaatttgctggttttttttttttagtggcctaatatatcatcagttataaacatttctgtgaatgtttttatgttatagttttgtcataggtaagagaggaatattaaaatgtttcagtgctattacattttgtcttttttctaatatattaaaattttagcacataaacatttattactcatttcttcattatgaattttattatcgaaatcagttgacaccattttttctttcagtttgcttaggcatattttatacagaaatattaatttcttttattttgcttttgtttactttgaattttgcttaatcgtattttgcttagaaatattaatataggtttgcataatatttaattttccttaaaaattttgcttaacatgtgcttctatatattttatcttttatacttttctttgttcttctttttgtattattggatagttcctcaaaatgccctatatttcacacatctgatttttagcatagcatatttttcagaaatttgagaatgtaaaacatatgctttctaaaatttaattagcacatttttttctttagtgtttctaagcagacttttgcttggggatgtataacacacactgaaacatacacaaatcataagtttgcaacttcagaatttatttatttttttgcatgtgaaggtccggttgttctatcaccacttgttgaaaagactattttcgtttcattgcttttgctgttttgtcaaagatcacttgactgtatttatgtggatctatttctgggttctattctgttccactgatccatttgtctgttcttttgccgatattatactgtcttgattactgtagctgtatagtaaattttgagtctggtagtgtcagttgttgctcttattcttctccttcaatattgtgctggctattttagatcgtttgcctctccatacaacctttaaaatcagtttgacaatatttagaacataactttctgggattttggttgggattgtgttgaatctgtagatcaaattgggaagactgacatcttgacaatattgagtcttcctatctatgaacatgtgctgtctctccatttatttagttcttctttggtttctttcgttggaattctgtagtttttctaatacagatttttatatgtagttgttatgttatccctaagtatttcatttttggagggtgctaatgtaaatgttattgtattttaaattttgaaattcacctggtatataggaaagtgattgatattttttctgtataccattgctggtatgtgggaaagtgattgagttttatatatttgtgtcctgaaacctggctataattgcttattagttccaggagtttttgtttattcttttcatactttctgcataggcaatcatatcatttgtgaaaaaagacaattttatttctaccttcccaatatttataccttttacttgtcttactttattagctagaacttcagtatgattttgaaaggagtgctgacagagaatatctttgtcctgttctgacattaatgagaaaatatttgattgttttttgattcttcctctcatattagccaaacatggagggctgggtaactggccaatgttttaaaattttgctttctttatttaatagtgtggaactgctagcctcagataagtcatccatcatcatcatcatcatatcatcatcatcagtaatatattgttaaaattagactttttcactgggtaattggtaggagcctataggttttcttgtgataagttcagtcctcagaaagcaccactcttgtggcatttcagggcttaaattcttaatactctttgcttggttttccaagtctaaaacactgttccacatatgattctgtacaatctcatatctagtcatattgcagtgctgagaattgtagttccagagaggcatgtgtggagatagggttttgagaatgttcgtgaaatgtttcacctacctagtaggtgaaataatttttgaaaggtgaaataaagatccgcagctgtagcaggtagatagaaatgcctctttcattgctggatgggagacatatattgtaagagagtgatcacgtttgatgtggagtacttttaaataataatttagcagctgtctgttggtagagattaatgaggtagagtggaagagaatgtcagtagagttgaaaatatttaggatcttggacactaggatgctgagtagattgtccacatgtatggtagcatacatgaagaagacaaggatgattcaagtactaaagtccttgttggtagtttgatgaattacatggaaaagttagggttaagattagagtagctggtggttatgatgccaaaggattaggactctttactcaaaagtaatgtagtgtcttggaaataacattgaatttctaggagaatgcagatcctactgtttggatggttgttttgtggcacatgtgtttattagctgcatgagctctttcagcacccctttcagaatttgccctttttcattctttttttcttggggctgtttaattcatgagccccgccttgcctttcctgttactgtatctgtgagtgtaacagactatttctacttgaaaccttcctcttaatgaccttctcttttctatagttcagttaggtgctaagacatcatttcaggaaaaatgactttatcttttatctaccaaaaaatatatttaagttttatataattttggggaatacttaatgttatgaagaatactattcttgacattaaataattttttctaggtctcatagatgttataataactgtatatttcaaaattaaattttctaataatttgctgtttattgaattatgaactgaaagaaagtaggttgaagatattaaaggactagtattattatttttattgaaactgtgatgtggatataattttacctatcagcaaacaaatatgtttaacagaagtctttttatttattatgacataaatgtatggtcacataaatggttttggctaactaaatatagctctgtatagaaaaaacataatgattaaattttgcagtcatttattgctgattttaagagaagttaattttattaaaactgttctcagtatgtatcacaaatttatttttctcttgttgattatggcttttgcagcacaattacaaaacattttaaactgggtttatcatactcgtaatgaattggtagttaatttcatagccttattttatcagtaactgtgcattcatctttagcctgacttgatttggttcctgatggacgaaataaacttttttctttttttctatgagtcggagtttcactctggttgcccagactggagtgcaatggcaggatcttggctcactgcaacctctgcctcccgggttcaagcgattcttctctcctgagtagctgggattacaggcatgtaccactatgcctggctaatttttgtatttttagtagagacggggtttcaccatgttggccaggctggtcttgaactcctgacctcgggtgatccacccgcttcagcctcccaaagtgctgggattacaggcatgagccaccgcgcccagcccaaagtaaacttaaattatgctcctggttaacccaatgtcttgagcttatgtttctaatatgctgactttcaaaaaatgatagtatatttggctgtatttttaggtgtttaagaatacttaggaacaattgcacataatgctcaacctgatggaaattacagatggttaaaagaaaataaactgttagatgttgactcatcttacatctgtatagaagaatgattttaaaatgatgtgaataggccgggcgcggtggctcacgcctgtaatcctagcactttgggaggccgagacgggcggatcacgaggtcaggagatcgagaccatcttggctaacacggtgaaaccccgtttctactaaaagtacaaaaaattagctgggcgtgttggcgggcgcctgtagtcccagctacttgggaggctgaggcaggagaatggcatgaacccgggaggcggagcttgcagtgagccgagatggcgccactgcactccaacctgggagacacagcgagactccgtctcaaaaaaaaaaaaaaaaaaaaaaaaaaaatgatgtgaatagacttggatggtgaaggcatgggataggttagttatcatttaggttcagaggttggcaaagtacgtgaaggaatagggttaaggttgctgattagtttgaggagacatgatatagttcagagtggtttattagttttctgatagttggagaatatgagtgtgtgtgtgtacacgtatgtgttgtgtgtatatttagtgtatttatatctacacctccccccactttttttttttttttttttttttttacttatttttttgtagagacaggatctgactttgttgcccaggctggtcttaaattcctggcttcaagcggtcctcacaccatggcctcccaaagcgtttggattacaggtgtaagccactgtgcctgggccacattttgggtaggatgaccagaaaaattaagctgtaaaagatccaaaaaatgtaccttttaaattccatctgtctgatatgtctgaagtgagataactgtacctacttagtccagatatatggtatgaagaggttctgaataccttgcatattcctttttgctgtctgagaagaaaggggtttaaatgaaaggcatgtatatatttaggattccttttacatacgctagaccagagtggtttttgctctagagtgtacaaggtgccaccgttgttcttcagtgtgtctctagagcttgcaacaagctaaaacttatcttttggtgcttcaggtctaaactgtattactggccagactttaaggattgagttcaaagttccagtgttgatttgtatgtgaatagttttaggtctccatattattgtttggaaataatgagaatctctcccccagcctgtgtgccccctgtgtccccatttcctccttagactgtgattacttccaggaaacaatgacattgaaattttaagtactcatatatctgggtcaccttttctaagttttggtgtattgtaaatcaatgctttctctagatataattagaataggttttattactgattctagggtgctcgcaaaggtttttttgaatgttattttcaaatggaagcttgaatgactcatagtttcatatacttgagaacaaaagagtaataaatttaaattggtggtgttattggtttaagtacattgcttttccaatacctaaaatatactttgcttagtcttacctctgatacctagtattttatgtcaaataccccattatgtgctatgggttttgtcccactcgttctgttcattcttttttctcattaaagaagtttttcatttcttcccccttttgtgtactttgcccttctttttgcgtgttcttagaattcttagtcttagcctagggactataagtgcacatatatgtccccatatactgtatacacatatgtgcacctcatgagaagattgtaactcactagactgaagtaggatggaatcttcctgggagataatgtacatatagaggcatggaagataactaatagaactttaattttgacattggagcctaatgacaataaaatgaatgaaagtcagtattctttaaaggtgttatgtcaaatcccagtgaaccatgtaattactttgctgcattaaattgttgataaatgcttaattttaagtacaggaaataaaatcaccgtaacagaggtatacatattttgctattttgttcacaatatatttcatacaacattctagatagaaatcttaggtcttatttttatatgattttgagctttctctttctgtcctagcttaaaattgatacaaagaatagggaaatgttatacttttttatattgtggaaagtaaagtttatttctgaaagtctcacttccattttcctgttactttattaggctgcagaacatgtttagtttacagctaaaatgccatttggtatcccagtgtgggttgtcctcatccggagacatcaatgtctattaaagtgaagctaaaggtctcatctgtgatggctaactgggtcactttactcattaacagagaaggcaactatcgcatcattctacagtctgtcacttccggaacagcttcttggcaataatgcctcacaggggaagtcataagctttcctgctgatgggtgtgactttgaggacagctgaaatggtatcaactagagaaatacagtgacaaaaacctattggaatacgtttaggccaaccgcatggtccttgcttcagataccagcctcaagtttgggggtccctagggcctcctttacttcagacttgctggctttagatactgaggtccccactgactccctcagatttgataattcactggtatgacccacaaaactcagagcactaagaattatagttttattataatgaaaggatacatactaaaaccagccaaaggagagacacgtgggcagaatctgggaggggctcaaaagcaaagcttctggttgtgctttcctggtggagtcatggatgctgttacctcttcctggctatgatgtatgacagtccagggaagttaatgcaagcttttggtgtccacagtttatactggattttgttcacatactgtccctgtgtctgacctttagtctttatctcctcccaaaagttcaggctaatacatttagtttctagtttctttggagatcagagctgacagggtattccaggaagctcccatcatgagtcacattgttagactctccagtgactccaggtactcttatcaaggaggatatcccctgggcctagagatcgtttcccagtagctgagggcaaaggccaggccctctctttggtaaagtgaattcctcaacacacctatttaaacagagggtatatttttgcaatttctcatattactctttatttgaaaatcttaaattttattttacaaataaatgattttcccttaatgttcaaattagaactatttagccttttccttttttttaaatctctctactttttctccctcatgacatccagactagtcatttatgcagtttagttgtatttttactgcattatgtatttatggccaaatatccattgtattcgtatattcatttcaaaagtacttactattcttctaaactgataggtcatgcttttctatccacaaaacaaatactcacttatatttcttgtcagctgcaatctggatacagagtatagcatgaacaaaggtttaatgatatcaaagtatataaatattttagaaaaggtgagcatttcattgtgatttgattatagacatattcaggagagttttcccaggaaaaaaagggctttaaaagctatactaaggcaacttggactatagacagtgaagggcattcaaatatttttagatatgaccatgacacacaacaaattgtttgttttagaaagtcagtgagtagcatagtgagtagaaatagtttgaagaaaggaaattcacctagaagcaactctatatgcccagttaggacgttattactgttgtcttcactggagatatatataggtaataaaggatgatttattaggaagttattaacttatgagagatgactttagcttttttttaaaatcttacccctttcataatacgtacacaagtctaatcaacttttaaacttctctaacagttttttatgttttcattttataaaacctcttgtgataatacagcctatgtatttttctacctaacctataacctatggttataacctagccttaccagcttatttttatagattcttgcactgtgttattcattttatatttatttaacacacatttgttaagtgagagcttactgtgcaccagattattgtaatagatgttgaaaatacaatgaatgtaagatgtgattcctgacctcaaaaagcatacatatcaatttagtagtcagacagatgggaaaagcttgtgatggagggaagcataggatactttgatagtttattgaaggagcatataacctagactagagtagagattaggagaagtttttgggactctgacactctagtttagaatagcagctaacaatatggactctggagccagaatgcatttggattctcagtttcttgctgtgtaaccttaggcaagttcttaacttcacctttaaaatgggaatcacaataatccctactgtatatggtaattatgaggctaaaaatgttaccgagcaaaagggcttgctgcctgatgtgctagaagccaatactatgacacttgagtttttgggaaaataaaagctttttattgcaagtcgactaacaagaggaaaggagtccagctcaaatctgtctctctgtgctgactttaaggcagtaatttcattagaaaaggtttagggagtgtgttcagggattggtaggttattggtggaaggagaggagaggtctggaaagtcctcaggcatgcacagctatttattcatactacctcatggatctcatgtgcaagtttcagggggagttagtatgcagcctgtggtggaaatttgatctgtgacaccggcaagttcgttctgtgcaaacgccagtaggccatatcggttccagttgatttcagccaggttttaaatctcataagtggagggagtttcagcgtttcagcaatttgtttctttttttaatttgccaccctgcaggctcaataatttctgccagtcactggtttctttaactctttagggcatagtttaaaaataagttaaaatatgtaaagtgttggaacagtacctggcatatattagtagttttgtatgtattacctccttctcttgctcttctcatcattttctaaaaatgaatatgtaattagtactcagtaaatatttgaataaatccttaaatgatagatgaaaatataattgctgttttgtttccttagaagtctttaagcatctctattgaaagcatttaaggtaaaaaaactattttatgtgtatttaggtccatattaactcataaattcatgagcttcataaagtgtaatctcatatgatatgtaaacaatgttgaatttgactgcttgtagatgaggatgtcttctccagttggtctcacgcgtccgtcttactgtataccctgtccagttcaggttatggcctggcacgtatagacatttgagtttggggtctccccactagaccctgccacctgctcttccaagatagacatggagtaaactcttttacatctcaaacacttaacacagtggttgtcacttattggtactaagtgaatgtttgttgaatgagtgaatgatgcctaaattatgaaataaaaaagaataattagaaatctgatgaaaagaacttttattgttccatgaggatgtggttgactacttctttgtggatctatgaagggattttggtaaaaataagactaacggcaaccaaaattaagagggtatattttctagagaaattttgtttgagattttctaacttgtcaaataggattcaccagaattattatgcctctttttaattgcaataatattggttaatgaaagagccaacaatagtattgcaaaagcgatttatattttgattagctaacttgaatgacatagttgtttaggcactattggtaaatagtggcaatcaagtcattcttttttaaaagaagataatgatgttggctttgtgatgagcaagaaggatgacttgtaggattattatttactgattagaaggacattcagagtacagaagcattgaataatcctaacctgaactagaagttagaatttgggattgaaaaccaataaagattagtatccaggggagtgcaaatttccatttttgggggggttttaaaactaaaccttggatttgtggggagttatgaaagcacataaaagagtcaagagatagaagttactatattgagtattctcaggcaatgagttgaggctttgtgggaatatctgctcagaagatgtctgagtagaatagaccagaactgaaaggtggaggtagtttattcttttttaagtattccattggtatattttccatactataatgaattgatattgccaattcgtatttctaataacattggagattgagtttcttcttcactgtagtcttaagctgtcattttgcttattatttttaaaaggctcctttctatgctttgtaactttgcagtttctattttatttctcatgtttctaatgtcaagccttttgcattatgtttctctgcttatgcatttataacaacttggttttcggttacatcatgattcatagacataaaacatcaactcagagtcaatcatatggtaacctttgtcagttcctccaatctttggtccatgctacatgccctctgtaggatatttcagatggtattcaaagataagattatgttcataagtaagcaaatttaagttttataggaaaaaccttatgaaaagtatcatgctttattaaaaattgatatataatgtctactgttttacttttcatccaattatcttcgaattttgtctggagggaaaattatcaagaaaattgtaattctgaaaaggattgtatcctagtttagggtgattgaccagatattccactttaaatttctccaagatttttcaattaaccatttctaaattaagattcttttatttgttagaagtgttttaaaaacatctagggtaatttaagtagaaccacgtttctgaagaaagattgacaaggagaaattgtaattatgtcatcacatttaaatgtttttactgtcaaattgaaattaaggtattatttaggcacattggccaaggcttatgttgttattgggtcctcatatcccattagcatgtcctaatgctggcttggtttctagcattggaaggcagtcaggaaatatctatctcatgaacactgcatgcaattgtatttttattgggatgttaatcaaccagtgaattatctatgaaaaacttagcttagtacttcttacattaggataccagtgcaactcatgaataagttttactttatatatagaaaaggagaaaaagaaacagtaggttattttttgaatgtaatatcagacacaaaagaatatcaaagtgagtttaaaattatatctgttatttaaattattaaataaaacctgacttttcaagtcgtgctattttaagcacattgagactctctttttgactttttgctaactcctttttttcatggagactgtgcctgacagactcttctctcaaaggctgcccatcatcgttgctgaatacacttcccaatgtttggtttgacttacaaccttggcctctcaatttctttgaaattttcatctcagcgacttaattttgaaatttggaaattcattcctacctattactcagtatgctaaatttggacatactgctttgatacaacttccatctttaaaggcagctgggacatttcatcagcttcaccatccagtgagctatggctgttccgtcttcagtgaagtccggtcttagccttaggaggggagaagttgtttttattgtgtacactatctcagcccaactggctattttttatatctgagattatgaaattctttacagttctccttactttcttaaagtggaagttgaggtcgttgatttgtaacctttttcttaattttttttattataaaaatgggtaaaaaatttttttttgcttttgttaggcgatatctaattctgttgcccaggttggagtgcagtggtgcaatcaggactcattgcagctgcaacctctggggctcaaatgatccttctgcctcagcctcctgagtagctgcgacttaggtgcatgccaccatgcctggctactttttaaattttttgtagagacagggtctcactatgttgcccaggctggtctcaatctcttggccttaagtgatcctcccacctcagcctcccaaagtgctgggattacaggtatgagccattgtgcctggtcattgatcttctttttaattaggtatttcatgcagcaaaattttctgtaaatatgctttagctgcatctctcaaacattaatctactctgtttttgttttcattctgtttaaaatactttaaaatttcccttttaatttcttcttttattcttgggttatttagaagtgtgttatttaattttcaaatattggatgactttccaaatattgacatctaatttaattcattatgatcagagaatatactttgaaatgtgttgtacgcatttaggaaaaaaaagcattttttcctggtttgggtggagtatttttataaatgtcaattaagtcaggttgttttatagtgatctacgcttccatatcctcactggctttctgtctgcttgtgttctgtaagtcttttcaagatgtctttactactagtgatttttttttctatttgtccagtcgtttgctcagagaagagtgttaaattctctatgtataattgaggatttccccactatttttcttatctattttgtcagttttattttgaagctttttttaaggtgtgtatacatttaagattgttacagactcctgatgaattgaccccctttgtcagtatgtattgttttcatctctagtaatttcttgttcagaagttctcattgtcttatattaatatagcctagatgcttcagcttttttccattagccctgaatttgacatctttttccatctctgtactttatacctaacggactctttatgtacaaagtgggctgttgtagacactattatatagttggttccttttttttttttaagagggatctcactctgtcactcaggctggaattcagtggcatgatcttggctcactgcaacctccgcttcccaggctcaagttatcctcccacagcagcttcccaagtagctgggactataggtgcatgccgccatggcctggctttgactatggttttgactttggttttgactatgataaacctacattttttaaaatattttttgtagagatggggttttgccatgttgcccaggctggtcttgaactcctgggctcaagctatctgcctgcttctgcccctcaaagtgctggcattacagacatacatccagctggttcttgatttcttaaaaaaatttattaataatgacaatctctgcttgttgattttgtaatgttgtggtttttagaagaaatatcattagaatgaaaacaatctggtttaaatctactatcatactacttgatttactacatggcttgccccatgttttctcatttacttttttccttttgtcttgccatcatttagattacttgagaatgttcttattccattatatctccactttttgggcctattagatatatatctttgtgtatattttagcagttgttctaaggtttatagtgtctgttttcacaatttacttttaaataatagtatgccacttcctagttggggttcttacctcatttccttttatacaatttgtttttacatatgttataaatcctacaatacattgttaatatttttactttaattagtcaattatattgtaagaaaagaaagaggaacacagatttcttatatttattctagtttttaaccattccaatgcccttcattatttcagtttagatacagattttattcttgtatcatattccttctacctgaaaattttcttttaaaatttcttatattctagcttggtggaaatatgttttatcagctattgtctgtctgaaaaagaactctactgtgcctttattattgaaagatattttcatttgctaaagatttttggattgacattgtttctattaatattagtatgttaaaggtgaggtttcattgtctcatggctggcgtaatttcagataaggagtctgctgtcaatcttatttttgttcctctgcctgtaatcttttcccccttcttgctgggttttgactatgataaacctacatttttttttttgtttttcttaaatctttcttcctgtcctcttggagtccattggggtgtgtgtttgtgtttatgtgtttaattaattttgtagcaattggaggcattatttctctcagttggtttctttgcttccttgtatctttctttttgttttcgcattccagctgtacaaatgttctgtctttggctgtagtctcccagctctttgattctcagcactgtttcttttttccctctttttttctttttgtatttcagttggaaaaagtgccacgtacgtttcttctttaagtttagtgacttttctcttctgtgtccagtctgtggataatctcattgattatcattcccactgattaacattctttttctctgatgttgtgtgtttttatttctgcattttcaattgtttcatttttattgtttccatctctgctgaaactccatatccgtttatgcatgttttccacttttttgtctagatcatttacaatgttatttttatttatttatttgttttatcaacttttaagttcagggtacatgtgcaggatgtgcaggtttgttacataagtaaacacatgctatggtggtttcctgcacagatcatgccgtcacccaggtattaattcagcatccattagctattcttcctaatgctctccctctccccatgccccccacaggtgcctggtgtgtgttgttcacccccatgtgtccatgtgttctcatcaatgaactcccacttataagtgaggacattcagtgttttgttttttcgttcctacgttagtttgccgaggataatggcttccagctccatccatgtccctgaaggatacgatcttgttcctttttgtggctgcatagtattccattgtgtatatgtatcatattttctttattcagtctatcattgatgggcatttaggttgattccattactttgctgttataaatagtgctgcaatgaatttacacatgcatatatctttataatagaatgatttatattccttgggtatatacccagtaatgggattgctgggtcaaatgatacttctgcctttaggtctctgaggaatcaccacactgtcttccacaatggttgaactaatttacactcccactcacagtgtaacagtgttcctttttcaggccgggtgcggtggcccacacctgtaatcccagcactttaggaggccgaggcaggcagatcacgaggtcaggagattgagaccatcctggctaacatggtgaaaccccctctctactaaaaagacaaaaattagccaggtgtggtggtgcgcgcctgtaatctagctacttaggaggccgaggcaggagaatctcttgaacccgggaagcagaggttgcagtgagccgagactgtgccactgcactccagcctgggcgacagagtgagactccatctcaaaaaaaaaaaaaaaaagcgtgttcctttttctcgacaacgttgccagcatctgttgttttttgtaaatgttatttttaaagtctttgataattccaaaatatagaccctctctttgtctgcttctgttgactgccttatctttgaatataggccatttatttttcctttgtgtatgtgtgtgtgtgagacagaatttttaaattagacgtctttcgtggatttttctttcctatatgaacaaaagagactgaggtaagtatctttatgcttggtaacaggcatacttcttttagtttgttaataggcttcatttgtgggtggggaggggtagtggttgaatcagcctgttctatgtgttgctatataattacatcttcagtgctccaaagaatttatattttctcagcagttggctgctgttacttgtatttattgtaatgcctagagtataaaagggttttctcctggtgtttctgtttcacgtttagctttcagtaggctctgctcccctgtaccacagagtgttctattttcatacttctagtacttttccccatatgtaaacaactgtttcttgccgctcagtgccagacttgtgaagactgtggagttttcttagtttttcttctccagccttagtattaagcagaacctgagcacctgaatcgcaggcatggggttttcctcagtgggtcttccctctccctcttgccagtgaagttttgccttgcatagggatattttgtcaggaccaagtctttctgctttttatcaatataatatcattggtccaagtctgtctccagcttcttgtatagctgcatatggatttattcccaggtaacttttgcatcatatcaagaagggtttggaaagcaggagggttttaacgtctgtgcccaaccaaggtgggggcattctcatgtttcctgccctgcctgtggtctttcttgtgaagcctgatagaagcctgagaaaaagtttgtatctcttgtgttttgggcttccagggattctaaactgttccactcgcccagacttagtttttaagaattggtcagttgttgttttctttgtactcacttatggctgccacttcctcttccttttctctaccaaagaagacatgagttcatatacttcaccctcctttggaggggctgggattcagtttatttggttgcctgcagatgtcagctttctgatggccataacaaaagttattatttgatagattatctgcttttttattatcatcagtgtagaagcagcattctcttactatttttcacatcgtaaatgaatgaggaactttttcttaaaccaaccttttaaaggtatcttcaaagagcaaagcacttctaagattatgaacatagatctatggaatgaatgaggggaaaaagcattttcttaacattagtcaaccagtacttgtagcttgggataacatctgcagttataatctcatgtatgatttgaagaatgctgtaaatcagagacagcagcaggaaaaataatggaaactggctaaatgacttaaaagttggctctaatgatgaagatactgatatatggaagatggccgtaacaagtttggatactttttttttttaagaattgtaaataaacaaaagctaatatttctaatttaataaacacattacatatatgatctcatatgaatatataaatcagttaatataaagtatacaatattaataacatttttagattacatctctattcttagaaaaccttttttccttcaagaattttatctcccttcatattcactttattcatatagtatattctataatgcatttaaagtctataaaatttttgttaaatatacaaatggggtcttgctgtgttggccaggttggtcttgaactcctggcctcaggcagtcccctgcctcagcctcccaaagtgccagaattacaggtgtgagccactgtgtctggccaagtctataaaatttaagtggctattggaggacctatatatttaggaacttgcagaaatctttggggcatttgtttcagagagtcataagactttatttagttatctctttatttttagttaaagtctgatgtaatctgttctgagtgattttactttactctctgaattaaagctagttgcttatgtctgatgacctcagtttccttttctggcaaattgagtaataattcaaaacttgagaatacacatctcatgaggagttatgtattttgaatgatatgttaagtaccaagcacaacactccattgtaggtctttgatacatgataggtgatatcataaatattatgtgtcaagtaaagaaaaaaatattgtctagagtaatgcagaggaactcttattttgacccatgaattttcagtcctttaaatactctgatttataaaaagagtagaataaaaaatgaaattactttcatttctgcagcaggtagaatcatgttatgtagagtcttgctaactggctattttttattgttactttacatacaggcatggtccattacatgaatttgagaagtttggttgaagaatggaaactaccatgttaacttgccataaatgatgtacctacaatacaagtagagcaaatgaaagattaaaggttacatttttttaaccttttttttttttttgaaaaaagagattattgtggtatttggtttttattgcatcattgctcagcagaaatgctatgaatttagttttttttttttttttttgagatggagtctcactctgttgcccaggctggagtgcagtggcacaatcttggctcactgcaacctccacctcctgggttcaggtgattctcctgcctcggccttgtgagtagtagctgggactacaggcgcgcgccaccacaccggttaatttttgtattttttagtagagatggtgtttcaccatattggacaggctggtcttgaactcctgacctcatgatctgcccgcctcagcctcccaaattgctgggattacaggtgtgagccaccatgcccagccaactttttcatctttcaaaactgaaactcattaaagactaccccccaagcctctggcaattactgatctaatttctatctcagtgtcagaaaggaacattaaaattttaaggaaatatagatttttaaactcaaatttgaactgccctcagtttagagaaattatagattttgaaggatgaaatggcagagaagatgaagtcacagtttgggaagagaatcacagatttttgttgcaagtgaaatacgtacttgaagttttggttgttgcttttggaaagcaaatcttgtaaactctttaagcatagtgctttcaagagtgtgtgattgtgataaaagggatgtataacacacagcatatccaaaaatttagaagacatatttgaatcctagaactatcctgaattttctgttaattggccagagtctagataacctggtgttgtgggagggacctggtgggaagtaattgattcgtgggggctatttccccccatgctgttctcatgatagtgagttcttatgtgatctgatgcttttataaggggcttccccctttgcttgacactcattctcttgcctgctgccatgtaagaccatgcctttgctcctccttcaccttctgccatgactgtgaggccaccccagccatgtggaacagcaagtccattaaactgctttttctttataaattacccagtctcgggtatgtctttattagcaagtgtgaaaatgaactaatgcacctagctctgtgaaagtatgttttgttctcttccccaaaatgcagaaattcatgtttcaggcctccatcagtgatatacatgttgagttcttcaaaataataaaaatctgtgaaagagatacattaaaactacgtaatcagtcagaattaattagagggtatagggtctataactctgttgatatggcattgaaaaaactgttagttgtatttttcacggtgtattctttgcaatgaaattctctgcttggaaaaatataaaaaagacacaaaaaaaccccaaagtaagattaaaaacattctctaagggttcttggaaaacacagtgtatttatggattataatctccatgtttgagctggtttgtggttacaaattcttgcccccaagcaagtttgtttgtagctttggactataatcttcatgtttgagctagtttgtagttacaaattcttgtccccaagtatttctttgcttctcctgtttttgtgtgtgtttattttttattccttttatctattactttccagagtttctactttcactttgtttttgcttctatgtctttcttccttttgtgctggcttaggaatacatttaaaaatatgttttcagtgctttattcattattttggttgttgtagttaggactattgtttagaatatctagcctgccaaggaatggaaatttgtgtgtgtgtgtgtgtgtgtgtgtgtgtgtgtgtgtctgtgtgtgtgtattcaaatcttacgatgtattaacttagattcctttagacctatccctttctcttattttgtatttcagttcttataacttatatattaagaagtttttataaagcttagcaagaagtttaaatacttttaaagtgattattatatttttaaagaatacatgtgtatttattttatagctacttgaaggaaattttgccaaagaagtgagccatgaaatggatggacttatttttcagcctactggagtaagttcatttgtctgtgtgtgtgtgttcgtttgtgtgtttgtgtgtgtgtgtacacagatatacatatacatacacatacacatgtatgcctcaaacttatttacttgggattgattactgctgtgattgccacttttccttaaaacaaattgctcattatgaaagattttatttatatctaaatacatgtaatactaaaatgagcacccatctgtttttcactcagcttaagaaataagcatttttggtcgttacatttcaaagaaaccagtcttttaatataattagttattaaaaaataattttctaccaatagcattacataaatgtttatttccttttgtaacttggtatacttttatgtattaatctctctaaaacttcattttgctgtagtttactgtagagtaaaattcatactttgtcactacttgagaaagaataaaacttttgaatattttttccatgttaaatttttgaaatgcactgaagaacttttaccaacttaatggtcgaatcatatatttgaagtaagttgtattttactctatagcaggttttctcattctcaaccactgatgtgttgggccagataattctttgctgtgggagctgtcttgtgcatggtaggatgtttagcagcatctgtggtctctactcactagatgccaggagtatagatgccaggagcatgctccctattcccatttgtgacaaccaaaaatatagtctgacattgcccagtttcctcagagaacataattggccctacttgataacccatgttctgtaggacggtgtttttcaaaatgtggcctgtagaggaggattagcaccacccaggaagtttcacagatgcagctcagccccacacctattgagtagaaactctggggatggagtttagcggtttgtgttttgacaagttctccaagtgattctaatgcatgttcaagtatgagagctacttactctataggaaagagtttatttcatgtgcaaccacctcatcatatgctgctttttttcttcaccaactcttcttttagtaattagagtataagctagttgagaatttatatatggagacatcagactgggtgcctggggtcaaagaaagggaactaataatttgaacacagtgtattaaatactgtacaggttgagtatctctaattcaaagactgatatgctataaaatttataatgttttgagcaccagcatgatgctcaaaggaaatgctcgttggagcattttggatttttgtattagggatgctcaactgttaagtatatataatgcagatattccccaatctgaaaaaaatcagaatccaaaccacttctggtcctaagcatttcagagaaggcatattcaacctatgcatgtaaagcattatatctttacgtgtgtaataaatctctgctaaaatgcaaatttagagacaatgtgatatgtgattggcatctgtctgtcttctagccccccttgccaaacaaagaacagaaatatcttctgtggttaagggaggaggagagggaggaggacatggaggagcactagaggttagggacggaaatggaagaaaatactattttaggaaaattaaagttgaatcttttagttctaatatattccagtctccctagactgaaagaagcaaagtctaaatataacaataaattcagaaaatttcagtgtgtgaaactcatggttcagatctgtacatatatggcatatgtaggaaaaatggcctgacaaataagtgagtctctttcttggatgtctagtataggcagttgatttgtcattccgttccctttctagtaaccatactttttttttttttttttttttttgagatggagttttgctcttgttgcccaagctgaagtgcaatggcgcaatgttggctcactgcaacctctgccttctgggctcaagggattctcctgcctcagcctcctgagtagctgggattgcaggtgcgcaccaccatgcccggctaattttttgtatttttagtagaaacggagtttcaccatgttagccaggctggtattgaactcctgatctcaggtgatccgcctaccttggcctcccaaagtgctgggattacaggtgtgagccaccgcgccgggccgtaaccacactttttattacaatgactttgtaattgatatctggtattaagtcaagtctccctgttcgccagcattaccttaaatatttgttgacaattggtttaacgtgaaagtttcagaatcaatttgtcatgctacccagaaatttttgttaggagtttaattggaacatctttgaatttagattaacgtggagaaaattgatgtgtttgcaatgttaaatcactttctcaatgaatgctatggcttttttttttcaggtctttttctgttctgtaactgagtttaagttttttattattgttatggtaacttctaaatatttgtcattttctgcttttgtggtaaattgtgtctttttttattgctacttctagtacactgccacattattgatttattttattgattcaacaatcctgttgaattctgttagttctcatcattgtctaattttacacattgaccaggacctctagtattgaattaagtattagttctagttagataagggagaagacatttataccttcttctcaacctcaaagggaatgtaactaaattttctccattaagtatgtttgtggtagatttctgttagatatcctttattgtgttaagaaatttctgattctgttcttccaataattctttttaaaatcataaacaggttttgggctttaacaccttttaaagcattaattttaaggcagtaatgcctcttcggtatctactaaggttatcatgtcattttcatttttacaccatttatgtagtaaattacactgatttttctcatgttgacccatccttgcattcctgggataaatgctacttgatcatgatatatataattttttaagcatacttttggatctaggtataattgcttcttgaggatttctgccaccttatttcttacagttcatttttctctctttttttttttttgagacagggtctcactttgttgcccaggctggtgtgcagtggcacaaacatggcttactgcagcctcgacctcctgggttcaagcaatcctcgcacttcaggtccccaagtagctgggactataggcgcgcaccaccacgccttgctaatttttgtatttttcgtagatacggggttttgccttgttgccgaggctggtctaaagctcctgagctcaagcaatccgcctgcctcagcctcgcaaagtgctgggattacaggtatgagccactgtacccggccaatttttctcattttttatattcagaataatgaaggtaatattttttattgttgaaaaaattatgtaagttgcacataatccatggtaatgcctatccatgatttaaaaaaaccaattaaatgagtgatttgtgctgaaaaatagaacagtctcttaccaaacagtctcttacctttttctgcactctgagtactactcctaggaggcaattattttcctcttttttttttttttttttttggcttttgcttctacagttctacacagtctatgctgttcttttttggttttgtattttatacataatctgcttactttgtactgtggaagaataggattgagccctctaattccactaaccccctccacacccctttctccttctgtcattctattgtaattacatcacatatttggtcaaattaatattcaatttttatatttttatggtgacataaatattgttcctatctgggtcaaatagtatacaattgtattttctttttttagaaaagtcttgtcatctagcattaggaatatttttggttattataattattaatatttctttctttaaactctccaaaagaactgtttactttttatcaatgcagtcaaatatataaggtccatttttcatttgaaggcattctttctgaagccttccattctttagtcctgctgcatagccttttcttcttagagtttcttttcactatttcatccaggaaatcccttttacctttcttctctgatagatttccctacttttttgactttatcttttctgcttttttgatttgagtgatcttgaaaacctaatgctgtacaaactggtccttatacttatggagcttttgtttcagctgtaaactgaacatgttattttcagtggtctctaatctgttctacaattttatggctctgacttagccccaaattttttattgtgtttgtgtagttctgtgcaacttggtataatcttgattatctcgtaataaatcaagcctccctgtttgccaggacgttcttaaatatttgcagacattttgtttaacacgtaagtttcagaatctgtatgtcatgttacccagcaatttttattaggagtttaattggagtgcctttgaatttagattaatttggagaaaattaatgtgtttgcaatattaaatcatcttcttatatatactagagaattagggaaaaggtgcaataaaccgtagctcaggactacctgtctaaatgtcagaaatttccagaagttttagatctactcttagtttacatattcaattttgtatttttaaaaactttatctcgtaagttataactgatagcaatattagacaatagaactaaaaaggagagagtagttgtactcaaattctgtatttgtaataagcttcctaagacactggctttctcagcctcttccaccttttggatggctgtctttatacttgtcttctaaggtagttctatccccctttccttctcttcatagagaaaagtgtattttttatggctatagctgttttggttaaatcaacctttaacccatgccttttgttttgcttctagtactctatttcttcgttcatattatacatttctactagggacaaccaatcttcaaacaatcagtgaagtctgttaagtggctcatcactttgtctttttgggttgtccttgctatttattccttatttaaaaaagaccatgtcagatttggctcaaattgttttatactcagcctatttcagtagcttcttaactgctctttgtatctgtattatctttccagtctacccctgttttttgacctagtaaaattatactatggaagaaacccttatatgggggagaccagtactgactgatagaaatataacatgtaacacaaatatgatccacatatatactttaaatgtttctagttgccacattaagaaaaaaagtggtaaaattaattttaataatatattttacttaaacgactatatcaaaagtattatcatttcaacatttactcaatataaaaacaattattatttttgtactgagtatttgaaatccagtgggaattttacacttacagcatgtcttggacttgccactgttcaagtgctcagtggccatgtgtgtaagtagatagtgcaggtatagatatattgatttattgtttcccatttcttgtatgtgctcatggcatttgtacatgattcatttgtgatcttcagttgaattgtaattctctgtgtaatgatagatttttcttctccagcttgcagaacaaaataagattacatttctttattcaaatgcaataggcaggctcctacactccttccccttccaaatcatagtgcattgcagtattgcgagggtccctttttttatttttatgttcttcccttttaaaattgtgctttgagttgtttatttcttgttttttgtttgtttgtttgctttttttggtggtggtttttaaaaaattatacttttaagttctgggattcatgtgcggaacatgcaggtttgttacataggtatacacgtgccatggtggtttcctgcactcatcaacccgtcatctacattcagtatttctcctaatgctatcccttccctagcccccaaccccccacaacatgccccagtgtgtgatgttccctccctgtgtccatattctcattgttcagctcccacttataagtgagaacatgtggtgtttggttttctgttcctgtgttatgtgcttcgagttattaaacgtgttctattcaaggggtcttgattccggacttcagtttctgtaacggtgaaatgctactgagtttgtagatggaaaccattttttgtgcatttactgccttcagccctctatgttgatagtgttgaagagaggtgtttttaagctacacctgttagtctgatggtagtattttagggtataaagagttgaaaagatagttgctaggtttctttcgtatcaccttagtcatgaatatttaatcttaaacctctttaaacaaaattgacacatacatatttgcattaaataactattcctctatcatcacttttatagcagcttggtcagaagtgatacacctttgtctagaattagatctttccttccatgacagcctaggtcctgatcatcaacctgtaccttctacttctctgatatggagatttttcagttctctggtagcagctgttctcattctgaggccaccagtctaagagagatgagatcttagattcctgtgcacactctgtgtcttcattgctctccattccataggatttgtgggagattgatttgctttcatgaagctgaaagcaatatctttttctatcttttctcttgaaaaattgttactaattgccaaattgcttcagaactaaaactgattgcttaaatgattattctcaaagcaaaaatggttctctttaaagatgcctttctgtttctagctacccctcacaagctctcttttggttatatttttgcctcacaaaatctatgggctgtggttatatttttgcctcacaaaaatctatgggctgtggttatatttttgccttgcaaaataatctgaggttattagtcctttccttccttatttctttttaaacctccattgtctaggatagcgtttagcccagtatgtcttagaaactgtttgttaaaggaatgaaaatgcatctttgtgttttccccagtctttcagatttgactagttttttatgttatcaatgtaggtaaataccttttaaatttataggtattttattttccttgctgcataggaatatgtgtaatctaatttatgctgttatcttttttcctttcaaaaaacttatcagtggctttctttaaattctcacttttctttgccaagtccagaatccaaacaccattcttccctaaaacaataacatgagttttgtcctctgcatattctcttcagaaacttcccagtgggttaggagtggtctctggttaaacaaacaaacaaacagacaccactgaatatctttttgattctccagtttttcatctgtaaaatgtagaggctgtaagagcttagctttgaaattctcttatggtcatatgatgatcagtgcaaatgatataaatcagtacttgaaaattctttctgccaataacctggtgaaaatttactaagtaatgaatttttaataaaagaagaaactcttttattttagtttcctaaaaataatttatgttttaaatggcaagttagacaattaaaataaactagacttcttatgaagtttgatagtatgactattacatgactgtattctattgatttttttctcctgccatgatttctttttttggtgggggagacagagtctttctctgtcgcccaggctggaatgcagtggcgcagacttggctcactgcaacccatggttcccaggttcaagtgattctttagtagaaatggcattttaccttgttggccaggctagtcttgaactcctggcctcaagtgatttgcccacctcggcctcccaaagtgctgggattataggcatgagccaccacacctggccatcctaccatcatttcaatagacttttcacttttatatcttttatctcctaagttgttaagattataaaatatatggaatgtctctgaaagggtcacattttgttcatcagtggacatggtcagcttcttccaaaagtattaatttatttttattagaacagatttattttatttataacagattctagattagtttacatttataacttatttcagaaaacatgttttacaactacctattttggtaacagtttaattgatggcatagcactgtactatactagttataagtatctagttcatcattttcattttctatgaaattttaatgatttcagtctttgtttcttaatgttttatttctgattgtaatttctcatgatcgttttctgtctagttttttatttcttaaaagcacatgttaccaactttaattctcttagtttttatcactaatatgtacctttcatcatatttttgatgtgctctttaattggatggttaatttctaaaacagcatctggctgtaagaaggatgtggtacataatcacatgtctacccatcctagttaattcagtggttattttacattcctactattttttttggtaaatattctaaagggtattctaagtataaatatatattaacggtgccatccagaataggctccagttttgcataaatccattcgggtagcaggaggcaattttctctctcaaatgcaaaatttcattatattgaattgtgtagcctttgttattttttccttattttggttttgcaatttcaacctccgattctcctgcaaaggctgattttttcctatttttagtttatcctcagtttaggccaccatcaccagagtggtcttatgtattccactttcagacttttgatttgccaaagccccagattaaacctgtacttagctcttatgcagagatttatgacttttctacctctttaaaaaaatggaaatatgtttctattaaaataaagttgaatgacattatcagacactatatgatattctgctaaagaaagcagagtttaagacacatttttctaataattcttactcataaattctctttatgactttaaaagaaagaatacttaagatttttctcacttcttttgtgcttatacattgtcatcaatttcctttttaccagttcaaatagcctttttctgattgctgtttgtatattcaaaggaaccaccttaattttccttttcacctgcactaggtcttatttgtaaggaggaagtaagaagagagttgattatagacagatgtggcttccagtggtgagaggagacatgattttaggtggtccagggacagggcatcagatgacactgcatcatacaatgagaaatgtagtcccattcttgtttttattcagtctttcagattataaggagaaagtctatttctagtttttaatatctaaaacttgctgatcttttcaacaagtgtgtgggcccacttttagactattcaataggcaacatatctactagaatttagtatcattgattaatttctgtcttttctaattttaggactactggttatttaaggtaagcaataccgttttctcgaatagtatcaatggtgtaccatttgttataaagtttccatttaaaatatatattttttagatttttagagtgaactattttaaagaaaaatataataatagttatggtattttgatgtgacagaaatcctgggccgagcatggtggctcccgcctgtaatcgcagcactttgggaggccaaggcgggcggatcacgaggtcaggagatcgagaccatcctggctaacgtggtgaaaccctgtctctactaaaaatacaaaaaattagccgggtgtggtggtgggcgcctgtggtcccagctactcaggaggctgaggcaggagaatggcgttaacccaggaggcggagcttgcagtgagccgagattgtgccactgcactccagcctgggcgtcagagccagactctgtctcaaaaaaaaataaataaataaaataaaatttagaaaacgtgatggtactagctagttactgtattagtttcctatggctactttaacacattaccacacacttgatggcttaaaacaacatacatttattcccttacagatctggaggtcccagcaatttgggaggccgaggtgggcggatcacttgagcccaggagtctgagataagcctgggcagcacagtgagaccccatctctataaagaatgaaaaaaattagccaggcatggtggcacacacctgtagtacttgggaggctgaggtaggaggattgcttgagcctgggaggtcaaggctgtaatgaactgtgatcgtggcactgcactcaggccttggtgacaattgttttttaaaaaaaattgaaaaaaaaaaaaaaaaaggtacttgtgattgcatttagggttcatctgggtaattcagaataatctcccctgcccttgaatggccttaatttaatcataccaccaaagtctcttttgccatataatgtaacgcattcctgatatctctaggtcgccatttttcagcccaccaaagttatagcttaataagacgtttccgatggatagctgtagaccttaatacccagtgtaatttctgattctgtctttgtaaaatttgtaaattacctttctttcttagacttcctattaagagcaagttctaaatgagaagtttaggacccttaatcaggccaagaactttttaagtaaaatttgccaacatttcaaaatttttcttctggggaagtctaaaactttctgatgaactcagctttaataattaagtgcagggcaagtaatacattgttatgagaaaagtaatatagtatattagaggtaatctgcattttaaaaataatgtcaaaatgtgtataaatttttcttttatttttaaattggaggatatacaaattttataacgtgtagttattttccctgaaaatcttttaacctgtctggaggtcaatccttcagtcttttgcctgctcttactattcttggagtagagaaggtaaaggagctagggtccactcttgggtaaactttcacttaaccttgcagtttcagtttttctcttctgttttgaatcttctccaccatagctctgccttcagctttttcacagaataaacatatctcctgccttttgcccgcagtggaggagagaagctagaggtttagtggtccttctatagactttccctggtctccttgttttatgtcctatgccttacctttatcccctggcagccttctaggttacctgttatttatatgactcaatcctttctggggcactgcaccaggaatgacttgcattggcgtccttctttgcatgtacttagtatttggttttctttgctgtatgctgtgttaacttctgtactttctatcttttaaaattacattgctatgggtttttttctgctattgtcagtctcctatttttgttttccctttctgttgatacctcttgttttctgtaactctcacctttagtgaggttttatatcaaagcgggcataaatacatgtttagtctaccatttatcctaaaatctttgaaactttttatagtgtggtgttgcatctattggttcctattagccaacaattcaagtaaatcaagaaagggatagttgagtgaaagggtgagtgtatataaagtggagaacaagtcctgatgaagcacaggcaaagcctgttatccatcctctggtaccacagaaatattccaaaggcaaatgaatggcaaaagatgatgaggattactagtggatctacttgtgaaaaaactccttggcccaactgtgtttggtgctagttacttaaaacttagcaagaagtttattctgctgtgttacattaattataatgagtgaattgaggttgaataaagggtagaagatgttagtactgttgaaaaaagaagatatatctatagatatctacatatttgagacagagtcttgctttgtcgcccaggctgtagtgcagtggtgcaatctcggctcactgcaacctccgcctcccgggttcaaatgattctcctgcctcagcctcctgagtagctgggactacaggcacaccccaccatgcccagctaatttttgtagttttagtagatacggggtttcaccatgttggccaggatagtctccatctcctgacctcgttatccactggccttggcctcccaaaatgctgagattacaggcgtgagtgtaattaacacacccggcctaattttttgtatttttagtagcgatggggtttccccatgttggccaggctggtcttgagctcctggcctcaggtgatccacccgcctcagcctcctaaagtgctgggattacaggtgtaagtcaccgtgcccggccaagaaagaagatactttgaatcctagcaagttattgaagaatagtgataaaaaatactatattaagatgatgattctattgagaacaaactcccaaaaaccagcttaggagaaagttttattgtttagcttttgatttaatattctactttcagagacataaccatgtaacacattcataattggacatagtttacttattacttttataagaaggaaaagttaatcagtggtttaatcaaggaaataaaacttaggatatttgtgtttataaagaagtacactaatatcttattttgagtaagacacagagcagtcattaatcatcatgaaagcctggattcaaacaaagtagattaccttgcatttacagaattatagaacatcagaggttatctagttcactcactggtttcaaaaatataaactccaatgttctaggtttctgtgaagtgccttaggtgactgcatggagggataggttactaggtcagcattctgtttccattgcagtgctgctgatttactaatattacttttatatattgtgcttgtagatgagattatgttttaaaaagggctttagctgctaagtaaatgatgttcgaatcaactgcttttttgaaaggtcgccagtcatctcctttaattaaaaaatcaagataattttcacccttttttactggatcatttagcattagtctatattctgttcactctttcttgaaatactttcttttatggcatctgtgacaccacatgctcctgattcctcctagtcttttgccattctttgcggtccctttcgagctcttccgtcttctaccagccattgaagtttggtgtttctcggggctcagtgcaccagatttcattctttctcatgccctactctttctagtagtctcatccatacctatgaatttagttcatttttatcagcatgttactcagacttcagatttctatgtaagccccaaatttggttatctttttgcccactctgatactgccttttgaatttctcaaaaacatcagaaacacaatacagacagttcccagcttatgatggtttgacttatgatttttctgtggatagtaatgccgttgtaagttgagaagcatctgcatatcaaagacaaactctatctctatttctgaaatgatcaaataagcagacatacaaactggttcttttccagcatttccacctcagttactaaatgcagttacttaaatcagaaatctagctgtcatctttggcactgtccccttccttcatctccaagtctttctttatcttttaagtatctcttaaattattcccttttttctccattgtcactgctactactctaatccagtttgtcattcattgcctcttgctggaaccactacagtggcatcctaaccagtcttacagcatccattcttgcctccctccaatcttttcttcactccttttttttttttgtttttgaaatgaagtttcactcttgttgcccaggctggagtgcagtgacgcgatctgggctcactgcaacctcagcctcctgggttcaagcaattctccagcctcagcctcctgagtagctgggaatgcaggcccgcaccaccacacccagctaatttttgtatttttagtagagacggggtttcaccatgttggccaggatggtctggatctcttgaccttgtgatccgcccacctcggcctcccaaagtgctgggattacaggcatgagccaccacgcctggcccaatcttttcttctctccatatcgagtgatcttccttaatctctagtgctttctccttgttctcaggttaaccaacatttctcaggaaaccaacattagatttggagccagtttacttttttctttatcatattttgccttttggtttccctgtgtgttttgctgttgattcaaaaataactttaatgttttttatttaaaggtggcttaattatattattcacaaacagtgatataaacaataatataaacagtcaattagtcagtttggggtgctgtaacaaaataccataaaccgagtggcttataaacaacagaaatttatttctcacagttctagaagctgggaagtccaagatcaaggtgttggcagattcggtgtgtggtgaaggcctgcttcttggcttatgttgtgtcccacatggcagaaggggcaagggagctttcctgggtctcttttctaagggtaggagtctcattcatgaaggcagagtcctcttgacttaatcacctcccaaaggtcccacctcctaataccatcacattaggggcttaggatttaaacataggagttttggaagggacacaaacatcagtctgtagcacagtgttttaaaaaaatttgaaatgtaacctatacttgacaaaaatacttaaatatttgagaaaaactttggtattttcttcaaaaggaaaaaattatctgtttgttttcagtataaacctattttctaaggtttaaggttcaagctttcctcaaacagaaatgatcatttttaaaaagaaccactatcaaattgaattttccatctcattatcagcttctgtaataaactatgttttattagactcctatctatatggttttcagttctgtgattacacttccattttgaattgctaatttttggccattcgtcacttaaaaatgaatattttaacgtgatgatttggtattttaatatgcaggtattcaatcttttacatgatagctattagattgtttaatttacaaagttggtagtaaaatgaaatcttatttgtttactagcttttataagttgattttagtgtagatttatgtagcatattacagttttacatgtggaaataacattaatttttaaccttttgaaaaatcagctttgattttacttttatcatctggagaaactatgtttctagacaagaattgtatgccattaatctatcactatgaaataaaaacagaatagtggattgtataattgaagtaagaataaaaatcttgaaaatatttttgttttatatttagaaaaatggcttttcttgttgtacccactaactctactatggttagtaaaacataattgtttctattgagtctagagttatttactttcaagtagtagagatataattgttttttaatgttttcatcactattttgattttcctataaggtggttcagcttgattttatgtatctggtattcatcagtttgcatagaaatttagagtcagctttgattttaatattgcattcttttgaaatattaatatttttattaaatctttactactgccaggtatattgaatgttatggatagattgtaaaatgaaaattggaattagcctaatgccttgtcttgaagtacatgacaaattagaatggttttcctctgtagcaaggatgttaccatggtgagagcttctgtttccatgacatttgcttgcatattttgataggtcttcatttgaagaagggctctgttttctggcaggctgcaaaagtgtcattctatcttttctcaaaatgtgttacttttattgaaaaatataattttccaaggaattgtaatagcaaagtgccaagaaagaaaatataccttattttatttttttttccttgttcatcttttagagcacagcaaaatattcttagcttgctttgtgtaaggaagaaaaagcaaaacatcattttcaagtttttaaaataaatatttacttttttttgaattttgttggcaaaataaacagctacagatgcataatttgtaatcagtctcagctagatatagatatatctgtacaactaaaaggaattgctaatgatgatatattggtagcagagaaaggggaaataaatataaataaggacttcacaaaaatgaaagaagcggtgaattcctagagggtaaatatacagaataccaaatcagttctcatataaatgatacatattaaacacttaatgaattagggatagttctttttattaataacttatgtttaatgttgaaacattaatggtagatttttaaaattgtcattttacagtggtataattttaatttttaaaccagataatacaatcacgtggttcagaaattttaacatgtatttaaaaaatacatagaagaaaatttccctctcatacttcttcccagtttctttatatatatagaagcaaatacaaatgtgtgaatacattcttattttcattccacttttttaaaaagatagcatattattttacactttgcttttcagaatttgtccgggtatatttttaatgtctattttgttagcgctctgatttaggcatctagggagacatattggaatcatagcaaaaagatagggtttattaattgatatttcttatcccttatgcttatagcaattccacattttagaaggaaatatttaaaagcacacattttgtctatgtagggtcagaaaattgattttccttttgttgtccaagttcagtgataactttagtagctctttctactgacagaccaattcattctgtaagagctacaaactgaaatagtctctaaagaatatgtatttatacatgctatttcttctgcctgaaactattttcttttctatattactcccatttatccttcaactatcaagttagatgtgcttccttgaggaagcctggttgtataggtgagcatgactctcccctgtgcctccacagtattcccattggcctcaaagcacttaacgtgtattaatttttagttatttaaacattaccatttctcttactagattgtaagtaccatgaagacagagaccatctctgtctcattcacagtgatatttttagtgcttgtagcagtagggtgaatattaagtactgtgctgtacgtgtgggcaatctgaatgtctgctgctcagattcactgtactttctcttgtagctacttaactcatccttattgcctgtataattctcagcttaaattttacttcccctgggaaatttgtttttatctttttgactgtgttacatttcattttctcagctattatagcactctgaacttcatctttcattaaattcttcacagttttttgtaactgcttattatttgtctgaaacccccattatctttatcttactgtcctctagcacagaggttgacacaggcttagcagttgatcaataggtactggtttaaaaaaaaagaatgaatgcatactttagatcagtgattctcaactggcatgattttacttcccaaataacatttgacagtatgtggggacattttttattattttgattggcccatagaggccagggatgctgttaaacctcctacattgcacggaacagcccccacaacaaagagtcaactgccccaatgtcagtagtattgctgttaaagaaccctgctttagactgtggatttctttgctttctccatattgtcttagatttatagatttataaatgtatagggcttttgaatatacttgaacagatatcttaaccattttgtcttttttctttaaattctatattttgtgacaatttaacttttttgacgtatagaaattgtatgtatttagggcatacagcttgatgttttgatatacattgtgaaataatcactacattccagctaattaacatctgatatctctgtctacctgccatttttgtaccctttgaccagcatcatcccatttctagttccttccgtttccaggcagccaccatcctaatctctgcttctatgagtttgactaattgagattccatgtataagtgagatcatgcagtatttctctttctggcttatttttgcttagtacagtgctctccagctccatccacgttaccacaaatggcataaattacttttctgggggtaaggctgaataatattctgttatatgtacaccacgttttctttaaccattcatccatcgcagggcatttaagttgcttccatatcttcgctattgtgcataaagctgcagtgaatgggagagagcagatatctcttcatgatcctgttttcaatacttccagatacatactcagaggtgggattgctgaatcatagggtggttctgtctttaattttttgaggaacctcaatactgttttcactaatgggctgtaccaatttacattctcaccgaagtatacaagggttcacttttctccatatccttgacaacacttgttatttcttgcctttttgataataggcatcctcgtaaatgtgaagtgctgtcttattgaggttttgatttgcatttccctgctgattagaaatgctgagcagcttttcaataggtctgttggccatctacgtttcttattttgagaagtgtctattcagggcccttacccatttttaacaggttatttgtatttttaatattgagttgtatgattttatatattggatattaacccctgtggatgtatagtttgaagattattttttctcatttcataggtgacctttcactttgttcattgtttcttttgctgtgcagaaggtttttagtttgatatagtcccacttgtctatttttgcttctgttgcctgtgcttttggtgttatatccagaaaatagttgccaagaccagtgtcaagaagtttttctttgtttacttctaggagttttacagtttccacttttgtgtttaaatgtttaatccatttgagttgatttttgtgtatggtgtgcacctttttgtctttccattcaccccgtacaatgtggtagttagtatatattttggaatctggaataaaatacttgggttcaaatatcttttctaccaatttctttatgactctgttttgtgatccatgagaaaagggtactatgttagattgaactacctcatggagctattttgagaataaagtgatttaagaacactcaaaccagtaactggtgaaaagtgaaaaactcagtcgatgttagcccttagaagttattgctgccttaattattctgtgtaaagggcatagtaggggataaaactagagaggatgaataaggctaggtaagtgggcacggggaggtggtctttggttgttaggttgagaagcttgtattattttcagtaaaccatctaaccagatggattcaggatcagttgtatttgatagggcctgttgataatagggataacagttaggttgatcacaatagcctgggtgaaaaagtaatagagataattggtggaatatggaattggtagagatcgcatcaaagatgattcgagagttttgaacctttctggttaggagcattatgttaatcagaaatggaaatcagaatggagatgaactagttttttgtttaagaatataaatgattcagttttagatttaaaactttaggctgcctttagggtactaatgaataagccagtgcctggcatacttttatttgggagaaagttaggacaaaagatgaagatttgggagtaattttcattgtaagtgtatttggagtcttagaggagtggatgctgtataatgtgtaacagtgaaaagacaaataatagattcttgaagaatgtgcgttcataattgattccattgttttactgtctctagtagcattactgtctaggatttctaaagttttctttaaaaataaatgctgtaataaaactaatattatagtaaggacagggatctttcttagcttcagatgtgatctttgtgaagaaggcattatgtctcaggttttactgtagaacctggtgataactactcacattttactagtggaaataatagaataacataagcctgcaaggtgtttttagatatctctggtctagatatcctgttttaggcaagcaaaatgctattattgcatttttacaaatgagatagataaagcccactttgaacttgcttaaaataattacgttagtagaggcaaagagggactaaatacgttgctcctttgccgttactaatgctagcttcatttacatcaggttttctcagccttggcaccattgacattttgggctagaattctttgttgtgggcagctgccctgtgctttgtaggatgtttagtagcatatctagcctttaaccactagatggcagtagcaccccctccccacctcttgttcaaccaaaaatgtctccacgcattgccaaatatcccttggaggcaaaatctcccctagttgagaaccagtgctttacaccacaaatatatatcatgtatacctccagttagcttcctgtccaccttagttttacagacttctctttggcatatggccatcttctacctctaagccaggttctgttctcatctggtcaacactttcttaagcatcttattttgctgcctgacgtttacatttattatgtttttgactttacaatggcaatggatatcttgggttatattggtaattacgtttacacctaacatatccccagtttttttttgacagctcacctcatacaatcagatttatttctataaactaagtattgtatttatcagttaactatagctctgataattattttaacctagatacatgctggtaaattgaattatattactctgactatacacgagaacatgtagaatggtgtttttatatccttgtttatagttcagcaagattctgtatttcaagtttgataaatcataaatatttatttctaaaaggcttattcagtttctgtatttgtaatatatttgctcttattattttggggatcatgaaaaagggattatttggtagtgatttatataatctttcataaatattgttagcttatttcataatctcagatatttcatttttaaattaagtgtacctgagacagatatttttgtagtaagttttgaaattctgtatttttaattattttattaaagtatttgagcattttactaggtgttttgtaggcacaaaattgatgtgattttttctgaagtagaattacattctaatgggtatttcaatatattttactcatagaatctgtgtcattgttgaatctacattcaataactgggagctacagtattcttaaaataccattttctagattaattaattaatttatttatttgagacagagtctcaccctattgcccaggctggcgtgcagtggtgtgatcttgactcactgcaacctctgcctttcaggttcaagcaattttcctgccttggcccccccaggtggctgggactacaaacatgcaccaccatgcctagctaatttttgcatttttagtagagatggtgtttcatcatgttggccaggctggtcttgaactcctgacctcaggtgatctgcccgccttggcttctcaaagtgctgggattacagacgtgagccactgcacctggccccattttctaaaattttataatcattaattttcataaaggtgctttgaaattcctaataatatcaagtctagtattccaaattaatatgaatgatttgatgtgcaatgagatgaggagttacttaagtttctgaattattgctgtgtaaaaacagaagagttgatacatgttgttttcttattagacaaaattgagtcttgatttccaggcaagagaatgtgaatgatatttaatatctgttatataaataaaattacatattaaagctttttagaatttatcattaggtacctattaggagatattttaaaactataccatcattcaacttttctagatttaataacttagattgatattggtttctaagtgttcttgtagtcacttactataaacaagtaggaaacggaactaaaggatgatttgcctgtaagtatgaaatttccttggcagaggttgcaaatgcggtgggatgtgcatagtgtgtttcaagctacacaaacttactctttttcttgggcctattctctcttgctgacactcctttctccccttactttttttgaccctttactactgtaatgagccactgttacttaaaggcctgtgacttttctgtcaaataagctttactaggaaaatgactatattttatcagattctcttcactaatgggttgacaatgggaaaatgttgcagtttcaacattccaaaaaaactttctaaagagatttatttgtgattatcctgaagcatgtatgttacctaaataaatctctcagggcaaatatatggaagaaaatttccactgaaaaattatatatttgattttatacttactcatgcttcaatacaaaacttgagggaaaataatgtgcattattttcttacacgtggcacagttaaaaggtgtttcctatcaattccaatgattttttctttcttagcaaaacttaaattatattgaatcgtcattgtatggacttccgtttgaagtaagcaatcctgtgattatgatttttgcagttttaaataatttataaaaatctgtttgagctgggtgcaatggattgcacccttcgtctcagctactcaggaggctgtggtgggagaattgcttaaactcaggagttcaaggctgcagtgctgtgactgcacctgtgaatagccactgcattctagcttgggcaagatagcaagactccatatctaattttaaaaattaaattaaaaatttgttagaatgcaatttgacttggataatttaaaaatactagtattggacacttagcaatttttccttcctaagtatttttcttataatatggccccaccctccataatgcacacactgaattgggagacttgcctctcctttagcacatcctatatttctctactcctgtttttttgcccatatttacttcatgctgcaaatctgcatgagtgaatattacccatccttcaaggcttacaatgttcattcctctataatcaattttaagacactcaggtaataccttttctttttttactttgtactcagaatacatttaaaatccccaagtgagatttatccctgggttacaaggttggtataaacatatgcagatcaatcaatatgatataccacagtaacagaataaaagctaaaaccacatgatcatctccacagattcatacaaagcatttggcaaagttcaacatcttttgggacaaaaacttccaataaaataggtatagaagaaaattttctcaacacaaaggccatttatgaaaaggccacagctagcatcacaattaatggggaagaactaaaagcttttcctgtaaaatccggtacaaggcaaggattccccatcttggtgcttctattcaacataatactggagctactagtaagagcaatcagacaagaaaaagaaacaacaggcatctaaaatggaaaacaagtagtagaattatctctgtttgcagatgacatgatcctatatgtagaaaaagactgttacatcaaaaaaacctgttaattcaataaagttgtgggatgcaaagttaacatacagaaatcagttacatttctttacaccaatcgataacagcctatctgaaaagagaatgaagaaaacaatctcatttacaatagcatcaaaaagaataaaatacctaggaataaatttaaccaagatggaagaaattgaagatgatacacataaatagaaagatattccatgttaatgaattggaagatttacattgttaagatgtccatactacccaaagtgatacacagatttggtgcaatccctatccaaataccaatgacattttttacagaactagagaaaaacaattctaaaatttgtaggggactaaaaaccctgaaaaagccaaagcaattttgagaaagaagaacaaagttggaagcatcacacttcctggtttcaagttatattgctaagctccagtaattaaaatggtgtagtactgaaatagaaacatacacatagaccagtggaccagaatagagggcccagaaataaacccaagcatgtatgttcaaatttttgacatgggcaccaagaatacacaatggggagaagataatcttttcagtaaatgatgttggggaagcttgaatatccatatacaaaagaatgaaattggacccttataccatacacaaaaatccacttaaaatagatcaaatacctaactgtaacacttgaaactgtaaaactcctagaagaaaacatagtggaaaagctccttgatgttggtcttggcaatgatctttttgatgttacatcaaaagctcagccaacaacagcaataatacacaactgggactacatgaaactaaaaagcttctgcacaacaggaaacaatcaacaaaatgaaaaggcagattgggagaaaatatttgcaaagcacatatctgataaggggatatctataatattaaaggaattcacaactcagtagcaaaaaacaaaacaaaaacaaataatccaaggacttgaatagacttttttttttttttttccaaagaagccatgaaagtggtcaacaggtggctgggcatggtggctcatgcctgtaatctcaacactttgggaggccaaggtgggtagatcacctgaggtcaggagtttgagaccagcctgaacaacatggagaaaccccatctctactaaaaaaaagaagaaaaaaaaatgcaaaattagctgggcctgctggcacatgcctgtaatctcagctacttgggaggctgaggcaggagaatcacttgaacctgggaggcggaggttgcggtgagctgagattgcgccactgcactccagcctgggcaacgagagggaaactccgtctcaaaaaaaaaaaaaaaggtcaaaaggtgtatgaaaaggtgctcaacatcaccagtcacagagaaatgaaaattaaaacgtcattgagatattacctcatgcatattaagatggctattatcgaaaatacaagataacatacaaaatagttggtgaaggtgtggagagtaagggtgtcccactgttggtaggaatgtaaattggtacaaccattatggaaaacagtatggaggctcctcaaacgattaaaaacaaaactaatatatgactcagcagttcctctgagtatataccaaaagaaatgaaattagtacctcatagagaaatgtatgcccccatgttcattacagcattatttccaacagcctacatatggaaaccacctaaatgtccttcagtgggtcaatgaattaagaaattatggtatatttatgcaacagaatattattcaggcttagaaaaaaagatcctgtcatttataacaacatggatggagctggagggcattgtactaagcaagatcagccagacacagaaagagaaatggtgtgtgatttcacttacatgtggaatctcaaaaagttgagtacacagaaacagaatgcaaaaaacacctattatgaagctacttggttaataagctcttttaaatgggggagaaacaaacccagttggtaactcattaataacaacttttgattataggtgataaactaattctgtacctccttattataattgaaacagatataaattactctgtcagttctaactgtaccgtcttctgtggttagaaatataaaaaaattagcaagctcaggtcagagggagagcatgctttttatcccccctctcagttgtgggtattcaaagggatttgttttgttgaaactagaagctactgttcaggactaggaagaaggttatcagtgctgaggatgggggagttggggagatgtaggttaaagagcacaaatttgcagttacgtaggctgaataaatctggaggtctaatgtacagcacaatgactgtacttaataatattgttttatatactggaagtttgccaagagagtagatttcagatgttcttgacacacatgtacacacatacaaggtaactgtgaggagatggataatgttaatttgctttaccatagtaatcatttcactgtgtatatcaaacattgtgttataatgttatatactttacatatcaaaaaatttcaattaatttttcattctgttgagtaaatgcattccaattaggatacctataaagtgaatatacaaatatattgattagtgtgatttatttatatttacatattatatacattaggaagttataatgcttaagaacacaattatttacaaagcttttgtttattaaaataatttttataatctctaattacatggacagtgttgtacaaccacctccactgtctatttccaaaaccttttcatcatcccaaacagaaatcatttaaccactaagcagtaacttccattttcttccatactgtagccctgggtgacctctaatctactttcggtcaccatgatttttttctattttaaatatttcatgtaagtggaatcatacaatattttccttttgtgtctggcttatttcgcttagcataatgcttttgaggttcatccgtttggcagcacgtatcaaaacttcattcctttttatatttggataatatatgtatatacaaccttttgtttatctactcacctgttgatggagacttgtattgtctttaccttttaatttttgtgaagaatgcttcaatgaacattgacatacaagtgtctgtttgagtagctgttttcaggtttttggagtgtgtacctagaaatggaccttccgggtcatgtggtaattctgtgtttggctttttgaggtactgttaaccttttatctatagtggctgcaccatttcacatttctatcagcaatgtgcatgttctgatttatccacattctcaccaacacttgttagtttctgtgtttttttttctaaattatagtcaccctagttagtatgaagtggtatctccatttgattttgattgcatttgtttaatgattaatgatagtgaacatcttttcatgtgcttattggccatttgtatatcttccttggagaaatgtttattcaagtcttttgacttttaaatttgggtttttttgttgttaagttgtatccattttaacaatatattctggatataaatagatacatatccaggtttatatcagatgtataatttgcaaacattttctcccattctgtaggttgtcttttcactttcttgataatgttctgtcatgcacaaaggtttttaattttgattaagcccaaactatgtagtttttcttttgttgcttatgcttttggtgtcaaaactaaaaatctactgccaaatctaagatcgcagagccttatgttttcttctaagacttctgtggttttacatgttacaggttgtttattcattttttgttaatctttgtatatggtatgaggtaggcattcaatttcatagttttacatgtggaaaaccagctgtcccacctctctttcttaaagagagtattctttccctcattgaatgggcttggcatccttgtggaaaagaaatcaatttgctatagatttatgactttatttatgtactcttaattctattctgttggtgtttttgtctatctttatgctagtaccacctgttttgattactgtagctttgtagtaagttttgaaaagtaaaaagtgtgactctttcaattcttttcttttttcaagatttttttttttttaccaataattttttatttatttattattattatactttaagttttagggtacatgtgcacaatgtgcaggttagttacatatgtatacatgtgccatgctggtgcgctgcacccactaactcgtcatctagcattaggtatatctcccgatgctatccctcccccctccccccaccccacaacagtccccagagtgtgatgttccccttcctgtgtccatgtgttctcattgttcaattcccacctatgagtgagaatatgcggtgtttgtttttttgttcttgcgatagtttactgagaatgatgatttccaatttcatccatgtccctacaaagggcatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaagaatcaccacactgacttccacaatggttgaactagtttacagtcccaccaacagtgtaaaagtgttcctatttttccacatcctctccagcacctgttgtttcctgactttttaatgattgccattctaactggtgtgagatgatatctcattgtggttttgatttgcatttctctgatggccagtgatggtgagcattttttcatgtgttttttggctgcataaatatcttcttttgagaagtgtctgttcatgtccttcggccactttttgatggggtctttttttttcttgtaaatttgtttgagttcattgtagattctggatattagccctttgtcagatgaataggttgcgaaaattttctcccattttgtaggttgcctgttcactctgatggtagtttcttttgctgtgcagaagctctttagtttaattagatcccatttgtttgactctttaggtctgttgaaattttacttgaatttgaagagcacattttcatttctgtggaaaacgctgttggaattttcttagagattgcactgaatctgtagattgttctgggagtattgacatcttaacacattgagtcttcctatccatgaacatatgatgtctttccatctttttttttttttaaagaaatcagtgttcagtatacagatgattcaccttggttaaattaattcctacatattttgttcctctagatgctattgcacattttttttttttgagacagagtttcactctgttgctcaggctggagtgcagtggtatgatcatggctcactatagccttgacctcccaggctcaagcaatcctcccacctcagtctcctaaggagccgggactacaggcatgtgccactatatttggctaattattaaatttttttgtagagataaggtcttgctttcttgcccaggctgatctcgaactcctgggctcaagctgtcctcacacctctacctcccaaagtgctggaattacaggcgtgagccaccgtgcctaaccctactgtaagtttttaaaaatgtcctttccttttttttcttttgatttttattgctggtgtatagaagcaaaactgaatttttgcgttgataatttcaccaaaaatagtaaattattaggaatacatttaacaaaagccatgcaagatctctatactgaatactacagaacattgttaagattcatttaaggatgagtaaatggagagatttacagtgtttatgaatcagaaaattcaatttggttaagatgtcatttcttccctaacctattgattgattcagtgtaatcctcattaaaatctcagcaggcttatttttcatagaaattggcaagctgattttaaaatgtatgtggaaatgtaaatgctacattagctaaaagtgttttgaaaaaggagaataaaagtctgaggacttacacagcctgttttcaaaatgtataaagttatagtaattgagactattctattagcaggaagaaagacatatatgttaatgcaacagattagtgagaaaagaaattgtgtgtgtgtgtgtgtgtgtgtgtgtgtgtgtgtatatatatatacacacatacatacatacagtcctgtgcttcataccatagaaattaataagctgaagtagtttgtatacctaaaaataacagctgaaaccataaaacttgtctaagaaaacatagtagaaaattgtaatgactttaggaaaatattccttaaataggtcacaaaaagcacaaattatataatttttaaatggataattttgacattactaaaataaagaactttggtcttcaaaagaaattatttagaaaatgaaaaagccaaagacttgtagaaaatatttgtaatacatatatccaaccaagactatttatttacaatatgtaagtaacttcttacaaggcagtaatgagtcaaacagctcagtgcaaacaagagtaaaagatttgaacagacacttcaccaaagaaggtatacagatagcaataaacaaaagaaaagatcttcaccatctttgtgtcattagagaaatgccaattaaaatgatgagacacacactttagaaaggctaaattaagaagactgacaatgcctagtccaaggcggatatggagcaaatggacttctcattcatttctggtaggaatagaaaatgttacagtttgacagttcttacaaagctaaacatgcatttgccatgtgatacagtcattccactctcctagttatttacccaagagttaggaaaacatgtcaatacaaatgttcagagcagcatcattcatgatagccaaaaactggaaacaacccagatatccatcaccttgtaaatgtgtaaacaatttgtggtatatacatacaatggaatcctagtcagcaatgaaaaggaacatactactagtatatgcaccaggatagattcatctcaaaaatcttacataaagtgtttctttattttttatttttaaagtatttcttatgtagctagaaaaggtacaactgtagtcgtagaaagcagatcactgttgccagaatgctgacggagggaattgactgcaaatggtagcaagaaattttttcacatccttgaaatgttcaatatcatgattttggtcatggttacgtaactgtatatatttgtcaagatttgttggttaattttattcattataaattatccctccataaagctgaacaagaaaaaaaagcatttttaaaaatgaagcttcttttaagtcataggaaggttggatagaatcactggttttattctttttctggactttcacaaacaagggtctacatgtctttggtaggaaaagaagaaaggtcatcaataagaaggtagatatctagcctgacttgttggttgaagattaaaattatgtttagaaaagaagtaattttgcttaataaaaagttacattaggtttaatacattgaatgtttaatttttaacttcttagtaacgattgtcatcattttaattggctttagaaatacaaacctggtcgatgtgatgatattttgaaatggaagcctcccagtctgaattctgtggattttcgtctaaaaataacaagaatgggaggagaagggtaagtatgcacttttgtactttttgcatgaaataatactgtttgtgtaaggcttcaccttttacagggtatttcatatatactttacaatactttaaagaaagaaactaaaatactttattttacaagatattttacatatatacttatacaacaatttcgttttcagagattactcctttgacctgtgtcagctaacatatagcagtttcctttaaagtttactgatctttgttttaaaatcattttcattaatataattatattaataacaacaatataaaaggtaataataatattaaaaaacgaattttggctgggcgtggtggctcatgcctgtaatcctagcactttgggaggccaagataggcagattgcttgagcacaggagtttgagagtagcctgggcaacatgacgaaaccccctctctaccaaaaatagaaaaattagttgggcttgttggcacatacctgtggtcccagctactcgggaggctgaggtgggaggattgtttgagcctgggaggcagaggtagcagtgagctgagactgcaccctgctgcactccagcctgggtgacagagtgagaccacttcccccgccgcacacctccccccaaagaaaagaactttgttaaattgtaaagtgaaaattttactaaattttgagattttactgaaaaataattctcttatatgaattatagatctagatataagatatgatcattggtattataattaagcatatcgaaataagtcttttttactttgaaggaaattacttcatgtttgcatttgcagagcaaatattttctatacttttgtagggtaagttaactgttgactttcattaagattttttataatgtctattaagtgttaatttttaaatttattggttaatcttccttttatgactttttggttgctatcttagaataaaagatgctttagcatgaatattttcaacatttttccaaagccttgtttttatttcacttttgttctataactttttaagtatcttggctaagtaaatacattacaacaaaataagaaatccttaatcaaggaaatcagaaagagaaagtaaataagataatactagcaaagagattaaagcttaccagtgcatcctgtgaaatttttacttatcaaaggtaaagcacagatagcatttttgctagctgatggaacaggggatatatggagtccagactccaaaagattaaaatatattaagaaactatgcattatcaaagaaaggaaactgtgcattgtggtgaatcttaagtgaaaaggtgggtttaataaagcatgtgggtattcgttttcaaacaacagggtatttaacattttatttgaggctgggtgcagtggctcatgcctgtaattccagcactttgggaggccaaggtgggaggatcacttgaggccaggaatttgagaccagtctgggcaaaataaggaggccctgtttctaaaacaaacaaaaattagccgggtatggtggtgcatgcctgtggttccagctacttgggaggctgaggtggcaggattgcttgagcccagagcaagtctctgtctcaaaaaaaaaagaaagaaaaagaaacacacacacacacacacacactatccctaaatgtttgtggcttaatttacaattgggacttaatggcaaaaagttgttagaacaattatctggaacccccaagaatatattgagctctatatgagtctgattataatccaaggatagataaatttgaggctataggaatagctggaatacacacacaggaatgactttcaggatagtttcaaaaatgtctttctcttatctaaacattggataaatattgatatgttgaacattcaagattagtcttcctgacaaagtgcccagtgtacagattttctcagttgccagtcaaatgtgggattgtttatcactaatcatgcaagttgggtgtaggtttgatatgttcttctggaagtgccttacagaagaccatctcactattagaaaaattgaggctaagaaactaattctagtggggctacgctgtttttttttttttttttttttttttgacacaagtgaatatagttcttcgaaaaataagacttcaaagatgaagtaaaattttgttaaactgcttcattactaaatcttctatttttcttaatgctatatttgtatttggttaaagagtatagactctcggattgtttcattgggttttttaaaaacaacttacttttgccttttacagtcagttcttagtggcacttaaaggcttcctgaggctaaacatagaatactcatttctctagtagtaaaaaatgttattttttcttgcagtttcctattgtaattaaacatagcatgatgtaattcagtttagtagtttgtcatcctagttttgcctttattcatagtacgttttaaatatattttgttcttttaaaattttacctatttaatgtcttcttcctaaaaaatggaattacttttgagtctagtgcatctttaaaactcatccaaatgtttctctaaggtgattttcagataggaatatgcaatttacatcagtgtatgtacattatttgtgtaatgggagtcaattttcaaaaatagaatatttaatatgaaatataacatggtaactattacataaaacatattcggttagccagagtaatatgctttttctaaatgtaaagaatgttgtgcattatagcagtctttactgaataaatgagtttatatctaatgcttagcattaactcagtattttagagaacactgtaagaaatatgtctatactagttcgaaaggggagtagctatgtctctgaatcattaagcatgcactagtgaagtgggactaagctgttaaaacaccatgagagaagctcatatctttgattgtacttccaaatatttctacaaagcctaaaatggaatagaatatcttgaaggtataatataaataatagtctttgaaaatgactgcagtagttttctaagaaatgaagacttaggcattctaggtatgtttttgagtttgactttaatgaggtgctaatagtatagatttctgttagattgaaatttaatacaaatagaaaaatctgttctatgtgttgagtgccctgttgatggcaattaaaatccatactttgctcttcttatctcctattatcatttctgaaaatttgagatatattaacattgatttatcatggcctaatataacttttgtatatcttagcaatttatattgtgttgagttttatacacaatatagattttcatctgagagctatttgttgttttaaaaacatgatggctttatattaactaacttgtgacctaaaaccatggtcattgtcaaaagctagaattacaaaagtagtctgtactctggaaattgcaaactcttgagtacaatgtcagtgatatatagtgattggtataaacttattatttgtatagaatagtattttagagttcaggttttaaagctggactgcctaggttatctccttactgtctgtgtgattgagcacattacttttttctgtgtgtcaagttcttcatcaataaaataagttggcctcataagacgtctgtaaggattaaataagctaatgtatgtaaaatgtttagaacagaacctggtacatggtaaacgtttaaatatttgccattatttttattgttttaatcaaaacaaatttaaaagtgcatcttcccttcttgctgcctctgcaatactacctgttacttgctgcactaagtccaactttctgtgtgaatcatttcctatttgattccaatctctgttaattttctcttttaaaatgcatatatctttagcttttttgtgtaatttgtcataactgttaaacacctggagagcaagagcacagcaaagtcagtaacttttcattatagaggtttttgtaacaagtctcttaaaataaccttgacagtatatatactggtatatatagcatatagtggttaagaacataggttattggccaagtttgcccagaaccaaatccaagttccactacttatttgctgtgtggtcttgttaacttaacctacctaaccttcctcatctgtaaaatgtccacaggaataatgtttattttgtagattggttgtgctgaagatttatgtatactcaatatttaattgcatgggtaaacaaagtaaatataagtctgcctttatagaatttacaagctaatgggctaagatgaaaaaataatactactttatcaggttttgtggggattaaataaatgatgcatgtaaattcagcataaaactcaataaataaatgtttgctttaaaaaatggttataattattaattgaacctcagcagaatgtatggttaagtcatggattaaaaacataactctgtattatcaagtggaaaaaaagtgccctgaatgaagaagcctcactttgctgtgaaaatataaaaatttttgtccttctaataaaaaatatacattctaaaacaagaatgaaatgtaatttttttttttttttttgagatggagtctcactctgtctcccaggctggagtgcagtggtgggatctcagctcactgcaagctctgcctcctgggttcaggccattctcctgcctcagcctccctagtagctttgactacaggcgcctgccaccatgcccggctaattttttgtatttttagtagagacggggtttcaccgtgttagccaggatggtctcgatctcctgacctgatgatccacctgccttggcctcccaaagtgctgggattacaggtgtgagccaccgcacctggcccaaaatgtaattttttacctatcacattggaaataataacattgtcccttttggttagaatgtgagcaaataggtactctcctaaactgtttggtaggaacagaagttggtacaactctttcaatgggcattaaggtagtatatgtcctgagaaaatatgctccaattttgtgaaaggagagatgttgtttgtcttctacatagttgtattcttagtacatagcatggtgacttgtttatagtaggcactccagaaatattcagtgatggaatgtatatacaaacaaataagaatatgtaaaagtatgtgtataataattttattgaagcatcattacaatagtgagaaactggaaatattcaatgtctttttcactgtaaaagtcttttgtaaaatatagttgtatacatgtgtcttcctgtatgtgtttccaggaaagttgctaatagtattctaaaaatctctaatagtatcttttagaaattggtctagtctgttgagatacaagatttcctagagctttgaggttgaactcagacctagcatctacatttgttgtttgattttacattcacacatagttgtgtgatgttaatagacataccagtttggatttaattaaaaacagaaacacagcaaatattttaacagaatgaatttagttgaagaattgtctgttacgaaagaactgaagagatgaaaaagtcttgcagaggaagcaagcactgcaggaagcgtctaccatgcagcgaactggggtaatgaagaaatgagggtagattattaaaatttagaagattggaggaggccttatagggttcataagaagccagttgctgcccagctgtcattcttgccacaagatcttggaggaaggattcagaggctccagacaattgatatactgggttataaggcccaagtggcagagcagcttatactatagcatgaacttgctgcagagccatcttttgttctgatttcaacttaaaaatggtagcctaacaggttccttggtcaatgagttggagtactgcttcaaaatccacagtgattgttaatctttgtaacgtcctttttagtatccactgatagtgcaagtagagtaacttgtctctgacaccttggagaagctatcctgataggcttccaaccattggacccctagaaatcttacttaggcaatgggctcttaatttttgtgggttttatgtcttctgtcttacatgtgtcttagcaagatgtctaaagaactttatacttcctctttatcactcttaataagtacaaaatcatcagcattgttgatcagtgatttgttctgtgtagtgtcagagtgaccactgtctctgaaaaaaattagaaagacgataacaagtgagagacagaaattggagtccttacacatggatgttgagattgtaagttggtgcagccagtgtggcaaacagttacatagttcctcaaaatgtttaagatagacttaccatgtgactcagcaattccactctcaagtatatacccaagagaaatgaaaacatatgcccacacaaaacttgtacgtaaatcttcttatcagcattattcataatagccaaagggtggaaacaaccccaaatatttatcaactgacacatggataaatacgcaaacaaaataactcttccaccaggcacagtgcctcactcctgtagtcccagcactttgagatgtctgaggtgggcatagtgcttgagtccaggagtttgagaccagcctgggcaacctggtgaaaccccatttctaacaagaaatacaaaaaaaaaaaaaaaaaaaaaaaaaagctggccatgatggcacatgcctgtagtcccagctacttggaggctaaggtgggaggaacacctgagcctggggaggttggggctacagtgagctgtggtggggccactgcactccagcctgagtgacagagtgagacccttccttaaaaaaaaggaaaaagaaaatacctttcatttagacgactgtagtggatcctcttaagcaaagagactctggatattatgccagctggatttcaattcaagctctgccactctttactcaggttatctctctgttgcttgtgtttctgtaacttcattatgtggataatagtgcctaccttgtgtgggactttaatgacataatacatgtaagtcctttaaactactgcatgttacataataaatactaaatatatatttactattttttaaaaagaccactgtctctgtagattctactgtggcagagagcagaaaagcagtatgctgtggctgcaagatatactattggtcattctaggcaaaggcagatgtcttctgatagtaccacagattggtacagagagaaaagtatttgccaacttgtatataagattttagaggctacattgattggtttcgttaaagacagcacatctgaaatggcagctgcacttggtttaacatgattaaatttatgataatcaaaaatcattctaaatctctgatggtggtactaatttttgtatttcccttggagatatgttactgcttttggtttatttccctggtagggaaggctggttgaaggggcttttatttggcctttcctagcataatgacccttattccgtgggtcagacagccaatgtggaaattcgttttccaagtatttctcttccagttatacatccagtaactggaaaataaccgcaggttgtatttgtggacataccgtcacacttagatttaaacttgagccagtaatccatttatcacctgattaccctaagctctccatttaacttacggactgcagtggcattttgggttcctggcaattcgtgtctgtttaaagtaagtgtctggtaatcccctagtggtctgggtgttctttcttttggattataatttttttattagatttttcttttgaaagaaagaacatccgtaccactagggggttaccagacacttactttaaacagacacgaccactaggggattacccatcggggattaccagaacaatcactttagcaaatgctgctcatcctttgaaaaactgttggaagatttacagcaagggtcagcactttttttctatgaaaggccagatagtcaatattttagggtttgttgcctatgtatctcaactactcaagtctaccattgtggtgctaaatcaaagctagacaatatgtgtatgagtgagcatgactgtgtcacagtgaaactttatttacaaaaacaggtgtgaggccagatgtggcctgtagactatagtttgccaactgtggatttacagtactgtacatggttgtagtagtattgcaataccttctttaaggggatctggcctcccacttgtattgggaggcttaggtatttttgttgttgtttgtttgttttgagatagagacttactctgttgcccaggctggagtgcagtggtgcaatctcagctcactgtaccgtccacctcccgggttcaagcgattctcctgcttcagcctccagagtagctgggattacaggtgcctgccaccatgctgggctgattttttataattttaataggggtggggtttcacagtgttggccaggctggtcgcaaactcctgacctcaagtgatccacgtgcctcggcctcccaaagtgctgggattacaggtgtgagccaacatgcctggccagaaggttctggtttgttaaccaggtaaggtctgcacatttaaaactgagaaatgctagcttcctagcaagcagaatggaatatatagaattgactgcatggtctcctttacttcctatcggaaaagtctttttactctgctgactagagtgtatgtgtgtgtgtgtgtgtgtgtgtgtgtgtgtgtgtatttcttttgcttcaattcattaaaaaaaaaaatagaatgagctgggtttggaagctgaggcaggaggattgcttgagccctaggagtttgaatccagcctgtgcaatacagcaagatctcatctctgggaaaaaaaaaaaaaaatcgttttctcatgcttatttgaattagtgttactctttttgagaaggaaattgtggtggtaaaatatttttctgaatgttgaagaactgttcttatataaggaaggattaagtatgggggaaaaagtcttactactttgctgagcagcatttttctgttttctaccctctgcctctttcacaaaatgaaatgtttaattctttcatttatattttatttaaaaattattttaaagaaatagacataaaacactaatgtaatcactattattatagtatgcttaatgactaagctatttggtatgtagctggttgtatttttttatgtataatatagctatttttattatttagcaaatgacccatagtaactgctttcttatttgaaaatattctcatcacccaaacatattttaagacaaatgcttcgttggctttcagtctttgaatggttactactgttaacattcttgattatgttttacttccagtgtgcctaggagaggcaaggaggagctgtgactgaactcttttcagttcctttgcctggttatctcttgggtattagtaactcttgtttcctctgttatttcatccttcctgcattcagcagaaaatctttcccaggccgcttaccaaaaaccaacatcataatcaaagtgtctacaagtaactagtaggagaaaaggagcatgtggctttaaaacatctacttatgacctcactggagtcaaattacttatttttacttgttaatttactaaatagaagtatatatcacctttgttttataatttgattctttggaatttaattttcatattcattttaacactattctttacattagtacctttcgcttatgtgatttttctcaattaatatatattttcattaattgcaatttctctaagttaccttttatgttataaaaagcttgttacctggtggatattatatagattaaatattagttaaattcctactttgaatcacattgaagttggtgggggggaaaatgaagtaacttaggaacataggatttgaatgcagaccctcatgagagatgagatgggaagaactgcaaacaaatcttgaactccttttttattaggtttgttttttgctgtaattatggttgtgaaacgccaaactactttagaagtgttgtaggattgagcaaatgggtactgatgttgggagtcagggttctcagtgaggaaggagaaagatacaaatatgaaatggaggaaggcagtgaagaactctgtgagatggattagaatttttaaaatatttgaatatatatgttcacatgtatgtgcatgtatatgaatatatatacatgattgtgtttgtgtatgtaatatgtgatacacataaactcatttcctagctctgtccactgacaggacctataagcagaggcaccctggtaataataagcatatccagcacgaagattttggtgtctaacaccattcctcaccaaaaagaaccagagatcttcagagaaatgtcttattctagagccgggtagggaggatgcaggataggcatagaataccttcttatgccagaaagtaagaaagtacatccccaacccaacaaaaacaatgtatgtcgaaaggatgcaggagccaacttgaaggtgctcccactggccagatctgggatatagtgtggacaccagaaggacagtaatgaattatgaactttgctaaaaataggaatctatgagtccatactgccatactggtaataaatgagcagaagagatggtttagcttttagcagaatgctgattggtaaatgttctgagtcctggatttggaaaattattttgccaccaccatagtaaagatcagctctagtgagaataatcaatggagttaatgggtgaagcacaccaacatggcacatgtatacatatgtaacaaacctgcacattgtgcacatgtaccccagaacttaaagtataataaaaaaataaataaataaaatacagcaaaaataaataaaaaagaataatcaatggatgctaagtctgggagggaaatttttataagatattttcatggttgtaaatgtctttctgtggattgcttataacttgcaagggcaaaataatagactagagagttgagaaattggacaaccccttactagcttatcagagttaacatcagcagtgaggataaaatgaacattatgtactagttcagtactatacctagcattctgactatgggtatctagctctaatctgataatgaggaagcattaaacaaatcccaaatgtggaacattctgtgttttttaaagggtctctgtattattcaaatatgtcagtttcatcaaacaaaatctgaggaatttttacttaaaatatacataatttcagatggtcaaaaactacctggagcaatagacacctttcgacgaaagtataatagctctgaggcttgccttgtgtacttgactatccccttcttggttgagcgttagttcatttattcctttctgtgtaccgggcactggagtgtattcagtgattattttctaaattgaatttctgaattacaattatcacagcagttataaaattaattttggtaatttcttatcaaaaattgtaattattaaggaacaattcacaaacacttttgccaaacgttaatcacttaagggctttttgtttttctctctcttacgaggagggagcattgaccttttaaaatgaagcaatatagagacaaagactatcaaataagtaaaaacaatctgagataactgaatttgaagcacagaagaaaaaacagatatgaaatcatttaaaaatagttttgaaatcttttaaatcacttaaataaccatgtgtctgatgtatggtatactgaaacttaagataatgcttatatgacagatgaagattgcctaagactgttacttaaacatgtaacaataggagtaaaagttgctttttggaatctgaggttggaaaatttcaaagagtttagaattaactttcaaaaaatttagctacatggttggcctgtcaaaacttatagtgtgacttcaaatcttatagtgtgacttcaaaatatgtctttgtcttttcaaccaaatgtattttgttatgttttgttatttgttcctactttcattgaatttaatcagaaaatttagtctgtaaaatcttttgaaaacattttgttaatcttgtctataacatcatatgttgtcttttctggatatttcttagacataacaacagtgaaattatttttactatttaaagaatacaacattttctctttgattatgcaattaagtattaaagtttatattagtaaattcctttactctctttactagctctaccccatataagagatacttgaagccttacattataattaagtttgctttgcatatttaatacctttgtatttagatactaggtttgatttctccagatatacaattgatatttctgtcacccaaatcatgctttttgttattaaatcatgtacttctttttattgcttttaatcctaaattcatcctagcttgatactaatactacctgtcctgcttgcttttccttgaatttgttgtggatcttttctcccattcatgtatctccatcctttttgtttcactgtggtaggtcattgccaaaactatcatgctgagatcctctggttttcggacatagcaaatacatgatcacatatcctcagggaccagtaactgatatacatttatagtgtatcagtgtgtggttacgtgtttgatgactagtccttttgtgaaattagttggtaatgtagcagtgtggcatagtggatgttagttgttaaaactgaaaagtggttcattaaagacaatttgtttttttgtgataaaattgtgtaatttttttagggttttagtctgaggatacaagagtcataaaaagctaataaccttcactctcccaacctgtccatccagcgttttccttgaccttcactctggacagtttccccgacgttgctagcacttagctccaagtgaacaaactagagtaaaccccaaagccatgttttttgagttttcctgatttgatgctgtcttgttaaaacctggaggttatctattaagaatgtaattataaagcataatttgtatgtagtcaatatagtcattattttcaagcatcaaactcaatccttcattggaaaaattcctttactttctaagtgtgtacttgaaaatatagttggttttatttaactcagtctgtagcctcttatttttaacacaagaatttagtccattcaacatttgtatgctaaagtatgtcgctttattccttctactttgtttattaattttacctcttttttgtttgcttgagatggagtctcactctgtcacccaggctggcatgcagtggcatgatcttggctcactgcaacctccgccgccctggttcaagtgattctcctgcctcagtctcccgagtagctgggattacaggcgcgcaccgtcacgcctggctgatttttgtatttttagtagagatggggtttcaccgtgttggccaggctggtcttgaactcctgatcttgtgttccccctgcctcggcctcctaaagtgctgggattacagacatgagccaccaagcccggcctaattttacctctttaactttcctttttaaaaaattgtttctgtgtgataattggtattagttgcattttcctctttgttaacctgaactgtctattaacttttcattatattattggttacctttcctttccttatattcataatcagatatatttctctgttattacttgaaaataaagtaccaactctcccccaccaagatgttctttttttttttttttttttttttttgagacggagtctcactctgttggccaggctggagtgcagtggtgtaatcttggctcactgcaccctctgcctcccaggttcaagcagttctctgcctcagcctcctaagtagctgagattacaggtgcccgccaccatgcctggctaatttttgcatttttagtagagatggggtttcaccatcttgttcaggctcgtcttgagctcctgacctcgtgatgcacctgccttggcctcccaaagtcctgggattacaggtgtgatccactatgcccagcctcaagatgttcttttcatcctcccctcatcatatagaaattttagaatagtttctaataccttacctttcttcttactttagaagtctttggcatgcttttattctcaccacccattcccccctagcttttattggaaaattttactggaacattttccccaacccaatccctacaggtattactgaaaaaacttagtagtttttttttgtcgttgttgtttgtttgttttatgaatttctcttacagacatgaatgtcacttttatttcaagaatttttttgtttggatcttgttttgtttggatctaaattgtttggatctaaatttaaattgggttcaatttaaatttaatggcatttatatactgcaagatttgtcacctaccactttttccttttcttcattttctctttcttgttcacattcatttgttctttggagtaattttctcagatgggaatatatagatttttaatctgaattttttgcctaactgctaacgtcttcctttttccagacaggcaaatcatgtcttacctggatatagaattcttggggtgcagttcttttctccttctaattgccttttggctcctttacaggtttctgccaagaccagctcggtcatggagaccccaacccagtggcgctagagaaattaaagacacacacagaaatatagagtgtggagtggggaaatcaggggtctcataactttcagagctgagagcctcgaacagagatttacccatatatttattgacagcaagccagtgatgagcattgtttctatagattatagattaactaaaagtattccttatgggaaacaaaggaatgggccaaaataaagggatgggtctggctagttatctgcagcaggaacatgtccttaaggcacagatcactcatgatattgtttgtggtttaagaacgcctttaagtggttttcctccctgggtaggccaggtgttccttgacctcattccagtaaacccacagccttcagcgggggcatcatggccatcacgaacatgtcacagtgctgcagacattttgtttatggccagtttaggggccagtttatggccagatttgggtgcctgttcccaacaagttactttattcccattttccttattggctcactggggctcaaatctggtttttggagtgctctaagtggtggcagtctacacaagaaggaaatatatgtgttctttatcttggtggatcataactggagaaatgttccctacatcctctactctgtaaagtgtttcatcttaggcttcaaatatgttcagcccataggaaggtcaggcacatgacctggggccaatgttgacctgatctctagggtttttagatttcagtggcctgtactcttctcaggatttgctaattttccaatctttgtctttagggtcttctcaatcatttcccctgctaggaagccctcgaatttcatacctcactttactcagtagacacttggattcacaggctgatattttggagttgggtatgaggagaagtcagacatgtttagatttatcatcttcctaggatccttaatagtttatttttaatttccaagtagtctttgtcttctcttttttgactttattgtttcttttcttattttataaattatgacaagaatgttctgaacaattcccttctagggaggagatgggcagaataaagattttctttatggtctaatgccatatgttctattttaacttctatttgtaatcatccttacatttgtcaaggcctttttaacccgtactttctaaatatctgaatctagagtgaaaccctgtccctagtaagaagctcagagtattcagctactcctctgtttttgctgctctttgtcagtataatctatgattttagataaaatcatgtatattgtgtttttattttctttcaaaaagttttcttgcatttatattttaattatataattctatttttaacaattatttaaatcattactatttaaacggttgcattttgggtggattaatatttaacaattatttaaacttttctgtattttaattggaattggtattgacagtcatttcatacccagctttattcctttttcagaacttttctatcagttcaagtagttttatataattttttttttttttgagacaggggtctcactctgttgcctaggctagagtgcagtggtgtgaacacagctcactgcagcctcaacctcccaggctccagcagtcctcctgcctttgggctcctgagtagctgggactacaggcacatgccaccacacatggctaatttttaaatttttgtagagatagggtctcactgtgttgcctaggctgttctcaactcctaggctcaagcagtcctcctgcctcaacctcccaaagtgctaggtgtgagccactgtgcctggccttagattatgttggtaaggagtaagtttattattttttcataaccattatttcttcttatgtcttcctaaacaggaatgtttccattatggtgtaatttgcaaaaatatataattaccttaattttagggggaaataaaagataacattacagcagctttcactgatttgtttttttaaaagttaatttgaaatattaattctatttatatttatttttacaagaagctttttctccaaagagtatataaagacattttttgcttttagaatcttgataatatctgtaggatcatcagaaacgtttagattatgaaatctttttttattttttaaaatttttgtgggtacatagtaggtgtttatatttatgaggtacatgagatgttttgatacaggcatgcaatatgaaataagtacatcatggagaatggggtgtccatcccctcaagcattcctttggtttacagataatccagttacattctttaagttattttaaaatgtacaattaagtttagatggtgaaatcttgaaatgtggagaattcccacttctaaaaacatatttgtcttcctaagtttgtattgtatatatattcaaaaagagtatttttcatgacattgctttagtctactacaagaacaattgtttatagtaaaaatattactaagccttggtaaaatgaagcagttatattgtagtctggtggcttatatttgatataattgtaggtggaatttttaaaattagcaatttgttatagtttgctctattaagatttagcctaaagtatttatgaaattcctatatttttattgctagacactccaagttcaaatacttgtttatatcctcaggataaagaaggaaagatttgagctttttagccactgtacatttcttaattaaaaccagtgaggaataaattaaatagctctgattattaaaataattgtgaaataattagtaatagaattatatttctttaacttgcacagtctgttttgaaccaagtcatttaatttggtttaaagagttaattatgatgagaggatatttaatatcctctagcatatgacagcttcaaaatataaatatggtaatttattataaaatgaagaaagctagggcacatcattgttaatgcagtccttttatctctggaaaatggaactcatattaagctttgactctcaagggagagaatatggggggagggtatggaagaggttactctattctttgtgtacatcagaaaactatcttagcaaactagacttccaagtttggaatgatgggattataggaacaattatgacaaaagatttttgcagagctacatacatatagtggtggagctagtggttgattttgattttattatattggcacctattatctatgacctctgtttaaaaaaattaaccttaattgtaggaaatgctttttactgtataataacaatttaagctgtagattttttaaatgcccatataacataccagcattgcctaatataaacactacagatttaacagttgtatttatattaaattattaccatgtattctttcaatagaaacctcttaccaatgagagggtttcagtatttacagctcaaagatgctttatgttcatattgataaatggaagccactacaggtttcagaaacatgttttcagtcatcaaatgaagtccaggtaatgtggccttttgaacagtacactgtattttcatttaattgtttgaaattgatactctaaattactatagttaatatgttagtatcaagaatatttttactgaccactatgcagttacatgagttatttaaatattcatcaaatttacttctttttggtagtgttctaatatttataagtcaagctggaatatgtagtatttagatttaaaaattgcatgagcatttaagtgggttcattgtagaaggcatagaccatatcacatggtctcaagggagtgtagaataaattaactgtaaattacgtgaattcattactaaggaacaaagacctttattcatctttttcagaatctattttatggaaaagaaaaaaatggactggcttacttgtcttcaatttacttttaaactttcattgttctaagtagcagtgctagttataactgattcatcactattcagtaagcatttattgaaaaccatctatgtgcaaaccacattgttaggtgctgtgaataaaacgatggataagccctatcctggaggagtgaaaacctgactaggatggcagatataaataactattactgtgccaaatgctatactattagagtaagtaaggttagtgaaggagcctagacaattttatatattccacatataaaacagaaaaaatgtaaggtaaaatatgaaaacattgtcattgttagtaataggaccaagaaggttccagagaagatggttcacttgaataaaactttataaatatgtaggaatgacattcaagacagaaagcatagcctgaaagaaggcgtggaactcgggaatgtttatctaataactagagttaatggaagtaaataaatcaggccaggatcacactgtgatagatcaggaaagccagagtaaggaattaggacttaccctggagaggtagtgaacagtagtaaatggaattgatattatctgtattttagaaggaactggctaggagatagagactgtcaacatattccaaccagtttcataagccagaaacctgtggaccatctttgcctccctcacctgacgatccaatgaggtactgtcagttttgcttcctagatactgcttaaatctattgacttgcctctgttctgtagacatgatcgttattcaaacttgcattatattgcctggactaatgtggtagcctctaactggtcttaccatattacccttgctctcactagttactacattgtttgacattactagaacgctgctatctcccaccccaacccccttctttttcattaatatttagtatttgcctggtgtagtgggttgaattgtgtctctcagaaaggtatgttgaaatcctaacccctggtacctgtgaatgtgaccctatttggaaataggtttgttgcaggtgtaattaagatgtaagttaagatgagctcatactggagtaggatgggcctttaatccaatgactcatgtccttataaagaaggaagacacagagagattatacatgaggggagaatgtcttgtgactatggaggcagagactgaagtgctatagctgcacgtcaagaaacacaaaggattgccagtgaaccaccagtaattaggaagaggcaagaaagcattcttccctacaggtgttggagggaacatggtcctgtctacatcttgattatcagacatctggcctccagaactgtgacataataaatttttgttgttttaagccgtccactttgttgtggtttgctatgaaagttttggtaaactaatactcttggtatacattgttttattttttagctttcagtatttctctccttatatttagatctcttgtgaacagcatttatctggatttattttttattgttgttactcattgacagtcttcataaatggagcatttcatccatttacacttaattaatcataagtaatgaatttttgccatcttattttgtgttatttgtcctactttttctatacttttccctctttcttgccttttattttgatttttttccttatttttttttccctgctcaatttaaagtcatactttgaaatgttggagttttcttggtgattaccctagaaattttagcacgcacatctaactctttaaatctaaagttaacatttatacttttccaagaaatgtaatcctttccaagttacgtttgtatttcttctattatagcccacaataccttattatttttgttacatacagtcaatatttgattgcttttcctacatatttacaacttcttttgctgtgtgttccttctattacttcagattttctgccagtagttacattctttaacatttcttttggctctgctggtagcaagttcagttgttttagtgacagtctttattctatcctatttattggatattgaattctaagtaaacagttattttttcttcagcatatagacagttttattccagtatcttctgactttccttgttgctgtcgacaaatcagctgttcgtatagttgtcttcttaccccaaaagaaaggtaacctttcttttctttgttcttgtttttaagattcaatctttgtatttgatgtactgtagatttactatgatgagcctcggtatggattttttttttccccaactggaacttattaggcttgtggaaagtgcattacattgtttttcatcatttctgagcttttcctgctattatttcttcaaatattacttttccccattttttttcttctttgcttccggcatttcacttgattaattggttaaacaaataaatattttctgtatttgcagttactattttaggagcttgtgatatattcatgcaaaatcagatccctgattcatggaacttacattttatttaagagagacagacaataaacataacaaataagtaaattagataatatgttgaaagctaaatcagtatttgtaaaaaaattaagtataataaggggttgagtgttccagtttgaaggggaggagtgacaaattaaaatattttaagtcccattgataaagtaagatttgagcaaatagttgaagaaagtgagggagttagccaagcagatagtagatatgagggagaagcaccagatggaagaaatagctggagcaaaagatcctgtataggccttggagcctgtgtggcaagagatgactaagtgaaggagggagagagaagtagaagagatcgggccctgtattatctcatcttatggctactgttagggcttcagctcatactctgagggaagtaggaggcattgctgggtttcaggatgataactgacattcgatttgactttttttttcttttaatttccctttgagaatccctcttggataggaaagggtcaggaaagagttcattgtaggaatccaggcaagagttcttgtgactaggatggtaacattagtaatggtgagaaacagtcagattctggatcaaaagatccagaaggtgtagtgtagtgattttctttactgtgttagtttagttaaactaaaattgcgttttccagaattctcttccttgtgtggtactagatgatagctagccttgagaaatgtgtgatacttggaaggcaaaaataaaacagcagtcattacattcagatatatacataatcattgctctgttggcttacctgttagcttctgtgagtcatgggccaaatgaatgtatagctccataggaaagggaaacagattcttctgcaggtcatctacagcatcaggtttagataagattgaaaacagacttgggttccagtttgtctccatcagttccagtttgttctcaggcattgcagtttgtcctattttatgtccaggctttcttcccaactgtctgccctgctgtcatagactttaggctcaccatcaaacacggggatacaggcttttatagacttcttcacaagctcccattaatggtctctggttagaagtatttttctgatcctccaactatctccttcaggatctttactccctcgcttctaccacagtagtataaggcctaactcttataataaactcctgattctatatcactggatggttctgcttcctagattaaagcgtaagtggtatattgagctgacagatttgagaaagaggagccatgattaattccatagggaagaatgtgggatgagtggtttgggaaaaaggttgaggtttataattgttcacagccatttgagatttatatgatgtatgtatgtgcaggacggactgataattaaatgggaatgtgatagatatcaccattcctgcttctttcaaattttgatgcccaccccctgccccaacacaatattgcttttggattactattttgccaggcaaaggaagttcctagagcttttctttatctctttctactataatgacccttaacccatgtgtaagagagtgcctatggggattctgccggttattaagtatgtctattccaattatacattcaggaataggagaaagtaccacagggtgagtctgtggactgactgggtctgctatgggtcaaacttgtgttaagacttcacccatcacctgatttctttaagtcttcactttgatgtgttgtgtcatagtagcgtgttgtgccccaagagttggcatcacttccctggaatcagtatagagtatttctgaaaggtctggatattaatttttctccatgacataatcattctagtacaggggtgcccaacccccaggccagaccagtataggtctgtggcctgttagaaccaagctgcaacagcaggaggtaagtggcggaggagcaagcattaacacctgagctctacctcctgtcagatcagtggcggtattagattctcataggagcacaaaccccatcgtgaactgctcatgcaagggatctaagttgcgtgctccttatgagaatctaactaatgcctgatgatttgacatgaaattttccccaaagcattcccccacccacatttgtggaaaaatcatcttacataaaactggttcctggtgccaaaaaggttgaggaccgctgctctagtagatagcaataggcccttctggggatgatttggtacataatttaaagcatatacttgtggcaaaactacagggtctttctgcaaggggacctggcctccccttgcatcaggggcctttgggtgttgggactgacttatatctgaaaactgggtaagaggggagtggcaggccacagctggaccacagggagcagccagttggttgtgaagaaacttgctggaaaatgttggaaaatcagagttggtctgctagaagccactctttggtggtggggaaatttgccatagaataccggcaggctagagctggtctgctagagccttgcaggtgagtgccaccaggcttcccacacaatatttagctgacaactgcatcatagaaaaacatccaaaccagaacccaggctatgcccttgtagtgtcccttcactgctctgtactcacaaagcctgacatttgtacctgctggcaaaggagcagggttacagggtcctgatcttgtatcacaaagcagggcaagagggtagctttggaaataagaggcagtaaattgataacttccacaattaaaattgataactggtacagttatatttgaagtatataagggggccaagttattattttgaaagccagggcaagaatctagcctttttttcttctgctttttttttttaatacgacacatacttcagatagccaaatggtaagtttctttttatgaaagttttccagccatgtaatgaagaaggaataatagactatcaccattttgtaacttctaatgtatttagaccggcactcttctatagaaatatgtgagtcacacatgtaattaaatttttctagtaaccataataaaaagtagaaacaggtgaaattaattccaataacatattttatttaactcaatatatctaaaatgttgtcatttcaacatcagtgtaatatgtatcaccccatgtgtcttttccctttgctgattttctgtgcatccttttgttgtaataacttgtaactgtgagtgcaacatctgagtcctttgagttcttctagggaatcctcgaacttgattcccaatacctcgatttggctttgtctggtactttctcataattagattgaggttacgcactttttgcaagaataccacagaaatgatgtgctgttttcagtgtgtcatatcagagtagatgatatagatatgtctcattactggtaatgttaaccttcatcactgttaaaggtggtatatgcggagtttctcttctttaaagttgctgctttcctttttctagttaataggttcttggagagtgtatgcaaatattctgtttctcctcaaactttctcctactagttgtagcttctattagcagatcctgcgtgcaaaaattatcactgcagtgttccttatggtaattttttatttccaggaaaaatactttgttttaacctctaaactgattagaactatatatacttagaaacaataagttggttttatttgtaaccaaaaatattcataatttgatgaatttccttagcttgttatttatattaagcatcatatttgtaatgtttcgttaacttcccaaatacttgaaatttatctcattttaattgtcatgatagcagatgattataatcctgagattttaagctactttctcctaaattactcatcttgtttagtatatgttataataacaatgcattgaaattctttgtcttattaagaatcaacctcatatcatagcataaaaaactattcatatgtaatagcagaaatcaggttttctagaggaaaagagctaatgtaatgattagttttctcttcttctattgtcttctgtatttataaagagtagtaagaacaggccgggcacggtggctcatgcctgttataccagcactttgagaggttgaggtgcatagatcacaaggtcaggagatcgagaatatcttggccaacatggtgaaacctcatctctactaaaaatacaaaaattagccgggcgtgctggtgcgcgcctgtagtcttagctactctggaggctgaggtgggagaatcgcttaaacccgggaggtggaggttgcagtgagccaagatcaagccactgcactccagcctggatgacaagagcaaaactctgtctcaaaaaaataaataaataaataaaagaaaaataaaaaggagtaataagaacaatcctattcttaccaactattttagaatgattactagttgttgacaaagctgttttatttccttatgttaaatcatatagtcaggagatgatgaactcatgaaagcttgtttgataatgaaatttattgtatagtgacaaatgcaaatataaattcaacataaaatgtagcttaaatatggtatttttatttctttgggggaaaaaaggtgaagagtaccaacaaaatgtttttaggctttatactaagccatttttatttatcatttcaattcatcatactaaacctataaagtagatgttgttgctatcttcattaaaaataagtaaactattggcatggctgctgtggaaaacagtatggtcattcctcaaaaaattaaaaatagaattatcatatgatccagcaattctgcttctgaaaatgaggtttcaaagagatttataccctcatgtttatagcagcattattcacaatagctaaaatgtggaagggatatagtgtctgtagatgaatggttaagcaaaatgtggtatatacatacaatagaatattattcaaccttaaaaagataggaaattctgacatatgctacattgtgaatgaaccttcaggacattatgcaaaatgaaataagccagatacaaaaagacaagtactgtgtgattccatttatatgagatgcctagagacaggaagtagaatggtggtcaccaggggctggagggagtggggaatgggaagtcatttttcataggtgtagagtttcagttctacaaaacaaaacaaaacaaaacttatggagatgaatggtggtgatggttgtatgacattatgaatgtatttaataccaccgaactgttcacttaaaagtggttaagatgctacattttgttctgtatattttaccgtaataaaaaaaattggagaaaaaaacaagtaaacttctttaaagtggttcaggaacttgtctaaaatcacataagtcttaagtataggaattagtattcaaacaaatccttgttatactccaaaacttactccttttctatcatagtcatggttttcaaactgctccatgaacaatacagtgttttatttgagtgaagagtcttcactgcccttttgtgcatttttaatacaaaaattaatgtttacttcttatgttattatttcagatctagctttgggaaatatagcgtatcttcacatttggaaattgtaggactagccctgtaatgcctatttcttctgagacattgcttctgtaatccgtatctttttctccagatgaaaggtgacgtcttaaactgtgacttagcaagccacctatgcatttgccttgcatgtaaatataaataataggggtaacattctatttttcttccgaactataattctagaaaacttctctctaattgctactcataagcaccctttgaaaagtttttaaaatcacctttacactttaagtgaatgctgccaaacttcaacagttagctattgtaatgtaatctaatattggaattcatttagtgcttactggtaaattttctctcctacctgggactaactcttccaagccttgtcaatagatctgggtcacttagccacagcactctttgtcacaatcagagcatgccgtgacttctaacaagcctttctttcccccaacgtagtctcgcaacttttcctttgagattacaaaaggaaagatgaaagaagaacagattattgatggcaatgatttaaaaagctatcatgatatgttaacttgtcatgtaactgtatgtgtaaacttcaaataatttttgaaacagatatgatatgagctagttgttttaggtcttttaaaaacattcttaaaagaaatgcctttccattgcatattttaaatatatttgaacagaactgattagcttttaaacaaaaagtcatttcctctcagttgtctgtgatttctctctttgggctattgaccttccctcctttttggaaggtaaatgctcaactttctacctttatccgatacatgttaaagtattgtttgttttggctttgctgtgtatatgtcctatttgtctgaatcagcatttttgctttacaccatatgcccatagaattcaggacctcttgtttttacagtgcagtgtcatcatgctgtaaaagaaaatgcatttaataaatgttttttaacatcagttaatgaagtatgtatgtttcagctttcttcttgtaatgttttagatttaggttatttttatgatctagatccttatgaaaagaacacacgatcctactaatagcaacggaaagatcaggtcgtcctaccagtcgataattatttggggttatttgcaattataaagctagtatatatttatgaggagatggagaaagaaaacaaaagttcagagccatgaaaaggaaaagtctgccccctacccattacccacatataaccactattaataattttttgtatctaattactcattaaatctcttgaaaatgtgctttcgaagacttcattgctggatgttggattgtgatgtcacatcatctttcagctttgtaatatggagcagtttttcatttcatttattttaaatttaaaaatttttgaaaataattttaacttttattttacattcaggaggtaattgtgcaggtttgtaacatggggtatattgtgtgatgctgaggtttggggtataattgatcttgtcacccaggtactgagcatagtactcaacagttttgcatccctttcccctctttctcccttcccttgagtcccccattgtctatggttaccatctttatgtccatgagtacccagtgtttagctcccacttataagtgagaacacgtggtattcggttttctgttctcacatttagaataatggccttcagcaatatccatgtcgctgcaaaggacatgatttccttcttttttatggctgcgtagtattccatggtgtatgtgtaccacattttctttatcgaatccactgttgatgggcacctatgtcgattccatgtcattgttattgtgaatagtgccacgatgaacaagtgagtgcatgtgtctttttggtaaaacaatgtcttttctttagatatatacccagtaaggggattgctgggtcaaatgatgattctgttttaagttctttcagaaatctccaaactattttccatgatggtcaaactaatttacgttctcatcaacagtgtacaagtgttccattttctctgcagcctaaccagcatctcataccagtcagaatggctattactaaaaagtcatttcatttcttttttttaaaaattttactttaagttccggaatgcgtgtgcagaacgtgcaggtttgttacataggtatatgtgtgccatggtagtttgcagcacctattgacccatccttgcctacgttccctcccctcgtcctccacccctcaacaggccttggtgtgtgttgttcccctccttgtgtccatgtgttctcattgttcaccttccacttatgagtgagaacatgcagtgtttggttttctgttcctgtgttagtttgctgagggtgatggcttccagcttcatccatgtccctgcaaaggacatgatctcattcatttttatggctgcatcttattcttattcttttcttttttctctttctttcctttcttgtttttttgtttttttgagacagggtgtctgttacccaggctggagtgcagtgatttgatcacagctcactgcagccttgacctcccagactcaagtgatcctctttacctcagcctctcgagtagctgggaccacaggtgtgtgctactatgcttggctaattttttaattttttgtagagacgaggtcttactatgttgtccatgctggtctcaaattctgggctcaagcgattctcctgcctcggcccccccaaagtgctaggattaaaggcatgagccaccatgcctgatcccgttttcattttttgatcgcttttaattctgctgttccctttctgagcaggtgtaaactctagagtagccctcttgctttctcctgagtattctttcctacttgtttcacagaattcctttactttcttctcttagaattttctcttcctgcttctgaaaaaggaacattgtgattttaggaaaaatttgtttctctggaagaagagtaggatgatatctttggtgtcagcagaatggaagataactgataaatgaattttattgattcctctaagatggtattaattagtagacatattttatgtattactttaaaaaattaattctgctattccataaattatatctaaaggataaatcctcatgggagcttcatatagtagttcaaattttctatttgcttggtataataaaattaaacaatgttagtttagataaatggagcatgtgttaacatatatatatatatatatatatatatatatatatatatatatatatatatataatttttttcacaccagttacacgggagaaatatatcctaattccaaagtgtgaaatttgaactgacagaattataaacatttttaacattttaaagtattttcaatctgttctgtatgtgatgagatattttttgagcctgtctttgtcacatgttagaaaatagttcctaaaagcaaaagctctctaattactttcttgttttcatacataaacataagtttacttaaaatttttctgctctattattccagtgatgtttttctgtgtttctgtatttatttaatgatgcttttgaatttctttagtgttacaggaaagctgttttctcttagttttgccttctccctttgttcttcatttcccttgcttgcctcaaaaaaacacttaccagctggaagtgtttaaactgtgaattgctgggtattggcccaacatgaagaatcctctaatttaataagcttcttagaagagttcttggttccataaatttgcttcaccttttgtcttaccagcttgttaataataagaatagtatcatttgtgtgtttaatgcttctaatatgcttgatttcccttgtatgtagtttatatacattatctcatttaatcaagctttttaatgatttctgttggctacagtgaaaatttgagaaagtttttttatcttctttatataattgcatcacatacattaataacataaagtataaattggtgtcagttttctaaagtaaggaataattttaagatataattattttacattaagaattttaatttagtaattatttatacatcattcattttaaaatttcttttatgtgaatgcattatttcttcctgttttggaaggggggtgtgtgtgtgtgtgtgtgtgtgtgtgtattttatttatagactttagtttccagaacagttttaaatttacagaaaaattgagtagatattaatagaacagaaagttcccatatacacctcttgggccccccacaaacagtgtaccctattattaacatggcacatttattacaattaatgaaccaatattggtatgttattatttatttattaatgttttgagacggggtctcactctgtcacccaggctggagtacagtggtgccatcttggctcactgcaacctctgcctgccaggttcaagagattctcttgcctcagccttctgagtagctaggacttacaggcatgtgccaccatgcccagctaatttttgtattatttggtagagacagggtttcacatgtttgccagacttggtgtgttatttttaactaaggtctgtagcttattcagatttccttagtttttacttgatgtcctttttcttttccaggatcccatctagaatactgcattacatttagttgtcatatctccttagggtactcttggctgtgacattttctcatactttccgcgtttttaatgacattgccagttgtgagaagcactgctcaaatgtattataggatgctcctcatttagaatttgtctcttgtttttctcataatcagacttggggtatgggtttagggaaagaagatcacagatgaagtgcgatttctatcacactgtatcaagagtacatactatgaacatgattttatgatttttgatgttgaccttgaccacctggctaaagtagggtttgtgagttttctccattttaaagataacccatttcttcctccttttcatactgtactctttggaaggaaatcactatgtgaagcctacacttaaacactgaaaagttacactctccccttcttagggtactgtacaattctttttatacattgttggatttaacattggtaataatttgttgaggatatttgcattcatgtttgtcttagtctccttgagctaccataacaaaataccatagactgggtgccttaaacaacagaaatctattttcttatagttctagagactgaaatttcaagattacagcagggttggtgtttggcaagggttctgccccttgagtcgcggatgctctcttcttactgtgtattcacatggcacaaggggaggaggaaaacactctctgctgtcttttcttataagacttctaatcctattgtatcaggaccccacccttgtgacctcatttactcttaattacttcgtaagaggccgtattttcaaatatagctaagggcgttagggcttcaacatatgaatttggggaggggggacagacattcagccctgcctcccttcccccaatttatatcgttctcacatgaaaaatacattcattttatcccaagtcttaattcattccagcatcaaccctaaagttcaaagtctcatctaaatatcatctaaagtggaaaggggtaagactcgaggtatgattcgtcctgagacaaaattctctctagctgtgaatctgtgaaactagcaagtactactaaaatatggtggtgggacaggcataggataaacattcccattctaagaaggagaaatcagtctatggccataccaccctgaagtgcctaatctcgtctaagaaggagaaatcagaaggaagaaaggggtgttatgtcccaaacaagtccaaaacctatcgaggaaattccattagatcttgaggtttgaaaataatctctttgatttcatgctgtgcctttcagaacaactggctttgccttctggatccactgggatggcagccccacctccatagactcctgcctccaaggctcctgggtagcaataacctagcttgttgaaaccatgaaggaaatcatccttgccctttaagactgtggtgagaatggcagctctctgatgatctctaaatcacatttggtgttgttactttttcttgaaggataatgcatgttcaccacctgatggttgtatgtttccatcttgtagaatccatgaagtctgccttccttcattcagtcctttacagttcacactggcagtgtatctgctcagataatttcgtagtctctttactgagtggtagtacaggcacaaccttggtgttctcctcagaaagccctcatcttttgaaatatgaacagacagaatttgccacatctttaagttctggttcttttttgcctaacagtagctttatttctctttctcttgcattttactataagccataaggagtaaccaagcttctcttttaatactttgtttaggtatctcctcctaaatgatggagacacctaaacaaagtattagagaagttagttatcattctcctgagtgaatatccaatttcattgactgcgagttctacattgcacacattcagtttatgacaatgttcttgagagacactcatctgtagttttgctttatcatgtttatctgattttggtattaaggtaatgttctcatagaatgagttaggaagtatcctctctgcttctattttctgaaacagattatagaaaattgatgtcatttcttaaatgtttgtataatacacccagtgaaaatatctgggcctagtgctttatttttggaaaggttaattataggttcaatttttaaaataaatattggccttgttagattatctgtttctccttctatgacttttggtagcttgtgcctttcaaagaattgatccactttatctaaattatcaaattagtgagcatagagtgttcttagtgttcttttattatccttttaatatccatgtgattaatagtgatgtcccttctttcacttatggtattggtaaatgtatgccttctgtttttttcttcttgattagtctggctagagatttatcaatttataaaaatcttttcaaataaccaaggctttggttttattgatattctctgttgttcctgttttcaagttcattgatttctgccctaatttttattatttctttttttctgagtgctttaaggttaaattgctcgttctctagaattttcaaaaatagaagcttgtttctggttttagatcttttcaaataaatgccttcaatgctgtaaatttccctgaaatcactgctttgactgcatcccacaaattttggcaagtttgtattttcattttaatttagttcaaaatattttaacatttctcttgactgctttttctttttctttctttctttttttttttttttaacactcgtgttattctgaagtaagttgtttaatctccaaatattctgggattttccagcgtctttctgttactgacttctagttgaattccattatcatctgaaaaaaaccttaaatttgttatggtgtattttgtggcccagaatgtgtctgtcttttagaatgttccatgagagtttgagaaaaatatttattctgctattgttggatgaattattctataaatgtcagctgaattcagtcgattagtgttgctcatcaactcaacaacatttttactgctttcctgcctgttagatctatcagttactaaaaaggggatgttgagatttctagctacataacagtggatttgcttctcttttaattccattagtttttgcctcatatattttgatgttctatttttaggcacatgcatattaaggattgttatgtcttcttggagaattgacccgtttatcattaagtaatactccactttatccctggttatttcctattctgaagtctatttcatttgaaattaataaatacagatgctcctcagcttatggtggggttacttcccaatatacttattgtaagttgaaaatactgttaagtcaaaaatgcatttaatacacctaacctgtgtaaccaccacagcttagcctagcctgccttaaatgtgttcagagcacttgcattagcttatggtcaaaatcatctaacacaaaagcctgttttataatgtgtcgactatttcatgtagcttattgaatactgtagtgaaagtgaaacacagaatggttgtataggtactcaaagtatactttctgctgaatgcatgttgcttgtacgtcaccatagtgttgaaaaattgtcatttcaactgtcgttaagtcaggaaccatctgtactccaaccttcttttggttagttttaacttggtacgtatttctccatctcttttcacttacctgcatctttatgtctaaaatgggtttcttatagaaaatattagttgggtctttttaaaaaaaatcttctctgacagtctctgttttttaattaatatgtttaggtccttaacagttgaagtgaattttgatatcgttggattaatatcaaccatgtttatatctgttttttatttgttgtacttgttcttttcatttttaaaatcttctctttttctgacatctctggttgaaattgaacattttatattattccattttctctcttctcttaatatataaattatacttcagttttttttaagtggttgtcctagggtttgcaatatacatttacaagtaatctatatctgctttctaataacaatacagtgctttgtgggtagtgcttgtgccttgtaacagagtatctcagttcctccctttcatcccttataacattattgtcatttatttcactgaactatatgctgtaattgccccatacattatcactgttattactttgaatagacagttatttacttctgactaagaataagaaaagcaaaatattttatattaccgtcatttattccttctttaacattctgtttcattatgtagatttgagtttctgacctgtatcttttttttctctctgttaagaacttctttttaatacttttttcaggacaggtcttctggtaaggaattccttcagtttttgtctgagaaaatttttgtccttttgaaggttaattttgctggatacagaattcaaggttgttgggtttttttttttcctttcaacactttgaattttaagacactgtcttcttgtttgcatgatttctgagaagtctgatgcgattcttgttatgtactcttaccctctataggtgagaggagtttttcctctggtttcctttaaggttttctctttgtctttgattttttgtagtttaaatataatgtgcctgtgtgtagattttttcagtttttatcctgctcggtgattgttttttttcttttttagcttcctggatctgtagtttgatatttatcattaattttggaaaattcttggccattattacttatatttattctgcttcagtcgtttttcttctccttttggtattctagttacatttttaaaccttttaaaatcatcccacagttcttggaatatgctattcttttttttgctctttgcatttgggacatttcttttttcttttttttggagggggggtggggggtgaagacagagtctctctctgttgctcaagcttcagtggcacagattaggttcactgcagcctcaacctcctgggctcaaacaatccttccacctcagccttcttccaagtagctgggactacagggatgcaccacaacacctggctgatttttgtatttttcgtagagatggggttttgccatgttgcccaggctgatctcaaactcctgaggtcaagccatccccacccagcttggccttccaaagtgctgggattacaggtgtgaactgctgcaccctgccaagttctgttttcaacctactgatgagcctatcataggcattcttcatttctcttgcagtgaatttgacttactgtatttcctttcttcatttttttgttagtgtggtaaaatataaaaactgtaaaatttagtatcttaatcatttttaagtgtacaattcagtagtagtataaatacattcctaatattatgccaccatcacaaccatccatctctagaactttttttatcctgtgaaactgaaactctgtaacccattaaacattgacttcccattgcttcctcctccagcccctggctttctactttccatctatgattttgaattggcttatttcatttagcataatatcctcaaggttcattcatgatgtggtatatgtcagaatttccttcctttttaaggccaaataatattcaattatatctatataccacattttacttattcatttgtcaatgcacactcaggctgcttccacattttagctattgtgaataatgctattatgagcatgggtttacaaatatgtctttaacacacagtttttagttattttgggtaaatacccagaagtggaatctggatcataagccaattctatttttaattttttaaggaactgccatactgttttttgcagtggctgtaccattgtacattcccagcagcagtgcccatatccttgccaacatggttttctgttcttttgataatagccatcctaatgggtgtaaactgggatctcattgtagtttggatttgcatttccataatggtagtgattttgaacacttttcatgtgcttcttggcaatttgtatgtcttttttggagaaatgtttattcacatcctttgtccatttttggatcaggttttttgttattgctgttgagttttaaatgtctctatacagttgatccttgagcaacacaggtttgaactgtgtgagtctacttaacttggattttctcctgcctctgccacccctgagacagcaagaccaaccctcctcttcttccatctcctcagcctacttgacatgaagatgatgaggatgaagacctttatgatgactcacttccacttagtgaatagtaaatatatatatatgttctcttccttatgattttttaacattttctttcctttagcctactttattttaagaatatagtatataatacatatacaaaatatatgttaattgattatgttattggtaaggcttctggtcaacagcaggctattagtagttaagttttgggggaatcaaaagttacatgtggattttcagctgcatgggaggtcagtgcccctgacattgttcaaaggtcagctgtattcttgatgttaaacctttattggatatatgatttgcaattttttttccatctgtaggttgccttttgccctgtcgatggtatcttttggtgaatacatcttaaaatctttctgtgaagtccagtttgtttattttttattgttgtatattttcttttcattcattcttagagtttccatctctctgctgacattaacaatttgttcttgcatactatctatccattagagttcttgacatattaattgttgttactttaaaatcactatctcattccataatttatgttatatctgagtctggttcaggtgtttgctttgtctcttcagactgtggtttttcctgcctgttagcatacattgtgattattttgttgaatgctggacatagtgtataatattttggataataggaagtgaagtagattggcctttagtttgaggtttcttttagtctagctaagacctgtgggctgtgtttactgttttgctgcacatgtagatgccatcagctttttgttttttgttttgtccttgtttttatgtttttttgggggggcttttattctttcctttgttgtttttgggttctctaagaactttttcttaaatagagtctctgtgttgtagctctttcatttgtaatctattttaattcttctggagcccttttggtgtagtggtaaggtgtcagggaggggaggggaagtgttctacaatcctatgacaaaatatcagtcttttaggaggcttgcattcctgggctgtgaccttagtgtttcttaggttttttgtttgtttgttttggcctcttagatgagacagaagactagacagggctggaggtggttactttcccttccctcagatcagataagccattgttatattagtttcccttgagggcaggcctttgttatgttgaatgatctgggcacatttgtaaatacagtcatgctggtgggatgtccttaggagatttctccttgtgtgaacattatagagtgtcctagatgagggatccccaactcccaggccacagacccgtaccagtccatggcctgttaggaactgggctgcgcagcaggaggtgagcattaccgcctgagctccgcctgctgtcagatcagtggcagccttagattcttgttgtaagtaaagttttggtgccgcaagagaaataacacttgaatataaaattttctttttaattctgagcaaggcaaggtacttctatagaagggtgcgcccttacagatggagcaatggtgagcacacagttggacaagggatgggaagaggttcttatccctgactcatgtggcccctgctgctgtgtcattcacctattggctagggttagatggcacagactaaactaattccaattggctaatttaaagagagtgacagggtgagtggtttggcgggaaaaatggttattacagagcaggtaatgggaatgagtcagggtggagcaggtaatccaaaaaggttgctttttgaggaagttaagtttaaaagtagaaggcaaagaattttacatattgacatattgattatttgaaaagaaatttggaactcatatctaacaacccctcctcttgcatttcctaacaaactttttaacatgtcttggcttagttgttctgcttgattttccaaaagaagcttctctggataaggtggaggacagttaaggaaggttttagtaagtgccatttttatgagcctctgcaccaacccacagatgcatggtgtgacacagcacctgacaagaataaatacacccattacagctgcgagggaaggaagaattgaggatattattcttttccatttaccaaaccacttttctagccattctgtaaaggggtcatttacccctgagttgttggctaactcattggacagagcagtcagaccttgcaatgcctttgttatacttccatcaggggcggtgttgtttgggatgacggtataacattgagttttaatcatgacacaaactcctctttttgctaatatcatgtctaagcctatcacaattttcccaagccatctggctagtatcccctaattgctcagctattctttaacaacatctctagtgtagttaataaatcgctgttggttataatagatgtagtttatccaatctacatttttattaattgtcacccaccaagatattgactcaaatcctgcagctatttgatttcgggctttaaattgatctggtactccccttgggactctaattgtgtctaaatagatgtgagagtcaaaagacccataaggggcttcttttgctttatgatgtctttttttttttttttttctttttctggttgatgaaatgccagggtaaaagggatagccaattggactaaagcataagtgccactttagttacttgacagtgtccagtaaaggtccatcataataccactacacatctactcagggatgaataaggactgattggtaagcttttgaaaatttttaagctcactgcatcccttcaggtctccaaggaactctaagtttcctgcctgtcgtgagagacacaaagtgagcttagtgttgggagatggaagctggatggccctcagggctgacccgcagggtgtcggactttgacatatagcagagagcgagcttggcatgatgtgttactccaggcggtagaatcctggaaaagagctaccatgcagcccacgcccggtcgactggaggaccaccctagtggaaaggggacaatctgggcctctggcctgccatgcatacaagcataacaattgcttttgtttaacgtgcggagggaatatttgatctatttcaaccaggcatttgcatcttagtattgtctcaattgccaaagtttgttttaagtctttaacttctacaatagctattttggtcttgttgttagacagaggaggagaaattcttccgttgtaaaaggttttggaagaaggcttagaggaaggtacaggcagcgggggattaaagaaacacatttcaaagaatctaatagggtctgtccctgaaacctcagcccccatatcataaaactggcttaaagaagggaaccaacttagaaaaggggaagaactttgagggtttaagataataacctgtataggattacactggtttagcttacagttgggggatagctgtccctctagtaaaatgaatgtatggttttaggaaattacaaaaaccagttggagcagtctattcttgctctttagtggtccacagaactttggaccagctacagcataaaagctctacattggtgggacaagactcctggttgacactggggtctttatcaaaatctccccggattaaatggtcccaattctctaatgcccagtctgacgagagtcaggagggacagaggtacttttctgaagtagagagctgtctttgccttggcaagtccccacagggtataacaaggcaagcattaaatgcaaaagtttgaagcaaaattgacttggttatgttaataactagatggtcagcaatagagtgaggaaagaagaaagagtattagaatagaagaaagagagagagttaaatttttcttagctttagtttggtagggttttcccttgggactatggcccatgaccctggaggggacggtgctttcttgactcgggtgtgatgagtccatcccctttccactataggaacagcattatcggtggttagcagcacaaggtagggtccttcccgggctgactcgagttttccttctttccaccctttgatgagaacgtgatcctcaggctggtgctagtttaccggaaattctaggggtggtacctctgctaaaagatttttagttttgaggtaaaggccaagtggcagataaaccaagtatataatttctaagaaactgaccttttgttttaaatgtggggacatcagcagtggactttatagtccttggtgccttcttactgagaaatttcctttagcacctatttttattagtttttagaccaaaaaaagccaaacaccattttatatttgacaatgcttcctgtatgatttttataccagataagctaaatttcacctttatattagtgtgttattaatgttaaactcaattttaataaaaccttgtagacctatttatccaattttaatgtctgaccataaagtaagatttttatagactccttttaaccttttataatttttgttaaagagcaggttagtgctttaagaaaaacctgttgtgcttttattttaatgtccagttcacagaaaaactggatgatacacctttaactttagccaatatgtttacacacagaattaccttcacaattaacatttcaaaacttgcttaaacctttaaaagaaaaaattttttaaccttttaatgtatgtaaaaatccacattcttatgcctacttataatccttttaccaaagatgtattttactttccttatacaccttgcacattcactgtttcttcaatagttttacattcaggaggcctaattacttttaaattatgcaacattttttgcataaattccgttttataacttttttttcacgacttttacaattctttgacatgcctcaactttctgacttgttgcaaacatccctttctttaaacaaccagttattttaggacaaaaatttaccatataacattcctttttacataaattctccccccccacccctttttttccccagagatgataatcattcttttccaaagtgaacttccttcatgtctgtggactagaccgtctaaggccacaagattagaagttaggataatgcatgttacactgttaacttttagcaaactttacttttgttgaaaaccttgtaagtttgggatttcaattattctttgcttttaataagacctcattcagtccatattaacttagaattggtatagatgggtctttcctgattctgtagtactttaaggcttggctgagtgcaaatatgccacacatttgagcagactaattattaggcacttttcctaactctgcttctacaagagtttccttatcacttactgaatacccattgtgtctttttccttcagtcacccaggaggaaccatctatcctcctgtcctgaagggagttcctcctaggtttggtcggacctttgtatggtaattaagatttagatcccatgttaggaaacctgctgggttaagggaattttcagtggttaatgttaaatcatctttttctaatggaatagccttatactttaaagttcttaagtcagtaagctacctttttgcttttttttttttttttttttttttggacttaggatagttctgacctgatgtggtgtgctcacaatgaggtttcctctaaaagttgtttttctactttcttctgttaggagagcagttgccggtacagattgaatgcatttaggccatccgtgggttactgggttaaggatttttgataggaaggctatggattgtcagtggcctcagtgctttcgggctatgcccttatttacactgacaacaaggtggtattggagtgttacagggtcatagagaagaccttcaattatcaattataggttttaaatttaccctggcttttaaaggaataggatacactcttttctctttactacttctatctctctatctctctttgactctctgtctctctctctctctctgatttcctctttgtctttctctttatctctccgcctgtctctctctttctctctctctctccctctgactctctgtctctttctctctgtttctctctgatttcctctcccagtttctctttcctctttgctggtctttccctgcctgtgccagccgcttatgctgctgttctcccctctccttccccttcccctaggggagggactggctggagtggagctactctttcttcccctgagaagaaaggaaaggggggttctgaatatttttcttactaccggaggtttgtgtgaggttcaacccccactcatggggatttctcacctctttttgagattcaactccccctcatggggatttctcacctctttctgaggttcaacaccccgccccccatggggatttctcacctctttctgagtttcaaccccctcctgaatggagatctctcacctctttttaacctccaagacatcccaactgaggaatacttcaccaccccctgtggctttctttccctagtcctgactaaggaatgctttaccgcccctgcggtttctctctccttggtatgtcttaaccaaggaatgctttaccaccctgcagctttttcctcagtcccaaccaccaaggaaatacttcaccatctgcaacatccttccttggtctgtacacagaatcatcatggcagtatatgaggatcctttaagctaggtttctggccagtttctttccacgttgctgagggcttgggttattcctcacactgggtgggtcctgatttctcacccctgaggctgccacaagggggcgggccacgcctcctcacgagagacaaccagagaccgccccgggaagggaatgtaatccccggccagccccggaattgttataagtgaagttttggtgccacaaaagaaatagcacttgaatataaaattttctttttaattctcagcaaggcaaggtacttctatagaagggtgtgcccttacacatggagcaatggtgagcgcacacttgggcaagggaggggaaggggttcttatccgtgaccatgtggcccctgctgctgtgtccttcccctattggttagggttagatggcacaggctaaagtgattctgattggctaatttaaaaagagtgacaggatgagtggtttggcgggaaaaatggttatgacagagcaggtaatgggaatgagtcagggtggagcaggtaatcgaaaaaggttgctttacgaggaagttaagtttaaaagtagaagacgaggaattgaacatactgacatattgattctttgaaaagaaatttagaactcatgcctgacaattctcaaaagagcaggaactctattatgaactgcacgtgtgagggatctaggtcatgtgctccttatgatctgaggtggaagagtttcatccagaaaccatctcccccttcccctgtctgtggaaaaattttcttccatgaaactagtgcctggtgccaaaaaggttggggatcactgtcctagatggtataacctaccacacacctaggctatatggcatagcggattgctcctaggctacaaatgtgtacagcatattactatactaaatattgtaggcaattgtaacacaattgtatttacatattataacatatctaaacaagaaatcgtacagtaaaaataaggtacaaaagattttttaaaatggtacacctgtatcaggcacctaatagaacttgcaggactggaagttgctctgggtaagtcagtgagtggtgagtgagtgtgaaggcctatgacattactacatactcctgtagattttataaacacagcacacttcggctacactaaatttatttaaaagttttcttcaacaataaattaaccttagctcactataacttttttactttacaaacttttaggatttttttttaaaccttttgactcttttgtaaaaagagttaggttaaaacccaaacacggctgagcgcggtggctcacgcctgtaatcttatcactttgggaggctgaggcaggcggatcacctgaggccaggagcttgagaccagcctggccaacatggtgaaatcccgtctctactaaaaatacaaaaattagccgggcatggtggggcgtgcttgtaatcccagctactggggaggctgaggcaggagaatcgcttgaacctgggaggcggaggttgcaatgagcccacattgcaccactgcactccagtctgggtgacagagcgagactctgcctcaaaagacaaaaaacaaaacccaaacacattgtagaactgtataaaaatattttctttcttgatatccttattctataagatttttatattttcaaaatttttaatttttaatgctttttaatttttcaattttacttttttgttaaaaactaagatgttgcaggtagtgactatctggggctggtgacacaggtggtaaaggaatttatcaggacaactgtaggtaaagaaaggtagatttattagagaaagtatgaaaataatgttgcaaagtagcaacgggcagcacagcagagaaggggctgtctgcaaagaggcaggggctgtagagaagttttatagggttgtactgagggggctgcatgggtcattgagttatcaggttgtttgtgattagccatctgtcagaagaattgttcgttgttctttcctacctggggctccttcctcattgttgcttacttatcagaactccacataagacacaaacacacacattagcctaggctatatagggtcaggataatcagtttcactgtttgtcacctccacatcatgtttggtttggaggtcttcagggccagtaacacacgtggaactgaaatctataacaatgccatgttctggaatacctcctgaaggacctgtctgagttaatctctaagttaactttttgttgttgctgttaaataagtagaaggaatacattctaaaataacaatacaaatacactattgtaaatacaaaagctagtaacattttcattactatcaagtgttaggtactgtacataattatatatgctgtacttttgtacagctggcagcccagtaggtttgtttataccagcgttaccacaaacatgtgaataatgcattgcactatgatgttatgatgtcactagatgataggaatttttcagcttcattataatcttatgggaccacctttgataaccgtatatcgttgttccaaacattgttatgaggctcatgactatagttacttttcttctcccactttcttatatgtgaggggatttttcttggatctttcatgtgaaaaccttgtcaaaagcctggaaataaaacccgtcaaaatattaaggttgccctaagactaggtcaccagcaactttttactaccaagtaatccatactcacttccagtaatttgtcaaaattatcatgtaagtgttcttaccatttattatgactccagcagcttttgttcaagatacgctgatctgtgctgttcttggctatgattctttctcttctcctgtgtctttagattttagggtgacagtgtgccctgtgatctgaattctctgatgagtcttagaaaagtcatgtatttttggtttatctttttttcttgttttagagtgggaatgatgacttgcacactctgttacatgttgtagctgaaaaccaaagtctgtgttcttaaaatttgtatatatttgttctgtatttcctaatgatcacctctttaattgcttaatgaaaaaatacaagtgactagatggtagatctgagttttacaataacttgaatttactctaaacattttgctaatgacattggcctatttaaacgcagtcttagaattgttttttccttggtataatctagtatgatagatactaggtgatggaattcttgtgaatccattttaagtatataatttaataaatatttttgaggcatgtgtatgccaacctttgtgctaggtgcttaggatacaaggtggcttagacatagccaatgtcttagttgttcctaagtctaatagagagaaaacaagatttaaaaaggtagcattgtagaaatgataatgatagaaaactccactttagtgtggagaaggaagcattagagaatatttacatgagagctgaattttgaaggagaaataggaatttatcagacagacttggtaggaaggtatgtccaggcagactagaatatttaaaggcagtggagacttgaaacaacatggagtaatttgaagattgtaggtggcttgttatttttggaccttagactgtaaggaaggttgttataatgagatataaacagtaggtagaggccagatcattctgaagagtttagccattatcttttagatttgggggattcagtgaaagatttgagcaggtaaggaaagcaatcagatttgtgtacagtcaagttaaggacattgtagagtgtgggctgaaagcatgataaagcaaaggacagagaagggatgatgagaacttggaaaaaatgttactatatataaaaaaagaggatgaatttggaagaccaaaaacaaacaaaaaattagatttagtggttagttgtgggggcaaggaggaaccccagcttccttctttagagaggctgggatcatcaaccaaaatgtaataaatattataagagtagattactaatttgatttttgacaggaatgtatcagtacaattgcccaccaagtggtggaatgtattaatctggaatcgagagtgtagtttggatttaaggtagagatttggaagtgatcaattcatatgtgttaaaaccataccagtgaattaaattgcttaggataaatataaaaattaggtacctttctagataaaactctgggtaacacctatatttaaggggtgttaggagaagaacagccaataaaatgcctatattgaatggaaacttccaaagagggaaagaggttcagaagagaatgtgtcttgggaccacaagagaggaaagaagtagagaagtaattttttaaaataccatccaaagtttgaactaacataaaaaacatggtttgacgtcattatttgtgtgatgatttccttaacatttgcaattttttatccaacagtttttaccactccagaagcttttctcagctagaacgtgccttaacccttaatgaatgttaaatactcatcatatactcagatttacctttttttccttataaatagtacttttgtatttgcataagtggtagaccagattcctaatctgttcgatagtacttttctttaaaagtgatcagaaaaattctttttttgaaattataatttcattaatgacatagcaaataccatattcacaacctgggcaattaacatctctggagctttagggatcaaatttaatgaaacagtaataagtactaggtaattaaggatgattgggagggtaagttttttgtcgttctttctaattaagtccagggtttggatgagaacactagactcaggagaatgttcccagagaggtggtataacttgtatgaaaaattagagtctgatgtgtgtattgtggtgtgtgtttaggtgagggtaaagggattgtggctagaaaataataaaaggctgaagactatagaaatttgttatcattgtaaagtttaggtagggcagaaaaaatatgtgaaggtcttgaaatctgaaaagtatagatttaataataattttatctcataggaactgtaacatattgataatgcccaaagtctttaataggtagtggaaaagtttaacttttttacttaggatattctatctaattaatggcaccattaaatattactagcatgcaccattggagaatgaatgctttgtaagtgaattctgactataaccaatgcaatggaaacatgttagactaggagttgagctcaaccaaggttttagttctcctctaaaccgctagccacagagtagggatgtgtttttattctttactgtgcaccaaatgccagcctggagatgctcaacacttcttggacgatgaaatgagtagatgtactgacaggtgaatcattaaacacgaatggctttttgtttcttcatatgtaaagtaagaaagatgacaaggaattctgttaggtcatctttgaatttcttacctatttttatgataatatgtactttggtacaagtaccctgagaacttcaaattaaattcttttgaaagaaataaaacattttgttaaatacacatcttttaaatgcaaattgaaaaccaagtgtccttgtatttcagaggctttttaatatagataaaatttaaattgagttctttagccaagctgaataaatgtacaaggtaaaaatgcaatctcttcataagtttcacagagtaaacactggaagttgcaataataaatatgtaaagtatttgtttttattacaaatgtaaaggattagaggtagtttaacatttggaatgcaggtattaaagtactgtaatcaagttggaagaagcagtataaatctgaaattttctcagtaaccagttgaatacatttagactagagagtgaatcatttatttcagttcaaagttgcagtgtctgagttgaaccacagaaggaataaaaaagtccacatttgtttaagaatagcagataactgaattccaagtgatagcctgtgattttcgaggcagtcagaaaagtttcacggaagctaagtgaagggaaagccaaatgtcaaatgtggcattccttcattaagtaagcatttattgataccttgcagtattctaggcagagggattgaagaaggctaaccatgatgacctctctaaggctattgaatttgccagtaatacacttacactaagtggtcctagtgaacctaaatctcaagtctgctattttcttaatgcccattttcttatccaaataacttgtacattaggcttgaaactgctttacttagatgtttattttttgtaactctaaatatgtatcattgcttttaaccatttttatactatgaaaagggatagccttctgttgcaatgagatttgtgaacgtatattttaaaagaaatatatcaactaaacatctggttttggatactctgtatcctctcttccactaatttttaaaggttttcctcatataatctacttcttcgctgtggttcatttatttttttcctaattggaagatagcaaaagagttggcagcatacatttctatgtgactttaagcatatacagaaatgttgcaacttcagtctgattaggaataataataaaataatataaatacaaataagaaataaaatagaaggggctccaaacctctttaaagtatttttcttttgttatacccatttttttcttatatgaactcatttttatgatatagtcttgtcattagggcaaatcataggcttgaattaaaagatcagtagacactactttattttttttaatttttgtcagcccccatctattaacatatctttccttccatttctccagcctagtgccttgtaacaataggagctctataaacagtacttttttttcctttctttttttttttttttgagagacagtctcactctgttgcctaggccggagtgcagtggcacaatcttggctcactataacctccacctcctgggttcaagtgattctcgtgcctcagcctcctaagtagctaggattacaggcatgtgccactacgcccggctgatttttgtgtttttagtagagatgaggtttccccatgttggctaggctggtctcgaactcctggcctcaagtaatccgcctgcctcccaaagtgctaagattacaggcatgagtcaccacacctagctataaacagtacttaaatggcgagttagcactttcttgtgaatttctgtaatacactctattcttgccctactttgcctcctggccagattaattcagtagcagctactattgaagagaattaacctaggagtgaagttgaatggtctcctcttggtcttcactgatatctttgtgggtggctcccccactcagccttctctgtttctaccccagcagaagattgggacttctttttacagcctacagaggatggacatctagcttcaccacttggcctttgctggcagggttggtgggggtgggctgctgtttttttctgtggtggttagctagagtggagtggttattgtcgaaaagcttctgtcttgctaggctgcccgcttcctggatagagagggcatgcttttcttggggcttttcttttctgggtctcctccattggcgtttttgcgttgctggtgtctccagtatccagtctgaaatacatgagacaaaaagaaaacccaaagtattgatcatcattttgttccttggatcctgagctcccttgtcagactgccaccttctctccttcttctgaaaacagttttgcaggaacatataatttaatttacaaaagttatattatgcataacctaagaagagttgacactgtagttgctcactaattacttgttgaattgaaatcaaaaataggtgcgtatttcttgagatatttgtatccatctgagatctttgtgatttgagaaaggaagaggtgagtaaaataaacacctaaagcagttctaccaaattaattttcaaatcaacaatttctacacctttagtaaacaatttataatttagaggaggaaagataaaaagtattatattgaacaataacctcagtcttttaggattgttacatgaaattcattttggatgatcatttatcttttaattcttctagtgctgtagattaaatgagtctggtgttgtattactacactatagctcctttgtggagccagtggaggctttctattctaaaccataagttctcacttattttgaggctgtcccacaccctgaaagataaagtttcaaatgagtcaggtgatcttttcacaaatggaatgagtgctcagtttacattttttttaattatactttaagttttagggtacatgtgcacaacatgcaggttagttacatatgtatacatgtgccaagttggtgtgctgcacccagtaactcgtcatttaacattaggtatatctcctaatgctgtccctccctgctccccccaccccacaacaggcctcggtgtgtgatgttccccttcctgtgtccatgtgttctcattgttcagttcccatctatgagtgagaacatgcagtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacttttggcttggttccaagtctttgctattgtaaatagtgctgcaataaacataggtgtgcatgtgtctttatagcagcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgtttgtctattattggtgtataagaatgcttatgatttttgtacattgattttgtatcctgagactttgctgaagttgcctgtcagcttaaggagattttgggctgagacaatggggttttctagatatacagtcatgtcatctgcaaacagggacaatttgacttcttcttttcctaattgaataccctttatttccttctcctggctaattgccctggccagaacttcaacactatgttgaataggagtggtgagagagggcatccctgtcttgtgccagttttcaaagggaatgcttccagtttttgcccattcagtatgatattggctgtgggtttgtcatagatagctcttattgttttgagatacgtcatttcacaaatgcaattggagtgttcagtttacatttttaaaagtacttttaaaaagtacttttaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaagtacttttactttcagcttgagtcactcttcccaggctttatccaggtggcttaggttagctagggctgtgtcccgtgatgtacagtccctttacacaatgttggagataaaacttggcctcatgtcttgcttcatattcccacagcctctcagagtcctgtggacaatgactagggagacaaaccatgcaagcaacatattttttaaaaggtcagtttcaataatgacttaattttaagttataatttcatggaacactttcatcactttctttttcacagtattttacccagttattaattaatctaagtagtgtatcttcgggaggtaagacagttatttccattttatagatgaggaaatcaagaaaagtcatttagtttatgacttatccaagagcattcagtgcattgagattggaagtggaacaacagaccaagattggaactctaaatgttttctttaaccaccatcctgtgcttagcccaatagaccgtgcccgtaaccaaattaaatttatatatctttcacaatgagagcaagggggaagaaaagattatccaattagaattttgttatagacatggtctgtaaatatctaatttttcagtctgatgcatcaagaatgttaaatcattatcatatctcctgtttcatatgtagcgtaataaaaagcccgtaatacaagacaataattttaaaaaaatattttcttgttaagaaatatggcggttatttgaaaataaacaattccatttaattttttacaatgtaaagaaaaatgtgatacgtatataacaaacataaatatagtacatatacttgtcattagatatattctatatctgcactttatatatacatacacaatataagacactgaaaatttgggataggtttataaactatcgatgctaccatgtgaaagaatactgttgtgtgaaataattggaatttgggaacaggcttatttaattttcatttcatctttgccttcccccttagtttaaatgcatttaaatatttatctaaatacagtgtcagattgggctgctataataagaataccatagactgggtaacttaaacaacagatacctacttttcatagttttagaggatgggaagttcaaaattagggtgccagcatggtcaggttctggtcctggtttccatatggcagccttcttgttgtaccctcacatggcagagagaaaggaagcaagtgttattgagtctcatataaaggcattaatcccatcatgaggattctactctcatgacttaattgcatcacaaaggccccaccacctcataccatctctttgagggttagggtttgaacacatgacttgagggaacacaaacatgcagcccataacatatagatatagtttctttttagagtagtttgttatatgttggggaaaagttaccactcaaaattaagggcctgaattctagattcatctcttattctgctaaatatgttgattatggaagcacatttgcaggattgtctttgagagttagcatcctgatgtagcaattcatttgtattgtaacatcatggagatttcttttgtgatttttctttttcacactttctcctattcctgagattctctttttgcactctattaaaattcaagtcaacatcagataaagctgggtcataatgtattgctttttcagtcagcggcttctgtttttcacattgagtattttctttaaaatgactcagtttgaggtgatactaaagaagtttaaaattagagaccatagctcagttatctaagattagcaatgcctataataaaactaaagtattatcaggcacaccagcttgtgcttacagtcctagcattttgggaggccaaggtaggaggatcacatgaggacaggaatttgaggccagcctggtgggcaacatggtgagaccctatctctacaaaaagtaaccagaaaattagctggacatggtgatatgtgcctgtagtcctagctacttggaaggctgaggtgggaggatcgctggagtccaggaattcaaagctgcagtgagctatgatcacaccactgcattccagtctggatgacagagtgggactctatttttaaaaaacaacacaacctatttattataccttttatttcccgagtccaaattaattcttcctatgtttgaagtcccatagtatttgattattagcatttattttattttgccttatatgagctgtttacttgatcctcacagtgtgtaatgaagtgttttacactttgcctattctcaagtacatgttttagattaaatttatccccctaaaggaaagatcaacatgtgacccctttctgatatctggtcctttggtgtggatatgttgattttgtttttattccagcttgcttctctttagactatcaaattatagattcatttttagttttactttctattaatagtgtacttcacctagttagattgttttcccagtagtcttaatttctcatggtaaaaatagattatcatttctcaattacttctaaatataaattccattctaataaatgccatttagatatccaatccaactataacagtgcctaccacacaataggtgctcaaaaaatgagtaaatgggtgaatgagtgaactaacaaatgctccttactgcctgtccatttaatagtttatccgtgtaggtatttatcagtatggttgctatgttcatgtatttgcagttactaaaaattcttaaactccttagcggtaaaggctgactctctgcaagtgggcgtgaacatgctacctcaaacctattaatttaagatgtagcaagttaatattatccaaagtacattgatagtctaagacccactaagcagaattgcatggaattgttatatagattaaatgaggtataatgtgtgtttgtaaagggagtctatataactgtaaagtactacaccaagattagtttggttaagaacacttttattaatatggaactaataatacatgttatataatattactgaacagtaactacatttcttagaatatgcagtgtatgtttgagcaaatagactggattgtataaattgtcaagattggaactaagctcttcacgagtatctaattcttggtaaggtgtcttcaggtgttcctaaataattggaagatgtaattatgagaaaagttataaatgaataataactaagtatgtactgttgacagatcattattgaaaagcaaatttctagatgtcagcactacaatttaaaagtgaagctttttattttgaatgaaatattagtagtttgggtttatttgcacaaaatattcaaagactggatgttgaaagattaaatttgtctctagagattatttaagaacaagactagattttctgttcatttgaaattagaaatgaaggaaacaagtaaaatggtttatagttgaaaacatattgtgaattggaaaggatttccagttccactcaagaaaacatttaagtccattagtaatgtctggccttttaattttaagccaagaacaatttactaaggatagtctaactttaaaaaaaatcactgtgaaatatgtttcttggtttacaattttgagtgtttggaaagctatataatttttttcttacctcatacaaaaagagagcatttgtcatttttctataaaattttattttcactgatgtcattttgttatgctccttacatttgtacaataggatagtacaaagtactgtggtcttattattcaatggaaatgtggcctttcagggatcatttgctttctagaactctatttaccagtagttatgaacaggttgtgcttcaccgttaggttgatgtggttgcaaggcagcattttaaaaagagaagagttttaaatatcatgcttggaaaagatctgaaggacagttaaaatctaatgtctaataaataaccattttaatgcagatatcatttttaaattgttatatttcgttccctttctttagtataataagtccattagtcatgatttcttttaagaactacttaggattttaggcagataaaggcaattgtcttaactgctagacaacatacagtatatttaaatacatatgtatgataaaaccttacacttttagatcagacccttttggaagtccaaatgtggtgtgcacactggttgaatagaaattcactattttttgtttgtttgtttgagagacagggacttgctatgttgcccagggatcctccagcctcagcttccggagtagctgggactataggtgcactctactgcacccagctccaaagttcacctctgtattgactttgtggagcaacttgcttaacaaatcaataattatacatacatttcaaaaaatatgtttagccttgctaagagaaaaacaaaatctttcaaagaatcattaagcaatttcaattgcatttgtttatatacaaacaatacactacttacagtttctagcataacttctttgtatatgctcatttctgtaacagtacaaggctgaatgagggaaacatataatagagaaatggcaagctgactgaaagatagagttaaaatagtttcttaattctgtttgtactttccaatatggtagccactaatgatgtgtagctgttgagcacttgaaatgtgactagactgtagtgagatgtgctgtaagcataaaataacacaccacattttgaagatttgatgcaaaaagaaagaatgtaaaatatctcactgataactgatatgtattgctatgttgaaataatgttttagaacatacagttaaatacaatgtattattaaaattcatcttttttaatatgactactacaaaatctaaaattatatatgtgcttgtatttctagatagcactattaaacagcactgatctgtatgatcttaaacattacaatacaattatatattggataactgcagctttagcttgcgttctaaaaggagttcagatgttgtacctgttttggcctcattttccttctttatattctctctctcagcctcggtccagtttgagagctgttagtgttccagcataagattcttttcttaatcctccttttttttttttgaagactgagtctcactctgtcacccaggctggaatgcagtggtgcaatcttggctcactgcaacctcctccttccgggttcaagtggttctcctgcctcagcctcctcagtagctgggattacaggcgcatgccagcatgcctggctactttttgtatttttagagacagggtttcaccatgttcgtcagactggtctcgaactcctgacctcatgatccctccgcctcagcctcccaaagtgctgggattacaggtgtgagccactgcacctggccaatcctcataatattttaagatgatttcatcttccttcctctagaggtcacagacattggaaagtcattccctaagtgaatatgaataatactatgtgtttcgaagaggtgaaatgtgtggtctagctacctttcagattctccttttctctcagaggaaggcttttgcctgcatggttgtattgtcacaatctgtaacttatagttcagattcaaaaaccccttttcttactggaaaacgtatacaacaacagggaaaattaaaaaattaaaaaaaatagcataaatgccatttttagaaggcagaaaaaagtctgcaaaccccaaagtgctacttaaagtgattgaaacccagcagagccatgggtaaaacagcactgccgggcagagagctgagaggccagcgtggtgacagatttcagaaagcaccagcactaagggactacctaaaggcctggcaccagccctaaagaccaaaggctggagctggagctaccatggtcaaagctgagatctggcattaggcaatagccacttagtcaggggaaggaggagagagaaacagaaggtgtgggaaagtatctagtaggatcagacttcagccagcaaacagagatacattttctgaagttcaggggtcatcttgtagagtagggctgttactcttgggacaatggtcagtgagctaactaggcaaccccggggagctaagctggctgcagaagccctcctggacctagtgatgcaaaaaactaatttgaaaaagatagtttcacctgtggcatggaaaagagagcccttgaagattggaaaaggctgcctttatccctcctttccccagcccttccctctctggaacctcctacctggtccaggaaaatctaatcttttcagccagctttgtaaccataagttacaaagtgtattcatatggcatcagttcaagcatactattaaaacagaagaaaaacacatgagaaagaagcatactggcagatgaattcttctctggtccactcctcgaaactgagtgcgctagtgcttctgcttgtctacttagatcttgatttttttggtttcttttattaaaacataatattttgaagagtagaatctgttgttccagcacaaaatgtagtatctacatcctagaaggccttttgtactttagagatcgtgtgaatgctttgggtaatagcatttatcatgattggaaaaggattgccatcagtctctctagattaggaaaaagtggtctcagaatggtggattttttacagtttgccttttttttttttttttaatgttagggaagctatgaagtgtgcttattattgccaaattcacctactcaaggctactttatgcatagtgtgtggcattcacccatgagtttcaggcagggaaacaggcactgacattaaggatcccagacagtttgctactttgaagcattaaatgggtagttacctgttcaattttttctgcctttttacttaggagacttttcatatgttgaaagcacaaagaaccaagtgtaatagtgttcacatcttttctagatagcatgttcctttcaggtgaaggctcaagacctgtatactccctcccccgccccacccctccacccccaaaagaataaaaacatactccaaattgcatgtgattttaggtggtttgaagatcctttaaagcttctccatgggccctgagttaatagctcccattttaaagagtatactttttttttcttcacacagtggaatcttttggacttcttgtttctagagggtcagaaaggcaggctctggatttctgatgtcatcttttcagttagttgttatatttaaaattggatttacaatttactcatcttattgactgatacaataaaatgtaaatgattattagtgttttgcttataaattgcttgactaatttttgcctactatctaaaacatttgccaaaatttctcaaataatcaatgctaagcttaattcatcactgttaagtttaattcatcaccttcttcctctttaaaggaattgacttctctttgtgtagtcatattaacaacaggtattttaatgtcttcgtcgtttgatgaaggattggcagacctaaatatataccagtttggtattatttagttttaaagtaatgattcgtgtgataggttcttgctggtttttaaagtgtgtatctaaaaccatttatgagtaaatttttatataggtaatttaattccaaaaactatgtcaagctaagttaaagaagttataaaacatttatttgtgtcttttagacatagaaagttgtttcactttattttaagcttccttgatatttgcttaagttacatttttaccttgtgaaatagttggaaacaagcatgccattttcaggtattacagtagaattctatttgaaaaagtgctagtcgaaagagttttttttctaactttcagattgctgcttggaaccctttaaattacagaatcatattaatgtgcctatgttacctgatatctgacaaggaatctattagtgctcttccttatagtgccagttctttgtatccctaagttatttatataaaatagataaatttacagtgtctttttttcttcccactagtcatgtgttttatctaatagtaaagattataccttgaaaaataaaatacagagggacctctattttcttgtaaaatttatctgatctcagagacaacaccttgctttacctcattttaccaccaaatacagagttatttcttttctaccaaaaaaaagcacttcaatgcattgatgacatacttatctcattgatgcatattcattctaagacttgtctcatgatgcttgcttgctgctgctgatttgcttatcttaattttttcttaaagtcatgagaacaatttttgtgtttttggactcaaggaatattggcaaattcagtttttgcttggcttcttaactgaagtctctttattgttgggatctcttatggtattctactcatttctctttccttctctactctccattcttcctactgccccaaataattcacatataatcacattagactcctgacacagaagtgttagtcttagagaggctcttttacatatcaaccccattttgagtatcacctgctagaaagtgaaaggaggctctgagtttttgagttccataataataacaaccaaacttcagaaaatgaagtggaaaatttcagtttgaccacagcaataaattcactttatctgtgctgaccatagtcagaacatttgcaaagtgatgtttcttgactcttataccacagatgacttcagatgtgttagtaccagctaaggatgtaataccacagcatttaaaaattttgcatgaatacctctggtttctttttcttgaactaaattaaggaagaattttaggaagctgttaagcttcttcattacatatttctatttatgcttcatctgtcatctcatttataggaatccttccttaaatttccctaagaccaggtaatctttatcttgttcagatcatgtcagaactttagctgtcagttttggttttgcataccaaaatattttagggaaaagtaatctacatataagtttgcttcatattctttcactaaaaaatctgtattacatttctcaagtatgttttagactgacattataccactggttagtttttctacaaggagatatgtgtcattttttgtttgtgttgctttttcttatctaccgagcaaccattgatcacctgccatgtgtcacacactatgcttagaggcttgggattatgatataaaatgtcttatgatgacacttgacagcttttgataagagactcttaaaatatgaaatttttatcagtggtttcaatgttgagtcatagtgcatctaaaggaattccataaaaccagcaatttagtgttagggttgagaagtctttagtaatgagaagactactttactacatggttcatgtgagcctgtaatcaaatttaccagtttttttttttaggtttcttcaaacttgctgccctttaagatgatgagctcccatgagttgggggagctctacctggtccagagtctgacatatcctataagtaatatataatatgatcaattaatggatgactcaaagagggtgaagatgggaaagagccaagatgaatagaagtttggcctagttttcctcccctgttgttgcctttctctttttttctctatttccctttttgagaagcagaccatgttgaatgaagataccctctgaagaggttggatagagcttttcaggcccaaactgattttatcacttagatttgattatgttctgggagattatccttaaccaaacttcttaattattatttgttaatgaatttggggagtatccatgatttattaagtggaaaaaaattaagatgctaaatgaaacatttcatatcttctcattaggttaacacacacttagataaaagtttcatgtctctttgatcataaaggagagtgaaatgattcactcctgtcttgatcatattgaatatcataggaaggaaaaagagaagattattaatagttgcatgacataccttttattgtttggcttgttatgggcaggtattactctggtaattaaacaaaatcaataaaatacataaaatttaaacaaatcacagcaacaaaacaaaggattgaagtctgtctttttttttttttttttttttttttttgagacagagtctcgctctgtcacccagggtaaagtgcagtggtgctatctcggctcactgcaagctccacctcctgggttcatgccattctcctgcctcagcctcccgagtagctgggattacaggcgcccgccaccacgcctggctaatttttttgtatttttagtagagtcggagtttcaccacgttagccagcatggtcttgatctcctgacctcgtgatccgcccgcctaagcctcccaaagtgctgggattacaggcgtgagccaccgcacccggcctgaagtctctcttttaatataagcagtcacactggcctctatgcaagtttgcctatgtacaacacaatattagatatattagaaagaggccaaagcttgccaagcttaaggtgggtcctggtatatccttccttgaaacaaggtacctaataatctacattagctaaactgagagataccacattagtgattctttccagataaagtggttcatcagcttcccctggaaagaattgtggcattactcatgcttgtttacttatttatttatattttatttttcaaacttttattttagattcaggatgtacatgtgtaggtttattacctgggtatattgtatgatgctgaggtttgagatatggacaatcccatcacccaggtactgagcatagtacccaacagtttttcaacccttgcctgcctcccttcctccttcctttagtagtccccgttgtctgttgttgccatctttatgtctatgagtacccagtgtttagctctcacttaggagaacctgcgttttctgttcctgcgttaattctcataggacaatggcctccagctatatccatattgctacaaaggacatgattttgtcctttttatggctgtgtagtattccatggtgtatgtgtaccacatgttctttatctagtccaccattgatggacacctaggttgattccatgtctttggtattgtgaatagtgtcacagtgaacatgcaagtatgtgtgtctttttggtagaatgatttgttttctttggatacatccccagtaatgggattgctggatcaaatggtagttctgttttacgttctttgagaaattgccaaactgcttcctacagtggctgagctactttacattcctcccaagtgtagaagcatttccttttctccatagacttgccagtatctgttgttttttgactttttaaataatagttgttcttactggtgtgagatggtatttcattttggttttgatttgcatttccctgatgagtagtgatgtggagcattttttcatatgtttgttggctgtttatgtgtcgaattttgagagatctctactcatatcttttgcctatttcttaatgggattatttggtttttgcttgttcagttgtttcagttactgatagattccggatattagacctttgttggatgcatagtttgcaatatattcttctattctgtaggttgtttactctgttgataatttcttttgctttgcagaagctctttaattaggtcccgcttgtcaatttttgtttttgttgcaattgcttttgaggacttaatcataaattctttcccaaggccagtatctagaattgtgtttcctaggttttcttctaggattcttatagtttgaggtcttacatttaagtctttaattcatctcgagttaatttttgtttatggtaaaagataggggtctagtttcattcttctgcatatggctagccagctatcccaggacaatatattgaatagggagtcctttcctcattgcttatttttgtcaactttgtcaaagattagatggctgtaggtgtgcagctttatttgagttttctattctgtttcaccagtttatgtgtctgtttttgtaccagtatcatgtggtttggctactgtagccttgtagtatagtttgaagttggataatgtaaagccttcatctttgttcttttgcctaggattgctttagctattcaggttcttttttggttccatatgaagtttagaatagtttttttctaattctgtgaaaaatgatggtagtttgataggaatagcattgaatctgtagattattttgggcagtatggccattttaatgatattgattctttcaacctgtgagcatggaatgttttctatttgtttgtgtcatctgtgatttcttttagtcatgttttatagatctccttgtaaagacctgtcacctccttagttagatgtattcataggtttttttgtgtgtgttttttgtggctatcgtaaatgagattttgttcttgatttggctctcatctcgagcattgttggtgtatagaaatgctactgattttaataccttgatttgtatcctgaaacttcactgaagcccaaacttattaaaacaatgtctctacagcatgagaattagaaacaaagagccagagaaagtgaagtttgattaccagttgtacttacaatctgtgtgcctttagataaattggtcatttccattagcttccatatctattaaatgaatataatcatgggacctaattcatggcattctttaaaaagattaaatgacaatcctaaattcataatactaaaagaatattcaaattaaattaatagcagagagaaaagcaatgtaatataaaattatacttaacacagagccttgcatattgaaattctcaataaataattttttgttgttgcatttgtaattatcagtactaatttacagaaacatatgcttactaatatatgctatatatataaatatacacacgcatatataggataaagtacacacatacacatacatgctcagggctgccatttagaccatcttatttgtaatctaactactcaggaaacttaattagttatcagaagttggctttgtgaaaatgtgatcaaagaaaaagagttagatgatcctggaggatagttcatccaggctttagtagagcttggaaaattaggccttccacattactacatacctttccagcattcatgttactcatctttgctaattatatcagtgagtctctgccttcccctctatccatctaccttcttcttcttcttctttattctttcttcttcttctcttctttcttcttcttcttccacttcttcctcttcttccatacgtaacattcatacatacattcttctttcatgcatataccatttgaactctgacagatttatatttttgaactcttgtttgtcattaaccatgaacttcaatatttcatgcaaggcaattaatttttgcttccctttttaatatcatgtattttccaaatatgtataccatggttttttaatgcatgcaactaatttaaacatcaagtaagcatgtatattatttcatttaatcttcaaaacatctttgtgaaataagtcatatctattcatccaacaaaaatactgaggctaaataggagttaaatgagttgcctgaagttacatagttaataagcaccacagttaggaatcctgtctactccatgatttcaggcccacctttccacagcttcaccacaacctgaacagaaaggtcctagaaatccccatttatgaatcatctctcttaggatggattacttctataaatatgttcattttgtagtggtttttacttgactcaacttcataataacctttcctgaccttgtaactgcccccccttattaactggcataatggaagaaaataagagattacagatccttgagaaaagaaagaaaaaagaatgtcgcaggtgggacggtatctaataattggaggacagctttagcaaggaggagatgaggaaggaaaactgagaatatatgtctagaaataacaggtgaattaagggtggaaaaacctggagatcaagattggatgttctccattcaattagaaatgaaagtttggggaataaagaaagggatgaatatgagagataaggaaacttggaggaaggaggcagtctgtaacaatttctgtgggaacctcagcattgaatcaagcagagaagtgtgtttgaagttgttgataaccttgtgctttaggaatagatttttctggccatttttttattgtgataagatccgtgaaccatgaaatttaccattttaaccaccttttttctgtcatgacagcctactattcagcattgaaaccattttcaaatgtacaaatcagtggcattaagtgcattattaatttcctgccactattttcactttccatttccagaactttctcatcatcccaaacagaaactctgtagccattaaacagtaactcctcattcctctctcttcttcacccctggtaaccactattctattttctgaatttgtgagtttgcatattctgtataccttatatgattcaaaccatacaatatttgtctttttgtgtctgacttatgtcacttagcataatgttttcaagttttatccatattataacatgtcagaatgtcattccttttaaggctgaataatgttccattgtaggtgcataccacgttaaaaaaatccattgtgtttttttgtttgtttgttgagacagggccttgctctgttgcccagacctgagtacagtggcactatcatggctcactgcagcctcagcctcctaggctcaagtgatccttttactgggactacaggcgtgtgccaccatgcctgggtaattttttattttttgtagagacgaggtctcactgtgttatcaggctgaacttaaactcctggcctcaagcaatcttcttaattcagcctccaaaaatgttaggattacaggcatgagccaccgtgaaaaatttattattgatgggcatatgggttgtttctgccttttggctactgtgaataatgctacagtgaacattggtgtacaaaataatcaattttaaaactacagtaaaaatcttttatgaaattgctgttttaattattgtttcatactatttaagtcattcggaaagtctgataaatttgtgtgaggaaaagagagtattatatgactacttttcacatttttgctgagcatattctaaggttgtgatgaccataaactgcttcagaagttcatcatctaatagaatggaaaaatattattattattagatctctgtctcactttttgggaataatctaattaatttcaccacgagggtaagtgagactttaagtcacttataaagagtgatcctagtcagctatgtaattgtttatactcatcattttaagacattttagagttatgcgtactacataacattgccagcgctgtgcactgagagttactttattaatggacatctcatgctttctcctgttatcagctcagcacatgagattctagaactttgccttgaatgcttagaatagaacttagtcatgctacggaggttgaactccctcatactttatgttaacttttaacttttagttgaacaatgcatatatctaggataagtgtagttatttataaacaaaaaacttaagactgacaatatagccttctagttaatcgcttttaaatttgaagttattaaaatagttttagtatatattattagtataaatgtgtttagagctgatatcaaaagaaaagataaaataaattgtaatagctgaaattattttacatgagatactcagctaagtaaaaagtttgttcaaggccttttacaaatgatagctagccagtagttactctgtttgaacacaagaatataatgactcagttaaggtaagtactgtctgttaaactaactcagtaggctgattcatatttatacagtcatgaaaatgataaggaattaattacttaaaaatcaagatagctagcaatttttcatttctaataatgataattcaatacctaccaaaattcatatatatttcatatatatatttcatatatatatcatatatatgaaatatatatatcatatatatatgaaatatatatcatatatatatttatatatatatatttcatatatatatttcatatatatgctatatatatttcatatatatagcatatatatttcatatatatatcatatatatatttcatatatatatcatatatatgtcatatatatatcatatgtatttcatatatatatcatatatatgtattatatatatatcatatatatgtatttcatatatatcatatatatgtatttcatatatatatcatatatatatttcctatatatcatatatatgtatttcatatatatatcatatatatatcatatatatatatatgtatgtatgtatatatatttttttccaagacagggtctcactctgtcacccaggctggagtgcagtggtgcagtctcggcttactgcaacctctgccccctgggctcaagttatccttccacctcagcctcctgagtagctgagaccacaggcatgcaccaccacacctggcttgttttgttttgttttttgtatttttagtagagacagtgtctcatcatggtgcccaggctgatgtcaaactcctgagctcaatctgccgacttcgacctccaaagtgctgggattacaggtgtgagccacagcacccagcccagaattcatatttatttttattttattttttttgagacagtcttgctttgtcacccatgctggagtgcagtggcataatctctgctcactacaagctccgcctcccaggttcatgccattctcctgcctcagcctcctgagcagctgggactataggtgcccgccaccacgcctggctaattttttttatttttagtagagacagggtttcaccgtgttagccaggatggtcttgatctcctgacctcgtgatccacccaccgcggcctcccaaagtgctgggattacaggggcaaaattcatattttaataaaagggatgcatatctaatgtttactaatgaattattcaagttaaaattaatagtcactatagtaaagaccaatttaacttatattctgtaagtgagactgaggtgattctttgtattttgattatagttcatgtttctgtcagcattttgtagagagttctatgaagctgaactcatccttgaaatttagaattgccataattctttttaatgtggaatataacagtcagtctttctgggatctgtaatttcaaaaacaacaacatttttctttttgattgatcatagctattattggaacagctggtaacatgtgacatagtactataatttagactgaaaaaaattgatttgtgaattatatccactcagcttaaatttctctgtttctagtctccagagcatcttttgtacttctttttctgcagaaacggcttcctaacataatgttcttacattttcccaggggaagaggaaaactccatagtcaattttcttacttgtctgaagtataaaaaaagaaactctttacacaaaaatagagggaaaaacaaagtaagattcagaatttcccaacacaggaaataaaagatttattccatttaaccttttaacaaatgcactttacacattttgtgtgtgtgtgtgtgtgtgtgtgtgtgtgtgtacttcaggatttctgttcatcctgcagtcaatgtcaaggagatgagaatttatgaatatgatgattcagatgatttcagatttgagactaattcccacataaatcattctcccctctcatcttttgtaggtaaaagtaagccatagaatagtttgtaggatcattagataacaagttaggtagggaactattttgtatttaatgatttccctgttaaaattcacttttcaactatttacttaagtattcaaataataaatcaactatccatttagaatgatcaggaaggatcaatttagagatttttttattgtaaattgacaaattgtcattacgattacaatatttatgaggtacaaagtgatgttatatgtatacaaagtagaattattaaaccaagctaattgacattcttcacttcacataattacacttttttgtggtgagcacgtttgaaatttgctgtcttagcaattttgaagtgtagactacactgttattaactgtagtcattatgctgtgcagtgtatcccaaaaacctttttcttcttgtctaattgaaactgtacgctttgatcaacatctccctgtttcccccatcccctaacctttggtcaccaccaaccattcaactctcgtctataagttagattcttttcaatttcacatgtaagtgagaacatcatgcagtatttgtctttctgtgcctgcgttatttcacttagcataacatcctcaagattcttccatgttgtcacaaatgacagaatatctttctttaaaggctaaatagtattccatttgtttatgtataccacattttctttatccattcatctgtcaatgaacatttaggttgattccataacttggctattgtgaatagtgctgcagtaaacacaagagtgcagatatctctttgtcatactgatttcaaatcctttagatatatacccagaagtgggattgctggatcatatcataattctacttttagtttttggaggaacctctatatagttttccatatggatgtactaacttacattcccaccaatagtatacaaaaggtttcttttttccttgcaaaaactggttatcttttgtcattttgaaaatgtggtggtaggtatgaggtggtatctcattgtgattctaatttacatttccctaatgcttagtgatattgaacaatttttcatatacctgttggccatttgtatgttgtcttttgagaaatgtctattcaagttctttgcccatttttcaatcagattgttttcttgcttttgagtttttttgagttccttatatattttgggtattaatcccttatcaaatgtctcgcttacagatattttctccaaatctgtaggttgtctcttcactttgttgtttttttgctgtgcagaaggtttttagtttgatgtaaatccatttgtctatttttgcttttgttgcctgaacttttagggtcaaattcaaaaaatcattgcccagaccaatgttatgtagtttttgatctattttttttccagtagttttacagtttcagatcttacatttaagtctttgtcttagtttgtttgtgcgctataacaaaataccacagactgggcaatttataatgaacacaaatgtatttctcagagttccagaggctgagaagtccagagcagggggctggtgtgttaatcaaggggctagtatgtgattagggcctttgtgctgggccatgctgtggtggaaggtggaagggaggagagagagggagagaacctctgtcaaaaatcaattgaccataaatatgtggattcatttctgagctgtctattctcttccattggtcagcgtatctatttttatggcagtaccatgctgttttaattactatagctttgtaatacagtttgaaattagtagtagtgtgatacctcccactttattctttttgctcaaaattgccttggctattcagggttttttgtagtcccataggaattttagaatttttttttctatttttgtgaaaaatgtcattgtaatttcgatagggattgtattgaatctgtaatcactgggtagtatggactttttaacaatattaattcttctaatccatgaacaaggagtatctttccatttacttgtgtcttctgtttctttcatcagtgttttataatttttcgtgtgtaggcctttcactttctaaatttatttctaagcattttattcattttttaactattataaatgggattgttgatttcatttttggatagtttgttgttaggatatagaaatgctactgatttttgtgtgttgattttatattctacaacttgactgtatttgtttattagttctaataggtttttgtttttgtttttgtttggtagaatctttatagctctctccatataagatcagcaagtatcgacaatttcactacttcctttcctatttggatgccttttctttctttctcttgcctacttgctccagcaaggacttccagtactgtgttgaagagaagtggtgagagtagtggtctttgctttgttcctgatcttagaagagaaggtttcaactttttattgttgaatataatgttatctgttggcctgtcatatgtggtctttagtatgttgaggtacattttattcgtacctatttgagaattttttctatcatgaaaggatgttgaattttgtcagattcttttgccatagctaatgagatgatcacttgagttttgttcttcattttgttaatgtggcttatcacatttatagacttgtgtatgtttaactgtcctttcattccggggataaatcctactgattgtggtgtatgatccttttaatgtgctattgaatttgatttgctagtatttcattgaggagctttgcatttacgttcatcaaggatattggtccatagttttcttgtaatgttctgtctggcattggtatcagggtaatgctggctttgttaaaagaatttggaagtattttctcctcttggatttttgggaagagtttggtagtatattagttctttaaatgtttggtcaaaatcagcctgaagccatcaggttctgggattttctttgatgagagactttttattacagattcaatctccttacttgtaattggtttgttctaattttctatttcgttatgattcagttctgataggttatgtatgtccaggaatttacccgtttcttctattatctaatttattggcatatagttgttcataataatctcttatgatcctttgtatttctaaggtatccgttgtaatatctcttctttcatttctgatttcatttatttgaatctttttttctcagtctaggtaagggtttgccaattttgtttatcttttcagaaaatcaattcttagtttcattgatttattcttctattttctagtcactaatttttaaatttctgctttgatctttattgtttccttctttctgctaactttgggctttttctttttctgtttccttaagatgtaatattaggttgtttgagatcttttttgctctaggtgtttattgtgtttatttgtataaatttccctcttagaactgcttttgctgcatctcatcagttttggtgtgttgctttttgtttgtctcaaggtaattttttgattgccctttttatttagaattatttgcagacttatttcgctgtatggtctgtgaacagctgtagattttcttttatatatatatattttaaacaaaatttgagagatgaagtctgtattgtttacaggtttgaggaataattgatttataataaactgcacatatttaaagtttgcaagttaatcagtttttacatatgaaatcactgttcccaggataagatgataaacatgtccatcacccccaaaattttccttctgtctttttctaatccttccctcttttccttcttcccttttttcatatcctcactcccttctctggcaatcatctgctgtttagtattcattttctataaatttatatcagtggaaacatacaatatgtgttttattgaggtagtgtgtctggcttctttcaatattacattcatccatgctgtcacatttatcaatagccctttttttttttgctgagtattattttgttgtatgactatatcaccatttacttatccatttactagttgatggacatttgagatatttctaatttttggctattatgaataaattgctttgaaacttgggtacagcctctttgtggacatacaatttcatttatttagggcaggggctggcaaataaccagagagcaaatattttagggtgtataggcttgcattcttctttcttgcactgtggtctgaaagctccaggtagtaagccagagtagtcatgggctgcacttcatttgcctcctctctttcagttatcactggcttgctctacctgttgttcagtttctgaaaaccatcattttgttgtgtttgtggtcttgtaactctatcttggctgagtctgtacattttaatgtagttatgtttctttttaaaagtttaatgtatttgtatttaaaatcattatgccaagattatgtgagatttttgtttctatattatgtttatgcagttctttactaagaaagggatgaatgacttcagggtttcctggaagctcatctcttaacatattcatctatcactattaaaatatgttaatatatcaattaatattataccccttgtttaggagtcaatctgtctctcttactgattgcttatgttggttttttctttgtgctttttgtattatgtattacaaccttttatattatgaaatacaatacccatgtaggaagttcataaaacataaatatacagcttaatgaaattttatgtaactaacacccatttaataactacttagggcaataaaaataatattgccagcatcctagaggccctaacatgccttttttcaatcacagctttctcccacccaaagatagccagtatcccaacctctgtggtttttacttctttgctcttctttacacttttactacttaggtagtcatctgtaaaattagtgtttgctgttgcgtgattttgatccttacataaatataactgtattagtttgttcttgcacttaactgtattggttcgttcttgcattgctataaagaactacctaagactgggtaatttataaagaaagaggtgtaattgactcacagttgtgcagacggtacaggaagcatgcctaaggagggctcagaaaacttacaatcatggtggaaggcaaacaggaaggaggcacatcttacatggccagagcaggaggaagagagcgcaaagggggaggtgctacacacttttaaacaaccatgtctcgtgagaactcattcactattatgagaacagcaagggggaaatccattcccatgagctggtcacctcccaccaggcccctcctccaacattggggattacaatttgacatgagatttgggcggggacacaaatccaaaccacactttgctctttgacatgtagcttcttttgttcagtattaggattttgaaattcattcatgatgttgtatggaattcattccttttcattggtgtataatattatatataggcacttgatggatagcagtttgaggtgcttaccagtaatagtcaaacataatgcacatgtactttaggacacatgtattcacacaaaattggaattgccagatcctagagtagtcatatgttcaacttaggagataatgtgtgttataaatttcatctactcagtggcttctttcagtctctaaatgatctcattttaactttttaaaatgttatttatttatttttgagatggggtgtctcactctgtcaccgaggctggactgcagtagtgtgatcatagcttattgcagtctcaaattcctgggatcaagcaatcctctcacctcagcctcaggtagctgagactacaggtacgtgccaccatacctgactaacttaaaaaaaaaaatcattgtagacataaggtcttgctacattgcccaggccagtcttgagctcctggcttcaagtgatcctcccaccttggtctcctcaagcgctaggattataggtgtgagccactgccctcgaccaatttttttttttttaattttaaaataattctagacttacagaaaagttgcaaaaatatttcatagagtattcctgtatatctttcacgtggtttcccccatttttaatatcttacataaccataggacatttattaaaatctgaaaataaacattggtacaatgctatcaacttatgtacatttattgttctaattttgccagtttccccaataatatactttttctcatctaggatccactctaagatcctatattacatttagttgtcatggctctttcatccaatctgtgataatactttcttcttgtttttcatgaccttgatacttttaaaagaatactggtcagttattttgtagactgtcacttagttgggtcttttgcattttttggcaagaacttatgaaaatagtgcttttctcagtgcattatatgttggtagtgaagggggtgtgttgataagctttaatactggtgatagttaaccataattacttggttaaggttatttgcagtgtttctctaaagttgctattttttttttttttgtaattgttacgtgtttttctggggagaaactttgagactatgcaatataatgtttctcactaaactttcattttctaattttaataccttttgatgttttttgcttgcaacaattattactgtggtggttttaaatttcagtttggtaaatattttaaatattggtgaatttaaatttttctcattattttttcatgtattaagataaattttactgtaaacaagaactgtctcttctcataaatttatttatattggtatagactttttttttttttttgagacagagtctcactctgttgccccaggctggagtgcaatggcgcgatctcggctcactgcaacctccgcctcctgggttcaagtgattctcctgcttcaacttcctgagtaactgggattacaggcacctgccaccatgcctggctaatttttgtatttttagtagagacggggtttcgccacatcggtcaggctggtctcgaaccgctgaccttaggtgatctgcccacctcccaaagtgctgggattataggtgtgagccaccacacctggcctggtatagactttttaaaaaatgtacttgtttattttttatagagacaagttctcactatgttgactaggctggtcttgaactcctggcctcaagcagtcctcctgccttggcctcccaaagtgctgggattatagatgtgagccaccacacctggcctattggtatggacttaagaataaagttgacccatgaataatgcaagggcactgactcccttgcagtagaaaatctgcatataatttttgactcccccccaaacctaactactaatagcttactgttgactggaagccttaccaataacatacacagtcaattaacatgtattttgtagttacatgtgttatacactatattcttataataaagctagagaaaagaaaatattaagaaaataacaaggaagagaacataaatatgctattcattagacttgagtggatcatcctaaaagtcttcatccttgtcatcattgtgaaggctgaggaagaggaggggttgttcttgctgtctcagtgaggacagaggtggaagaaatctgcgtataagtggacctacgtggttcaaacccatgttattcaagggtcagagctgtattttattttatgggttataatccaatactataattttattttagtgttttgattttgaccattgggaactctttcaagttggcttctgtgtctttttgacatgctttccatcatttttcagtacttccttactttctagtaccataagatgttacagaatcttctattttctttcctcggcccaggaattagctgtttctctaaggagccctggtttcttttattggtgaatgatagttagaaataaaaatctaatcctaggtgtggtcattgcttctggttgtcattctaagccctctctgttgacagagctaggaatgtatcatatactaacaagcacctacgtgtatatttgtatttatttcttcttccatctgtcagtatattaaaaggcatgaggccttactgatagtccttatccaacatcaaaatgttaattctgtcctttctccttttcttatttgtaactctttgtacagtgagaaacctgcatctctttatccatgatatatttgtttgttaaatcctagtatatattttcataattactaaccagtacccatatgagaaacaagtttattgacttaagtacagtgtttgtctacatttctttttgttggtagccttagagaatatagtcaaaatactattttctgaagttacttaaattagctccttttcgtccccatcccccttcatgtgtattattcatttgtaaatataattattttcattcctttttaggttctctcaacatactgattgattttaattgatcgtttggtatatgaaacattgtaatggttctaagtcctaactgtataaaaagatactctcatagatatgtcactcttcactcatcctgctgccctatttctattcccccatgatttctacctgttttcacctatccctcatgggaaaccagtctctttagtttctgttttagccttcctgtaattcctttgtacaaagaaacagacacatgaatgttattgtactttttctttaccaaaggatagcatactatatatcctctcttgcgccttctttttttcacttaacacagtaaatatatcctggaaatcatttcctattggtaagtagagattgtcctcattttttaccgctgcatattattccactgtgtggatttaaccgtagcttatttaaccactctgccatgtctgagcgtttgggttgtccttaacattttgcaactgcaaacagtgctgcaataaatagccttgtgtatatgtattttttagtttttggaggtacatcttcaaggacattgtcagaaggaagatgactgggtcaaaagctaagtgcatgtgtagttttgccaaatttccctccagacgggttatactagtttgcatttccaatagtagtatacgagagtgtctgttttccacagcctggccagcagaatgtgtggtccataccttttaattttgccaatctggtaagtgggaattgtatctcagtgttgttttaatttgcatttttctagttacaagtgagtttgaatatttttacatacgcttaatgtccatgttttatatttttgaattatctttttaatgtgtttttcccatttcttctcaatgtttaagagttctttatatattaaagttagtagtcccttttctgtggtatatgttacaaatattttctcccagtttgtcagttatcttttgactttgtttatggtgtttttttgccatgccatttaaaaaaatttttacatagtatgatttaccaacattttctcttatttccttgttatatcaagattgaagaggaatttactcaggttttcttttaatacttgtaaggtttctcctttttttgtacttagattcccaatccatttggagtttattcttgtgacttgtgcgaagtttggatcttagtctatctcttgataaacataaattattaattttaatgtagacagatataccagtattttcctgtatggcattattttcatctgtgtggatagccagttatccctgcactatttattagaaagattatcctttcacttctgctctgcagtgccacctttgttataaattcagtgcctatgcgtaggtctgtttctaggttctctgttctattctactgacgtacttgtttgtccttacgtcaatcacattttcattattgctaaagcttcatgagaagaagtcttgatatctagtaagcaagtcctcctactttgttcttctttaggatgatttttaatatttttgttgttttgcttttcctcatatattttcgaatgagcttataaagtttctcatacaaattctgtcaggagtttttagattgcatttaatatataaattgggttgtgaacattttatgtggtaacagtgttgtaatttcctacctatgaacatgttgtattctttcatttacttaggttttcttaaatttcttgcaataatgtttgatacttttattaattaaggtctttcacttcttttgttagttttattcctagattaaaaatattttttatcatttcattttgaattggatcatccatagtttcattttttaactgcatgttgctggtaatacaactgctatttttctctaattgatctagtatccaggaatcttattataaattcattgattaatcctaataatttttctgcattttggggggaatacatatgtatatatattatgtttatgaataatgtgagcttttttccctctaaaccttagatcatgtttttccttgccttaatagactggctaggacctctagtacattgttaaacaaaaatggtgatagaaggtgtttttgcattcttctccatctaaaattttaaaatttccccattaagtgtgtttcctctaggatttgatttatttatttacttagatcatttagataaaattgaaaaagttagcttctcttccttatttgctgagagtacttatacaagggtgtttagttttttcaaataccttttctgccattataacaatacagtctttccccccatcctgtttctcaggtagttacaatggtgagttatttaatattaaatgatttttagaataaacccaatttgatggttttctttgcttcttttttcttccctttccccttcccttccctctttcctccttttccctcctcatcctccccccttctcccctctcctctctgaagttggcctatattgtatgtttcctttcttttacttcaacattgcattttttaaaaaaattaatgacattttcataggtctttttccacatttatggaaaattaaacaaagtgcagagatttcctagataccctttctctttcggcatacagtttcccttatcatgttgcactagtgtggtacatttgttacaattgatggacaaattggttatattactaactaaagtccatagtttccattgggtttagctgtgttttatagtgctatggatttagacagattcatgatgtacagatgatatcaaccattacagtattatacagactagttttctgctctgaaaatttcctgtgcaacatccatttgttccttttttcctccccctgatctcctggcaatcactgatcttgccgctatagttttgcctcttccgaatgtcatatagctagaatcatatagtatgtagtctttttagataggcttcattcacttagtgatattcatttagatttcttccgtgtctttctgtagcttcataggtcatttctttctttaaatagacttgatcttttagagcagttttaggttcatagcaaaagttgagcagaaagtacagacagttctcatatgctacctgccccacacatgcatggccctcccccactatcagtactctgcatcagagtgctacatttattagagttgatgaacctatgttgacatgtaattatcactaaagtctgtagtttgcattaaggtttactcttggtggtgttttgacaaatgtataatgacatatatctagcattatagtatcatacagaatggtttcactgccttaaaaaaatccttttgcctttctcagaatatcatatagttggatcatacaatgtttaggcttttaagattgacttcttatactgttactttcctctgtgtcttttcatggcttgatagctcatttatttttggcattgaataatattgcattgcctgtgtgtaccatcatttattttcacctattcaaggacatcttggttgcttccaagttttggcaataatgaataaagccgctataaacacccatgtgcaggttttttgtatggacatacattttctatttatttgagtaaataccaaggaagatgattattgggtcatgtggtaagggtatattcagttttgtaagaaaccactaaactgtcttccaaaggggctatgctattttgcattcccaccagcaatgctcgcgagttcctgttgctccacatccttgccggcattggtggtgtcagtgttctggattttggccattctcataggtgtgttgtagtatcttagtgttacttcagtttgtatttccctaatgacatatgagacttgagcatcttttcatataaccacttgctatctgcatatcttcttttgtgaggtttctgttccagtcttttgctcatttttaaatcagattattatttttttctttttctaaatttttgtttttagagacgggtttttgctgtcactcaggctggagtacagtggtgcattcatgactcactgtaacctttaactcatggactcatgagatcctcctgcatcagcttcctgagtagctgggactacagacacatgccaccgtgcccagctactttttatactttttgtagagacgaagtcttgctatgttgcccaggctggtctggaactcttggcctcaagtgatcctccaaccttgtcctctcagagtgctgggattacaggcatgagccaccatgccaagcaaacttgtttattttcttactgttaagttttaatagtttgttgaatattttggatgaaacttatttttcacatgtcttttgaaaatatttttttcccagtctgtggcttgttttcttattctctgaatccacattgcattttgtgtccatgtcaaagttatgctaactttataaaattaattgggaaatattcttttctattttctggaaaaatttgtgtgtaattagaattaattttggtagaatttgctggtgaatttgctagaccttttgcttgctttgtggagtaatttaaaattgtttatgggagacatctaagattttctatttttttcttgtgtcaattttagtgcattatatttttctaggagtgtctctattctgacttttgaaacttgttgggataaaagtatttataatatcctcttattatttattactacatttaggctgttttcttttttctttgtcctactgattatttgtgtgttttctttgtcagcctcattcagaatcaattcaattattgtcttagaaggaatagtttttagtgtttttgatactctccagtgtgttttccgtttcatgaatttctgctaattgttatctctttgcttctatttttgttgggtttcagttactgtcatttttctaatttcttgaggtggatacttaactcatcaatttctataaagcatttcttctttttcatatatatattttggattgtaaatttctttataacttggatttaactgcaacctacaagttttgatatattgttattttgctatttggttgaagacatttcataatttcaattatgattttacctctgatctatgggttatttataagtacacttctgtctttacagacatggagatttttctggttacttatatgttattgatttctagctgagttatgttctgaggctatgatctgcattattttatttgttcaaaatttgctttatgtgggaggaaggagaggatcaggaagagtagctagtggatgctgggcttaatacctgggtgatgggatgatctttgcagcacaccatcatggcacatgtgtactgatgtaacaaacttgcacattctgcacacgtaccccggaacttaaaataaaagttggaaattttaaaaaaaggaaaaaaaatttgctttatggaatacactttttaaatttacatcccactagaagattcaaagagtaatgtagaccttatcaatgatatgcattttcttaagttgaagatggcactactgatcctatattcagtgtatttgctttctatttgtttggttgtttgttttctaatagtagatgtattggatgtagtctggtctttggataacttcctaagcagtggaattttatgtaagtcagtattcaaggtgctataagttgtttcaaggtattttgttgcaatttaaaaatatatctgataacgggtactatagttatggcttgtagatagaacagttaattttgagttatttagcttatttttagaaagaatcccttgctccttttaaacttttaatttgaaataattacagactcaatttacttttaaagcagtttttctgtgtttgatgtatcatcaatattgggtgagtgaagttcttttaaatgtttattctattacctgacaagttctactttcttttatgagaaacttttctggaaacaattttggggctttcttttcagaatagatattggttaatgtttgtgtttggaaaattgaaagcaaaatggatattagtcttgcctattaacttctaaagctgtgataaattgtttttgtccaacaatgcctccttattgctactttccaaaacatcctctttggtagccacagtatagaagtatttagttgcaagcaaatatcttacagttgttagcatttgtataaaggttatggtaatgttcgcctaacttaagggcaaaacaattacctggtaccaagtgagtcagggtttctattttaaaatatacatataaatgtgtttattagtgctgaattaatgctttactctgggaatttaaaatgtgtgattgctatattgtatataagcaccgtgcatgatgaagtggtacatattacttgactataattacatatacaatttgttaaaataatttttgaaagttaaaagtatttaaagaaatccattttaaaagtgagaatttgtgttctcaaagtattatcttatgcatagcaggcctttaaattatgacacatgttaaaatccactcaaacaaaggtggtaatataatatatggtaagggataatgaataagaaagaagtatatgaataagaaagaacagtgttttttaaaagtgaaatatacatacatacatatatatgtgccaactgatatatttaagaaatttcttatttagggaaaggtagttattaggcaagttggagggagggacacactaaatagtatattggcaaacttcctgaaatgcatatgcatagtaatttagaggcatattgatttttaaatatcaggcagcttttattcttttccttttctagcatctatttgtatgaacagtgactgttcctgctgctaaaggaggttttatcaagctttctgtgaacatttgttatataggaaataaattaaactactgctatatataactaacattcaatttatgataccagcaatgatttgggagcgatttaaagttttgttggttaatttcttatttgtcaaatgatgggccaagaaattctccatttcttagattaggggacatttcctatttgaatctactaaacaaatgcctttagtcgtgtttgtaaccatcaacagtatgtttcaaattatgatgtcatcacttacattccaaatgtaagaaaaactttttgctaagttggcttaattcagaattgtatttagcagctataaatattctcttagtgaccctttaatactttgtaggcttttttttttttttttgagatagagttttgctcttcttgcccgggctggagtgcaatggcgtgatctcggctcactgcaacctctgcctcctgagttcaagcgattcttctgcctaagcctcctgagtagctgggattacaagcatgcgccaccacgcctggctaatttttgtatttttagtagagacggggtttctccacgttggtcaggctggtctcaaactcctgacctcaggtgatcccccctcctcggcttcccaaagtgctgggattacaggtgtgagccaccacgcctggcctgtaggctcttatagaacgtaggggacaggggatattcccaggagactaaatatctaccttatttcatagaatctaagttgctttgagactgctttcgtggtcttagtagaccatgtcaatgaagggtaatcacacaactacctcacaacaatcacctggttattattattataccacctagcatcacagacatttcaatttcagagaagttaaattatgaataaatgtatatcctggaattgttgaagtagggttttgaaatcactaacagaatttaaaagagatggttacgataatcttgtgttctaattttctatgattatatcagtatggcatgccgagaactttttgattgttttgagtttgcagttgttgtttagttttttgttttgactctagataccacacagtgttccattctcagattcatgcaatggaatttatagtcatcctagagatcattagaattctattatgttaaaaggccattaacttttaatgttgagactctgagaagtgacgttgcatagttcctctgggcaaggaatatgggcagtttttttcttcttctttatgtgtaatcgtgttcagactggagttgtatccatttattcacaatgtccattatgaaaagatttgtgataaaagaaagatgagatatatctacatttaggtcagttaaacacaagaatatttaattatgtccttcctataccctgtaccactaccagttccttacatactccacaagcacagttataatgatagtatttcttcattctcaatgtttcattgcatttaagagagatgggcatattagaactgtgggaataagaaggaagggataatgcagagaccataaccattaccatttttttatattagacctctatttggtttgatttttattttcatgtttattgttttataagaaataagtacatctttcaatatgactccatattgcgtgcaaaataaaatatatgccatttgaaattcttcatggttaatttgaaacttcgagttctcatctccaactaaattatttcttactctgtccatacttgtgccctctttatctcaaatctttttctcaggacattgtgtaagtttctccctttgtgtacccactctttgagtgaggctaatcccaaatcccatctattcaaacttttccagatcccttcatagcaaatacctttattccgctactttccaatggtgagtttctctgttataccccttattggagggtaccttttgttaaggttataggtatttgtcaggttttcctgttagattttggtacgatatatttaggtttatattatctcctgtacagtgcatagtggtggtgcatcatcatacaggtcttcatccttgttatcttcacgttgactaggctgagaaggaggaggaagaggggttagtcttgctgtctccgtggtggcagaggcagaagaggtggaagaggtggaaggggaggcaggagaggcaggcacactcagtgtaacttttattgaaaaacgatccctgtataagtggactcatgctgttcaaacttgtgttattcaagggccctctgtaattttgttagaattactaatatattagagtgttctacatttttcattctcaacattttactgatcattattattatttgagatggggtctcgttatattgcccagactaaagggagtggctattcacaggtgcagtcatagcacactacaaccttggactcctggagtcaagcaatcctcctgcttcagtctgtcgaggtactaggactataggcacacacaaccacacttggctcccattattttctgaaatataaaattatttattttctggttactatctcatagtgtgaaagataagaataattacacagttattacttttctcacagcatccatctaatatattttatagtatatctatattatatctattattcaaattttgataattatacaaccttatttataagaaggagtattttataaataatgcttttttttctttgtaggttacttcctcagaatgttggcctcctgtatgttggaggttatgaaagaccctttgcacaaatcaaggtatgtttgttcattttcagtgtacttttcctggatgttctcttatctggaatccatcaaaaccttgctaataataatcaacatataaaaatatcgtgttccagcactttgggaggctaagacaggtggatcacttgagcccaggaggttgagaccatgctgggaaccctgtctctacaaaaagaaaaattttttgtcattagccaagttcagtggcatgtgcctatagtcccagctactctggaggctgaggtgggaagatcacttaagccccatgagtttgaggctgcagtgagccgtgatcacaccactgtactccagcctgggtgacagagtgagaccctgtctcaaaaaaaaaaaaaaaaaaaaaaagtgaatgtgaggtgataatttcataagcttttgcatatttctgctgaagaaatctttcagcttttcaaaggaattgattattttaatattcttgccatagtaaaattgactttgaccgaaacagttcagtgattcatttagaagagtacatttagagattaatctttgagatcatcccttttgccattaaaaaaatgtttacaagtcgggtacggtggctcatgcctgcactaccagtgctttttgaggccgaggtgggagggtcagggctggaagattgcttgggcccagaagttcgagactagcctgggcaacatagtgaaacctcatctctacaaaatagtaaaaaaaaaaatttcgctggccatggcagttgtcccaggtttttggaaggctgaggcaagaggatcgcctgaacctgggaggtcaaggttgcagtgagccatgatcacaccactgcattccagcctgggtgacagagtgagactctgccttgaaaaacaaaaatgtttttaacagcttttttgagatctaattgaagaacaataaactgtacaatttgataaattatgacatgcttgtagttgtgaaaccatcactgcaatcaagataattaacattcatcacttcagaaagtttccttgtgcccctttgaaatttccccctcctgcccttcctttttttttttttttttcctggtctccaggcaaccagtaatctgatttttgttattatagattaatttgcattttctggagctttatataagtgaaatcatatagtgtatattcacttgttctcttttttgccttcgttcactcagcataattattttgagattcatccacattattgcacttatcgctagtttattattttttgttgccaagtatcaggttggtgtaaaagtaattgtgtttttttgccattagtagtatggctatagcactgtttgattatcctttcacctgctgatgggcatttgcattgtttctagcttggggctattacaaataaagctgctgtgagcatttgtgtacgagttttgcatagacttatgctttcctttctcttgggtaaatatctaggaggggaatggctgggtcacgtggtagttgtattacatttccgtaatgactgagattcttcgtgtactttttttccatctgaatctagtgaaatggatgttcatatcttctctagtgaagtatttcttcaaatcttgttattttaaaattgggttttttgttttcttactgagttttgaacattttttatatcttctggatataagtcctttatcagatttgtgatttgcagttattttctcccagctatcgttgtcttttcatctcttaacagtgtcctcaaagagcagttcttagtattgatgaagttcagttgatttttctttcatggctcatgcttttgttgttgtatctaagaaatattttcctaacccaaagtcacaaagatttttctcgtatgtattctgctagaagttttatacttttaagttatacatttaggtttattgtccatttgaggtaatttttatagaagagtcaagtatggattgatgttctttttttttgtcatcttttttttccagaatgttactctcaaacat

SEQ ID NO: 14865 - DNA, 8139 bp, Human
agattaaaaataaaattatgatccagtgatactgcctctgggtgtatagccaaaataatttaaaaccggatctcaaagagatattttcacacccacgttctttgcaacattatccaaaatagccaagaggtagaagcagcccacgtgtccattgacagatgaatggctaaagaaaatgtggtgtatacatacagtggaatattattctacctttaaaaagaaagaatttctgtcacatgctacaacatgaataaacctcaaggacattatgctaagtgaaacaagccaatcacaaaaggacaaatagtgtgtgattctgttaatactcgtatgaagtatctaaagtagtcaaaatcatagaaacagaaagtagaaaggcagttatcaaggtctgggtagaggggaaggggggcaattagtgtttagggagtatagcatttcagtgttgcaagatggaaaagttctagacatacacttagcattgctgaactgtacacttaaaaatggttaagatggaaaattcaatgtttttttaccacagattttaaaaagcaatgtttcattgcctaattttatatttggttaacaattttactgattgttctatgtcccaggcactttcaattattattctttcagtgacccagtaaattaggaacttgttccccattttagaaattaggaaatagacactgaaaggtttagaaacttatttctgttagaccttacatgtggtatagcaaaactgtgtttacctaactgaatgagttgtccaatacttgcatatacacagtgtttccaaaataaaagaatgggtccctagaaagcaaggcaagagaattgagactaaaataatgaatatttgaggataaatttggcaagtttgctacttggaatatcacttttttgggcatgtctagttccaaaaccactgagtgtattgcacctgttggatttgttgaaaatgcagatggtacaatcaaatgtaaagggaaaggaatatagtttgaaagtttttatgaagacatgtgctgcctaatctgcgaattgaaagcatcttttaaaaacttacttctcgtcatattcctaggtggtagtgaatatgtgggtagaaaaatgagaatgtttcagataatgctaatgaagttaaatgattgcagtctaccatattgtgaggaaaagttgttagccatgaaagatgaggacagaattaaaatattaccatgactggcatttgatttgaaaactacaaagataagcttaggttcctatttatgaaaaccattctcacagcccagtgaaatatcttttaaaaggttcgtagttaccatggatacttgttagctttgatagagtatccatattcagtcatctgaggtgaagaagccaaaaaacccatcaactaatgtcacaaatagcttcatctgtaaatttgtactagtttggggatggaaaggctaagtttcctgaagattagattgttggttaattgtcactgcttggaaagcaaaatatttaggatgtacattgcctgaatttgatcctagtattcactattgatatgtaactttttcatttaactagtacacggcatttcttagattttaacataggaatttagatggttagacctttctgaaagttgatgaaacctaggcagtatactcaatttctgaaagccgtagagacacagacaatattgaaggtattggtccccatggtaacatatttgcatttggcccagcatggctggtttctgcctagcttcttttaattgctatatattgacagccattttcacaattatttataaaatgtcggataagtgagcatgtgtacaagggagtgcacaccataccttaagcttgattagatacttcagatgacaaagagctctctgcatgaagagttactgaggtatttttatcatttcctaatgtgcctgtcacatagtagaagcaaaaagcctttcaagttatttaaatattttcctcaattctctttcaaaacaggtgacaaaagagctgaaacagtatgacaacaaaattatagaatgcaaatttgagaacaacagctgggtcttcatgagacagagaacagacaaaagttttcctaatgcctacaacactgccatgggtgagtatgacaacttaccagtgcttattatatttaaaacaaaaattaaggtgttagacccaaagtgtgctgcctttgttgttttgcttaatggggcatagtcatttggacttcatccttgtttgatgggaaagatacgtcaagtctgtattctgtttggctccagttggcttgtaggttctactctctaaactggtgatcttgtgcccatgcacccaaaagagaagtttaaagggcaggatactgggctgtatacaagttgaatttattgaacaacaacaacaacagaaaccatgataatttcagatctattcaaaactataaaaaccattgtttgccagatggtaaaagacaaaattatcaggggaaaatgtaatttccagctcttaaaatagctttataaacaatggagaacaaagtaaacgaaaaccatttaaaaagacaaaatctgctatgctattcttcagagtgttctttgggtacaatatgaatgctttgggaattcagaatagtaagtttctttcatggggaacaacacaaattaattgaagtttataaggtataccactaccagtagcagttgttgttctggattgcatttttagtggagttgaaaaaaggtaaaaaccaagataacaggttaatcaaactttacttttagaatgtgcagttgatgaggaggatgatgatgatgatatgataagctaatgagaaaatattgaaattgccaatttcagctttgcagtttaaaagttactgttgtacatttaggagttctcattggaactagcatccatgttcagacaagatgagttaatttcaaaagtcaggatgattaagccaatgtcttttcttctaagaccaaataggtaaataaaatgaaaaggactggcactaaattttgataagagaagataatatggtctgctagctacaatgaaaccacctattcaacaggaatggtggctggtgccatgttttatgtttcgtagagtagacttctttctgagagaaagattgaaggactatagtgcacgttttctgtagaagttttagttgaatacagactatggtgcaatgtgttgtgttagattaaaatcccataaaaactggtttgggagggatagaaaaccgtggggaagacatgcttatagcccaaacatttaaagttttggtttaaaattaatactgcagtaaagagtagccattagacaagcacatattttgggtgtagggtagggaggagatagttcaatgtgaagcacatcactcaaatgggtaaaatggaaagtatttagtatattgggatgaaaacctttctcataagcctgtggtgagtcagctgccttaattaaccctcacatgagacctgtctccctttgtccacagctgtgtgtaacagcatctcaaaccctgtcaccaaggagatgctgtttgagttcatcgacagatgtactgcagcttctcaaggacagaagcgaaaacatcatctggaccctgacacggagctcatgccaccaccacctcccaaaagaccacgccctttaacctaagacctgcctgtgacttgagggttaagaagaaagaggaatgaggaaaaaacgctgttgcccatttttgtagccagagaaattgaaaaacgactgtggcttgatgttgatacacatttgaattttttttaaaaaaagaaagttatcgtagccagcctgtaaatacttgatgcattcgtttcctcagtgctgcaatacatcgtggacttaaacatcttatttatctgataaactcagccttaccttgtggaatctgaagattgaaatatccaaaggtttaaacaagatggaaatcaatgaaaaagaggccttgtttatatatgggtagcttcacatttaatttataaagttaacaatctggaaactgtgagcccataaaacagtattttttagaagttgtgttacaactgtagcaaattttccttttaaaaaatccaggcaatggcattaaacattcttgctatcatttaccatggatttcctacatttctgagatccctgtattcaaaaacaaatgacagggttgttaagttgtactatattaaacaacttggtctggtttatatcattttaacaagttttttggaaatgtaaaagaaaaaagtaaagctccatttttgtgaattgcattgtttctaaaggaagtattttgagtattttcatctgtttgtattgtttcgactatgatatcagatatccagtgtgtccattctggcagtggttttgagttacttcatggaacttggacatacaccaccaggtcctttatgtgttgttctcctgggagacttctttttttaaatgccagggctacttctgctttacctcagtggtatcagcacattgtaaattacgttaaaacacacaactcactgtgatctatgggagtgatatcaaatacaaacgatgttgtgttccttctctcgaacaaaacagcaaagggaatgccagctaacttctttgattagaaggtaatgtcatggaatagaatgctgtcaccagaaaatgctctcccactgctagataaatgcagaggcaaagtgtagacatctgtaggaactaaatatcaaggaaatcaagacatttattttcaaagcgagaattctatctacattctattctgcggatgttatttctgttatacatctgaattttaaaatgtttactgatagataatggatttaaagggcggctaattgattgtctgccattgttgataaactgttctaattggtttgtgaaagaactctgagaattagctaaatggaggctagtgtatttatttttagaggtacatgttttaagtaaatgtatttaaaacaaattttcatggtctgaattgtatatgtaaatgcatatctgtgtaagtatatgcaagtgtatattcttctactgattcagtcagacacgaaatccaactgaattacccggtagactgaatatctgacgggatttctatatggacatagcacagatgaaccaaaaatgtatttatattcacctgagttttaatgtttttaaacaaagttttctcctgcagtgcttttctatatgaaatagttgagtcaagcttgggcttttttcttcgttgttcccaagtcatgtaatgtatagtgaatttatccaaaacgccattgtaacgttttttactagagtgtttttgcacatttgggcgctaaagggattaaaacaactgatgccacaatgactattgaaggagggaaaattctcaaggttccatagtatcttttacaaaatggattaaaaaaaaaatgcctatgcaacttcaaatagtctgatgcctgcttccccaggacgagtgactcttccacggtgtgctgctttccctccgagcctgtggaaaggcagagcccttttgcagatacgaaagcaagcttttgccaatgatctttaatggagttaaaatgtttatggtaattgtaacctttcaaatgagttacgtgaaaagagcatctcacttttaatacacccagatattttcttcaagtctttgtgcattttagcaggacttaattttcttaatttattctttcctttcaattatagtgacatagagtagttggccttataagtagatcccatttagcccctgaacataataccatctgcagtattataaaagtcatttagaaggtcagggggataatctagaggcaggattttggacattgtgaaggaaatgtgctccttctcagctcacttcaataactattttctgagactgaagttttttagacaagaataagaaaactttgctttcttcagttatcacatgtgaaagcttttgctttttgttaggaaaaggtgtggatgactctactgcgtggatggttacatttgctttccgtgaaatgctcagaaaatgtcaggacattccttttccaattgtgtgtcagtgcgtattgtaataaaactactgatttaaattagcataagtgtatctactttgttttactggtgatactcttgtgtcccttctattgctggcatcacatcctactgctgtcagccacacccagtgtaatccatctggctttgtagagattagcataaagacttggaaagcctctatttttctttctgagaaactgagaaatttgattgacacaggggggtgtagtttgaaccttttatttttgaagtggagaggaatgggagaaagcacatctttatatgatgtttatattatttctcttcatctaatcttagcagtctactgtatgagtagatattctgttacattatttttaatgcatttaaattttttagaatactcagcaatagcaataaatattctgaaatgatgaagtcgtgaactaccaaatttttttttgcattgcatttttatagtatggaatttgccatctttaaatgtttaaataataccaccattttgaactctgcatatagtttttcctggccaaaaaaataaccttggaagccaagaagcaaatactcccaagtgggaggacacatgtggtggagaaaactctggactagactcacacaagtccaggctctgcctcctgttggctctgttctgtctagatcctcccacacacacacccccatccacccctgccattttgttccatctataaagtggcaaatcccatctgtcacactgggctagattatttaaaagcctttccaggtctaaccatgattcctgtgttaaagacagtactttgaaaatctcccatattcaccataatagcagtataaccattattgattattcaccaactaccaagactgtcctaaacataaccactctatgcaggcaggtactgttaccaaccccacttttagatgaggaacctgagactaagttgtgagctgagatccagacataggtctttttactccagcacctacatttttgcacagtcctctcccaaaggcttagttacatacagtccctttgtggaagactgatttcatgccagggggtcccaaactaagacattttttgggtgctaacagggtaataggctttaagcacttctctctaataaagaaggtgaagttgggagcacagaagtaaatacactttagggccttatttaactatttatttaacaatacttaaatgtgagtgactaagcagccatgaaggggaagtttaatgttctcattaagatgctaaattctaaagaggtaattaggaagaaataagtgattaaattacacactgggctaacattttcctgattgtctcatagttagctgtcaactctgctgctttggcaggtcattgtcagccttggttaatgcagatgggccccttccctcacctgactgatgtcaggtgaccactctgcagtatcaggaaggtggtagtggagcagactctgagcaggggccacctggtctccagatttcacatttcccaaaaccagggcatggatccggggttgccaaatattttgccatgtcagggcattaaaaaaacaaattatcttgccattatttagtaaaactaaggaactcttaacacacaaaaaggaagtaggacatattttagaagacaggcctttatatagaagaaattttgttttatgaaagattcactccattgtcctttgcttgtatattgcctccctagctgatgaaaactttttcatgaactggtgttgggaatcactgcagaggtggaattcagttggggctttaagtgggaaggggatgtggaaagtagcagcagcacttggtttcaaaactaaagatctattcacaatagcaaagacttggaactaacccaaatgtccaacaatgatagactggattaagaaaatgtggcacatatacaccatggaatactatgcagccataaaaaatgatgagttcatgtcctttgtagggacatggatgaaagtggaaatcatcattctcagtaaactatcgcaagaacaaaaaaccaaacaccgca

SEQ ID NO: 14866 - DNA, 5286 bp, Human
tatgctgtaatcccagctacttgggaggctgaggcaggaggatcacttgagcccaggagttcaaggctttagagcaacatgatcacatgcctgtgaatagccacggcactccagcctggacaacatagtgagacctgtctcaatacaataaaataaaaagtaaaattaaataaaataaacggagaaaatgaaaagccataaaaatgatgttttaaaaatgtaattagacaagatggtctcagttccagtctttgttccatgttcacatatttatcaaacacctctcatgtgctgagtgctgggggaacatgcaaagatgcccaggatctggctggtgccctggactgaaaacgtcacatgaacactggcctggtcctgcacatccctagaagaagtcagaaatggaagagcctttaacatgtcattctttgctttctgagtcttaaagaaagctttcacaaatgtctaacttgatgcgaagaatttacatttgggttgaattaaaagccgtagcccgggccgggcgtggtggctcacacctgtaatcccagcactttgggaggctgcggccggtggatcacgaggtcaggagatcgagaccatcctggctaacacagtgaaaccccgtctctactaaaaaatacaaaaaaaattagccaggcgtggtgccgggcacctgtagtcccagctactcgggaggctgaggcaggagaatggcatgaacccaggaggcagagcttgcagtgagccgagattgcgccactgcactctagcctgggtgacacagagagactccgtctcaaaaaaagaaaaaaaaagccgtagccctggagcggtggcttacaccggtaatcccagcactttgggaggttgaggtgggcggatcacctaaggtcacgagttcaagaccagcctggccaacagggataaaccccgtctctactaaaaatacaaaaattagccaggcgtggtggcacacacctataattccagctacttgggaggctgaggcaggagaatcgcttcaacccggaaggtggaggttgcagtgagctgagatggcgcactgcactccaacctgggtgacagagcatgactgtgtctcaaaaaaaaaaaaaaaaaaaaaaaagttagttgtgctggtgatgttagcaaatgcagataccaaaactgttgattagaatggggaaggcccactggtcactcatgaaatggcagtttgactcaccttgccattcctcgggaagtcactcaggaccacgtagaccacaactgcatcacccaacttgggatatgttagtttgtttccaaaactcatttgactacctcattcttactttttgtcattattgcaaagcacatatgctgtgatttttctcgatattttccattaaatcgcttaatttcttgctgaaataaatttttaaaagaaatttcatgatactagcatgagtaagaaagcagcagcatttgccataaattgaaggtaacgtaaaaattaagtccagtgaaaatcacgccttgttaaattctgccttaattctcttgcctgcagaatgctcggagatggcagcctactctctgtcaacacgggactgagggaggtattaaagacaaaccagcacctccctgagaatttctccataatcaaatcagggaaagtgaaaaataattgaaaaaggaacagcgttctcagtacgcaagtcattgttgtgtgggatagtgtgcgtgtgtcatataaaatcttctcctactccaccagaacattgcccacactgggagacagtgtcctggtgtccacagaaccatggcagggactgatcctatttcacagttgtaggcactgtcctttagggtcacaggctaaaaccagctctggactttgagcgccacatgaaagggccagactgctcggttaattccagacagcaaacacagaccttggtttgatctcagcaatcacaggttggattaacacaactgttttccctccccttgttccaggattgtgcttagaggacaagaaatcgtcagttctgttgttcccaagtcaaacagtgtttttgacttccagaaagcttacaagctgactgaagaggaggtaaggttgccatcttgtctttctatgccattgtcctggaaagatgagttagcttgggcaacatgatgagactccatctctatgaaaaattcaaaaaaattagctgggcatggtgatgcatgcctatggtcccagctacttgggaggctgaggtgggaggatcacttgagtccaggaagcggaggttgcagtgagccaagatcgcaccactgcactccaggctgggcaacagagtgagatcctgtctcaaaaaaaaaaaaaaaaaaagatgggttgatgccaccctttgaggtcaccactgaagacacaacattgggcactagaccttgaccctcaatgcctatgattctgtgatttgaggcccctccaaaatttctgatcgagctggtcttggaatgacgcttaccagtaagtgttctgtggggtgacttcgggcatttcctctcccctccctggtcctaaatttgctcatcgctaaaatgaaagcatctcccaggcatctcctaatttccatgtctacctcccctttctccttataggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacagatatgaactgctccctgtacttaggaaacaagagtgatccaactgctttcattttttgacctgaatttattctgacttgagccaaattggaaggagaatcttttgtatctctcttggtctcatacctcccctgaattgtctaaaagggaaccaggggcatttgtagaccaaaatgatgatcttcatgccctgagccagagccccatccactgtcactggccctgctcaaccctgtcatgcgagaggctgcagggggaggaagagcgtcagctttcagtcctcatgaggggtcctgttccacacgcaatgaccagaaacaccaaggccccagctgcccctgtgatttgggcaattaactgttttaagagtctgccccctcctctctgaggtcaggccaccatcacgtctcacagtgttgagggataaaggccactcccacctggtttctctgccttcgaattgtcctccaactcagccagcccaggaagcatcagtgtcatcctctgaaatactaatctgaccacagcccaccctcagtcccaccctcagtcccaccctctgcccataaatccttcagcggctcccatcaccatcggagagagctcagtcttggccaccatgaaggtctctgctatctggcttattgcgccagccccaccttctgccagggtcccaccctgaacccctgctccaggaggatgtcctccgccctgcataccccatgctctccctccctgggggccttggctctgccccccccatgccctgccctattccagagcccgggccaagtgcccccagccctcatgtgcgccctacctctattgcaacatccaccacattatatttgtcaccaaggtcagtgttggaggtctttggggccccagtgtgacaaacacctagtgggctggctgggactcgaggattttgttatctttctgcaatcaaggaggctcattggagtccaacaacacagcaccatttagcctgtatccaaggtgcccatttttgtttgttttgctttgttttccctgatgtttctttgttcaagtcatacacgaacatggctaaatgtgtgaacagtaccgaagaataagcagggaaaaggaatgccgtgccctgaccccatccccgagtttcctgtctcagaaacagcccctcttcccagctcatgtgtttttccagagagtctgcacagaaatgagcactatatgtaaccttaaaaatacaaaatatagcacaccatatgcatggttccactcttcgcttttttcctttaatatattggggatgatgtgacttttgatgtaggagaaaaagaccttaagtctgacacttgaaattatgtaacatctgactgggggaataaaatcaaaagggccctggttaagcacgggaagccatcttcctcaaatgtccaattaacctcattggacaaaggtctcactggaattggtgaggggtgagtgatggcaaggctgctaacacatctgtcacccttctcctaagccagagctcatagtcccaggaaacttaccagtttccaaggtccaaaatggtcaaacaaggtcaggcgaggtggctcatgcctgtaatcctagcactttgggaggccagcctgggcaacatggcgaaaccctgtctctactaaaaatacaaaacattagccaggcatgctggtacactcctgtagtcccagctactgggaggctgaggcacaacaattgcttgaacccgggaggtggaggttgcagtgagctgagatcgtgccactgtactccagcctgggcgacagagtgagactctgtcaaaaaaaaaaaaaaaagtcaagcaagtcataaatgggcttattccggagagagaggctcatccttctgtcccaaagtactgcaagctccgaaagcccacatggctgggataagaaccctggctgctggggcttgagactccatgctgggtgggggaggaatgggaaggaggaccagacactaaatgagtcagtccatggctctgacttggtcctgacaccctgcagcttcctcccaacaagacatctctccactcctgcccaggagcaggttactggagccacaggcatctgccagctcttattccggccaaattctgacaggcaagagggcacagcgcagggcatgtctcactgcgcataacctaatggagctgcaaacatcctcctgtccctttgggtcacctggcctggcctgggcaaggaactctggtggccttttggggaaaatgggtgtcccctggtcataggcacccttttagccttggctttgtccaaagagtctaaagcttggctgggtgcggtggctgacgcctgtaatcccagcattttgagaggctgagatgggaggatcacttgaacccaggagtttgagaccagcctgggtaacatagcaagaccccatctgaacaaaaaataaaaaaattagctgtgcatggtggtg

SEQ ID NO: 14867 - DNA, 44836 bp, Human
  misc_feature (1)...(44836): n = A,T,C or G
tgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaggagttcgagaccatcctggccaacatggcaaaaccccgtctctactgaaaatacaaaaattaactgggcatggtggcaggtgcctataatcccagctacacaggaggctgatgcaggagaattgcttgaacctgggaggtggaggttgcagtgagctgagatcgtgccattgcactccaccttgggcgacaaaaggaagactccatctaaaagaaaaaaaaaaaagccaggtgcggtggctcacgcctgtaatcccagcactttgggaggctgaggcgggtggatcacgaggtcaagagattgagaccatcctggccaacatggagaaaccccatctctactaaaaatagaaaaaatttgctgggtgtggtggtgcacgcctgtagtaccagctacttgggaggctgagacaggagaatcgcttgaacctgggaggcagagcttgcagtgagcagaggtcatgccattgcactccagcctgggcgacagagtgagactcctctcaaaaaaaaataggggcctggcagaacggtcgccctcattccttccagatgccttttgaatgctctgctggatgggtggttggctgagccgtggggcatctgagaacaagtcagtagaccttctccaagagtatgcaataaggactgagcaggaaaaaagttggagactgcctgtcccctcacaaagttgatggtctaacattcttctcagggtcaagaaacttgtccagggagacactgctgtttataatcacaggcctgcttagcctagaacctgggctggcctcttcatcagtggggatgagggctccttgctcccagctgctcagctcccagcagcattgagctcctgggtgtgtgccaagcctgtatgggaggtgatagggaggattttaattaatactgagtaattaccaggcggtgtttaagcatcccaaatgccctcaggttcccaaacctacagctactctcttcctggctaggcctgtaaggagagggggactctgctctatgcccagtgggcctttggttagcacgtaggctgtagactggacatcccaggaaggtctccacctttttcaatacccttccagtttggtaggaggaggagggcaatttgggaaatagtctggcctctacagttcacctataccatcttcccaggggcaaaggataacaatgcctgtggtctgctcaacttcatcaagcagtgttgacctagggcccagtgtagaatgtggggagaggaatgggcagacctagatctggggaccctggtgaaagtgctccaggaggaacaggcacagaggtctttgctgcttttggccttatttccctttctcactgtacacatttggctgagtgaactctttcaaatttatttttctgtctgtggctctcaaattatgatctcattcaaacgcctacttcctacaaggccttacccgtttgacatctcagagacctgacagactcctgagttattccaccattccacctggcagccaaggtggtcttgactccaccaggcctttgctcttgttgtatgttcagatggctttcctccagatcttcccctgggcgggtcctgctcaggcctcggggctagcttgaatgtcacgccggaaagtgagccctctcttgcccttcatcacagcagaatcacactgatgtgctcgtatgcttctgcttctcgctgtgtctctggtgcttagtaagtgctggccaaaaagaggctcttggcatcagctgaaagaataatttaaaggtcttcaggaccaggcgagaggcactaatcggtccccttcatgggtagaccgttcattacctaattccctggattccctccgtgagctggcatcaggaacactccactgtctcgaccccccgacagcccgagggggcgggtcatctagtggcgcaagcgcactgagggccggtgctaagcggggacgcgcacgcccgcggtggcgtgcgtcacaaccaggacgcctgccccgcccgtccagctcgcctgcccgtcggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaaggtaggctgtgggcggggccctggggagtggtgcaggaggtctccagaggtctagaggggtggcagggagccaggtgtcgcgccgcagccaagccgaccgcaggctgggattgggagctctgtagccgcgtttctagcgtttccctgagacaccggcgtgagcccgcgtgcgccacttccaaattgagctccgcgatcctgcgagccctagagcgcaccgagtgatttgtcagatccagccttgaaggaaacgtgcgcgctgtcggccctgctagaggatccctcgcctttgcttaagacccttcaccagttttggcttcgaagacaacagcgttctcatccagtgacttgtgtttaattgataggacagtaagtttgtttggaaataataattttttttgaaaagttactgtgaaaacttttaagcatagacaaaagaggaaaggtgagatgaatccctatatgccatcacctacatttaacagttgcgtttgtcacaaagtttcatccataccttttttctttctttgccgaagtgtattaaagcaaatctctcaggtcatttcacctctgcttacttgagtttgtatttcttcaaacatggtccctgggaatattcctgtttttaaaaacttggccaaaacgattgaatcaaatttggtgagagtaaataattatcttgccggccggggcagtgggcccctatagtctataccagctactctggaggctgaggaggaaatatcgcttgaatccaagagttcgagaccagcctgggcaaaatagacaccctacctcatttttgaaaacgaaaaacctggccgggcgtggtgggtcacgcctgtagtcccagcactttgggaggccgaggcgggtggatcacctgaggtcaggagttcgagaccagcctggccaacatggcgaaaccccgtctctactaaaaatacaaaaattagccgggcgtggtggcgggcgtctgtagtcccagctacttgggaggctgaggcagggagaatcgcttgaacctgggaggcggaggttgcagtgagccaagatcatgccactgcactccagcctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcgacttcccaaagtgatgggattacaggcatgagccaccaatacctgaccatccttaagaaggaatgaaattcttattcatgttacagcattgaaaatattatcctaaatgaaatgagccagatacaaaaggacaaataatgtatgattccacttacagaaggtaaccagagtagctaaattcatagggacagaaagtagaagagagctaaccgagggcttgggggaaggtgtaatagggtgttattgtttaataggtacagagtttcagtttgggataatgaaaaagttctgaagttggataatggtgatggttgcacaatgtatgtacttaatgacactgaattgtacacttaaaatggtgaagtggcacattttatgtacatcttaccacaatttaaaaaggaagaaaaaatgaattgtatacccaatgacattagaataagtctacactacttaaattagaaataggatatgtttcaactccagagccaataaaaaaaagaacaagaagtatcatatgtaataactatatagcaaggaagctttgcttagtgaggtccttgtgactaaccaccaattcagtttataaaattgtatcctattggaaagagtcaaaaaacttactagctgttattttaataacagctttaatatcaaacaggacataacttcaaagtataaagtattataatgcgtatttaatgttgagagatgcctgaagagtataaacttattaataaattactgtagctgcatacaaacaataaatcgacattcagaattgtttcacttctgtaattaccataaagcatttatacttgccggtctctcagcattttttttttttttttttaggtaacagctttatagagatatgcttcacatacaagtcaactatttagaatgtataattggtttttcatatctgtgtgcagccgtcaccataataattttttttttttttttagacggaattttgctcttgttgtccaggctggaatgcaatgatgtgatcttggctcactgcaacctctgcctcccgggttgaagcaattctcctgccccagcctcccgagtagccaggattacaggcgcgtgtcaccacgcccggctaatgtttgtgtttttagtagagatggggtttcatcatgttggccaggctggtcttgaactcctgacctcaggtgatctgtctgcctcggcctcccaaagtgttgggattacaggcatgagccactgcacctgaccaaccataacaatttttttttttgagacggagtcttgctctgtcgcccaggctggagtgcagtggcgcgatctcggctgactgcaagctccacctcccaggttcgtgccattcttctgcctcagcctcccgagtagctgggactacaggcgcccaccaccatgcctagctaattttttgtatttttttttttagtagagacagggtttcaccgtgttagccgggatggtctcgatctcctgacctcgtgatccgcctgcctcggcctcccaaagtgctgagattacaggcatgagccatcgcgcctggcgccataacaatttttagaacatttttcctcactccaaaaaaagtcccatatactgttttgtttttcttttcttttttcttttttttttttaaagatggagtctctctctgttgctcaggctggagtgcagtggtgagatctcagctcactacaatctctccctcctgggttcaagcaattcttgtgcctcagtctcctaagtagctgggattaccggcatgtgccaccatgcccagctaatttttgtatttttagtagagatggggtttcaccatgatggccaggctggtctcgaactcccaacctcaggtgatctgtccaccacggcctcccaaagtgctgggattacaggtgtgagccactgcgcccggtcaccatacactttagtcatcacctcaccaacaccctcattcccctcatccctaggcatcctctaatctacttttgtctctaccatttgcctatcctgcatatttcatataaatggaatcatataatatgtgttgttgttgtttttttttgagcggagtcttgctctgtcgcccaggctggagtgcagtggcgtgatctcagctcactgcaagctccgcctcctgggttcacgccattctcctgcctcagcctcccgagtagctgggactacaggcgcccgccaccacacccggctaattttttgtatttttagtggagatggggtttccctgtgttagccaggatggtctcgatctcctgaccttgtgatccgcctgcctcagcctcccaaagtgctgggattccaggcgttagccaccgtgcccagccaatatgtggtcttttgccgctggcacttagcataatgtactcaaggttcatccatgttgtaagcatgtatcagtactttttttttttttttcctttttccacttgttctaaataaacttcatttctttttattgctaaatactattctgttgtctggaaataccattcatttctggatataccatttatccattcatatgttgatggacatatagattgttcccactctttgactattatgaataatgctgctacgaatatttgtgtgtacaagttctgtgtggagctgttttcatttctcataggagtagaattgctgggccatatagtagctctgtttaaccttttgaggaattgccagtctgttttccaaagtggctgaaccattttacattccaaccagcagtgttttgaggattctaattcctctacatccttgtctgaacgtatctgtcttctaaaattattatagccaaactagtgggtgtgaagtagtacttcattgtggttttgatttgcatttctctaatgactaatgatgttgagtggacatctttccatgtatttgtcagttgcatttcttcttattttttaagatagggtgtcactctgttgccctggttggagtgtattagcagaatcataggtcattacagccttgaaatcctgggctcatgccaccatagctgggctcctgggctcatgcgccaccataagtggctaattttttttttcatacctggctaatttttatttttattattattatttttgagacagggtctctgtcaccctggctggagtatagtggtgcaatcatagctcactgcagcctaacccttgcaggctcaagcgatcctttcaccttagcctcccaagtagctaggactacaggcatacaccatgcctggctaatttttgtattttttgtggagatggggtttcaccatgttgcccaggctggtctcgaactcctgagctcaggtgatttgctcgcctcatctcccaaagtgctgggattacagatgtgagccaatgtgcctggcctctggctaactaaacaaaattttttttttttttttagtagagattgggtctcactatgttgccagcgttggtcataaactcctggcctcaagggatcctcctgccttggcctcccaaagtgctgggattataggcatgagccactgtgtccagccttttcacttttttggtgtcctttgaagcacaaatgtttttaattctgatgaaatcggatgtgtcttttttcttttcttgtttgtgctataggtgtcatatttaagaaaccgttgccaaatccaaggtcatgaaaatttacccctgtattttcttctagaagtttatagttttatcttttgcatttaagtctttggtacattttgagtttttttttttaatatatatatattaaaaaagctttcttcttcttttttttttttttttttagacggagtctcgcactgtcgcccaggctggagtgcacaatggcacaatcttggctcactgcaacctccgcctcctgggttcaggcgattctcctgcctcagtttcccgagtagctgggattacaggtacccgtcaccacgcctggctaattttttgtatttttggtagagacggggtttcactatgttggtcaggctggtcttgaactcctgacctcgtgatgcacctgatttggcctcccagagtgctgggattacaggcatgagccaccgtgcctggccgagtactttattcttttacatgtaaatatccagttgttcagcaccatttgttgaagagactattcttttctcacttaattgtcttggtactcttgttgaaaattgattgttatgcatggactcagtaacatggggaaaaaaaagaaaatggattgactgtaaatgtgagtcagtttctagactcagttctgttccattgatttatatgtctgaccacatgctaatatcacattgtcttgattactatagataactctagtaggtttggaatcaggaagtatgagttctccaagttcattctttttttagaattgttttggctattttgggtccctagaattttttttttttgagactgagtcttgctctgtcactcaggctgcagtgcagtgacacgattggctcactgcagcctccgcctcctgggttcagtaattctcctgcctcagcctgtaggcatataagctaccacacctggcttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcccgggtgcgatcacagctcactgcaacctcagctttttgggtttaagcaagatcctcccacctcagcctggagtagctgggaccagaggcgctggccaccacacttagctagtttttttctatttttttgtagaggcggagtctcaccatgttgccttggttggtcttgaacttttcgggctcaagcaattctcctgcctcagcctcccaaagtacttggattacaagtgtgggccaccattcccatccagcaaaatatttttgtgtacctgtacagtgcgtttatgtattaaggtaaatgttattacaaaagagtcaaaaagtcaaaagaagagctgagtgtctgtagtcccagctaccctgaggctgaagcaagagaattgcttgagcccaggagtttgaggctgttgtgggccatgatcacgcctgtttgtagctgctacactctagcctgtgcaacataggaacacctaatttctttaaaaaagagaaaaaaagttagaaaaaagtttaaagttgggccatgtgcgttggctcacgcctgtaatcccagcactttaggaggcagaggtgggtggatcgcctgagctcaggagttcgagaccagcctgaccaacgtggtgaaaccccatctctagtaaagatacaaaaattaaccaggtgtggtggcgggcgtctgtaatcccagctacttgggaggcttgaggcaggagaatcacttgaacccgagaggtggagattgaggtgagctgagatcgtaccatgattggactccagcctaggtgacagggcaagactccatcccaaaaacaaaaaaaaattaaggtttataaagtaaaagttacagtaagctaaggttataattgaagaaaaaacgtattttttatagattgtgtagcctaaggatacagtgtttataaagtctaccttagtgtacagtagtgtcctagaccttcacattcacttaccactcactcactgactacacccgaaataactccagtcctgcaagtgccatacacaagtgtaaaattacttttataccatatttttaccatacgttttctatgtttagatatacaaatagcctaggagtaataggctttaccatatattctaggtgtgttgtaggctgtaccatctaggtttgtgtaagtacactctgtaatgtttgcagaatgatgaaattgcctaacaaatttctcagaatgaagtgatacatgtgcttttgttttttcgaggcatccaatattttaaaagtaaaattataattcaaagagtttacttcatgctatcagcagacatacttatgttctttcttattctgttctttttttttttttttcatcttaaactcagtggtaagaattgtcatgttcttgagggttcttttggggaagattattggagctttgtttttggtgactccatgatttttaacagggcaggtgatttgtcttggcatttctagaccaagcatccaatgctcaactagttggttggtttctcagcccaaaaaaaagaagccctatgttgttggcggtactccagggctttttttgtagccatcatcagagaattctggatatggttaactttaatgcacaccaaattttaaaaatggttagtagataagtggtatctgaaatcctaataattttcagcaagactgctcttacttcagagtggagtttagtgcccctaaaatgagtgggcatcagtggccttggatatctttttctatgtttatctttatttttgtaagttgagaggtttttttaagtttactttgtttttttttttttaaatttacaaccctattcacctggagtagagagttttaagtttgttttttggtgtataataaagaatgtgactagcctttttcctggggttcctggcataatgtgtctaaaacctttggaattttccaagtgatagaagtatctttctttgttattcatgagccttttggatcataactgagtttatgttaatgagatgattcaggatgggggctggtcaccagaaagaccaaccatgtgataggagggctgatgcttgaggaagtctaatctctggggagagaaagggggctggaggttgagtttagttatgtggccaatgattcaatcgtgtctatgttaggaaacgccagtaaaaactctcaacacaaaattggtggatcatcctggtaggtaaatccattgatgggctgggagggtgattccatggggaaaggggacagaagtttgtgttcaggacccttacagaccttgccgtatgtctcttcatttcactggcccaaatttgtatcctttataataaaactataattgtaaatacagtgcttttctgagttctgtgagttctagtgaatattgaaccagaggggtcatgggaacccctgaatttttttgagacaagggtcttcttctgtcacccaggctggaatgcagtggtgcgatcatagctcactgcagccttgacctcccgggctcaggcaatcctcctacctcagcctccctagtagctagaaccagaggtgcgtggcaccacacctggctaattttaaaaaattattcatagagatgggggtctctctatgttgcccgggccgatctcaaactcctgggctccagtgatcgtgctgccttagcctctcagtgctgggagtcaccatgccctgctggaatccctgaatttgtaatgagttggttagaagtacaggtggcctgggatccccaaagtataactaccatctgaagtaagggcagtcttgttgggcatcttgccttttaacttctagagtctgatgttaaccacctagtgttagcatcagaattgtatggaagtataccagttagtgacagaatagttttatattcctattatatataattctactgaaattaggggccagatgtgaactgatgagaagacatacaccagaagggggatgtggcctttggtcctttccagcttgggtaataggaaatcattctttcagtctattttttaatttaatttaatttttttattttgagacagaatttctctcttgtccaggctggagcacagtggcgcagtcttggctcactgcaacctttgcctcccaggttcaagcaattcttgtgcctcagcctcccaggtagctgggattacaggcgcatgccaccatgcccagctaatcatttacgtttaatgtctatgtgtgccagggtctgtactcaacaaaaggtagcaggaaagtctccatccctactccttaagagtccttagtgtgatgcagtagacatgtggatcgtgtctgtgaatagccactgcactccagcctgagcaacctagcaagactgtttcttagaaaaagaaaatcaggccgggtgtggtggcctcatgcctctaatcccaaggaggccaaggcgggcagactcctaaggttgggagtttgagaccagcctgaccaacatggagaaacccaaattagttgggtgtggcagtgtatgcctgtaatcccagctacttgggaggctgaggcaggaggcatcgcttgaacctgggaggcagaggttacggtgagccgagattgcgccattgcactccagcctgggcaacaagagtgaaactctgtctccaaaaaaaaaaaaaaaaaaaaagaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggacaacatggtgagacctcgtctctatgttaaaaaaaaaaaagtcacttaaaatagtcctttgtgtgattctctttccaattcagtatgcagtacgtttgctttatgctttagggattgctttttctaatttaatttcataattgtttaaaatatttgtgattccaaagccaaatctataaaacaaggtatattcagagaagactggcttctacccttgtagcctccactcaattcttcccttcccctatagcagtggttttcagccttgggagcttttaaacaatattgataatggccccacatcaagtcaaggccatgattgcaccacacactccagcctgggcaacagaacgagatcttgtctcaaagaaaaaaaaaaaaaaaaacaacatcctggggcatcatgaacacatttgacttgggatctgcatattattgcatgattcagatgcactaactagcctgatttgttattttcatttgattactagtctgtgacatgtgtcttgtgttttaattacagaatatgtgaaattgtgttcttaggaaaatgaaaatggcttaattttgctaatttgctttttcttttattagagtataatttttttcttttggcatcagttaccgaggccattttttccttctctttgctctaatctaagcatatagattcaatttagtagatattgtgagtgctagctggtgttctatcaatttgaaatggttctgtggccatggaagtttgggagatgcttctacaggccagggacacattaaacagctttataaagggaaggaacatcaccatatttataccccatgcaagctgtgtgaagaactggtctgaggcagtgccaggctggatgctgggaaactccattttttttttttttttttttttgagacagaatcttgccccgtcacccaggctggagtgcaatggtgcaatcttggctcactgcaacctctgcctccctggttcaagggattctcctgccccagcctcctgagtagctgggattacgggcatgcgccaccatgtccagctatattagagatggggtttcgccatgttggccaggctggtctcgaactgacatcaagtgatctgcccgccttggcctcccaaagtgctgggattacaggcgtgagacactgcgcctggccctgttttcattcttttttttttttttttctgacatggagtgttgctctgtcgcccaggctggagtgcagtagtgcaatctcggctcactgcaaccttcacctcccaggttcaagcgattctgctgcctcagtcccctagtagctgggactacaggtgcacaccaccatgcccggctagtttttgtatttttagtagagacagggtttcaccatgttggccaggctggtctcaaactcctgacctcgcgatccgcccgcctcggcctcccaaagtgctgggattacaggcgtgagccactgtgcctggtcctgtttccattcaaaagggagttcttgactgtctttcaagggtgtggtaaaacttaaagataatgtatgctaaatatctagtgtctggtgtgataactgtaattggttgtttaatcatttctattgatcctagaactcatatctctcaagaactcatatctctaaaaaccagggaacttgcatatttaaaaattcttgggaaattggattatcagtaagagttttgattggaaaatacagaattgtaacaggaaaaatagcaatagctggaagggagtggggatgggtaggaggaggtatttccctagttctgggagcatgaagcaaagctggtctttacagcagagaatgatccttttaggtctggatagctggtgttcctagagttgaagtttctgcccctgggtaagtagtgctctgtgtcatctctgacttgacccacaatccccaccactccttgctctgatcttgccacagtcagatcctatacttagggagacgttctttctctttctgtgaggcatggcttacgctggactaatcattccacccttgtcctactgttacagtctgtgtttaggagtaaatgggggagtaattaaaactgtgtgattggagatggtcatggcattgcccctgacatagggagcctggagtaacaggaactgtgaagtttattggttctattctggacctattgaatttcaggtccaactcagggagttggagttccagctggcatttagccaacattgggaatgtgggtctggagagcacaatggtcatgagtcaagctcactttttcacatttcttttcctttgcatatgccttcccttctgcctggaatgctgtcctccccttcttgtttctctgctgaactgctacttgtcttttatcaaccagttcaagggtttccttttctgcacagcagcaaccctatgaggtaggtgctattattatcctggttttatagatgaggaaagtgaggcacagaggttaagtaacttattcaaggtcacactgctagtaagtgaggtgactggatttgaacccaagcagcctggctcagaatctatgcttataactacttcattcttactggtttctaggtacttggtaagtacttatcatatgaatcgagtgttcacagtagtcatctatgtgcaagagaattaaggagtcaggttctctgttttaggacagtatttccagtgagacaaaaggcaatccccaaatgtttcctaatgtgttcccttttctccgttcccgttaccattcaagctttcttcatttttttgtcaggaatattacagtaggcccattactggtcttcccactccgtgtcttattccattggtgatactattattagaataatctttccaaaatgcatgtatgaccctcttattcccttgcggtagatctactccattggctccacagtgcctaaagcagttcctgatccaaactaaagagcgagctattctgtatccccagtttagaatattccagagaaggaatggcttgggttgggtcatattccgtttttggaataagttaccatgaatgttctatgcttgttccaagcaagttaccatgcttaagaacactgatttgcctggcttggatcatgcaccctatcctatgaccaaattggaagtagtaggcagagttgggagtgaagtcccacaaggacttcacatctgtgagaggccactcctaaaggataactctggttacctaactaggagaaggtaggggtttggagtagtgtcacaggaggtgggttgacacagtggtatggctgaacactgttgtggccttcagcctccccactgccttcctgtgttatttcagcagatgtccactctggtcagcactgggacaggggaggataaaagtgcacttgactataggagcttatcatctgtctggtaggggcagcagtaagcaaacaggcaacatgatccttccacaggaaaaagctggggggattctaataaacattatattgctaaggatccataattaaataatggaatggtggaatttatttcaaaaaatgtaaaacaagtattttattgattcacacttttacttttcctcagttgtcaaatttagatgactcagattctggcttgaccacttcctagctgtgtgaccttgggtacaattctctgagtctcagtctcctcagctacaaaatgggatggtaatagggttgttgtgaagggtatatgtgatgatgcatttaaaatggttggcataatacttgcacgtagtgggactcaaaaattgtaactaacaaaaaatgtttgagggtgggcgttgtggctcatgcctgtaatcccagcactttgggaggtcaaggctggcggatcacctgaagtcaggagttcgaaaccagcctggccaacatggtgaaatcctgtctctactaaaaatacaaaaattagccaggtgtggtggttggcgcctgtaatcccagctatttgggaggctaaggcaggagaatcgcttgagcccaggaggcggaggttgcagtgggaggttgcagtgagcagagattgcaccactgcactccagcctgggcaacaagagcgaaactctgtctcaaaaaaaaaaaagtgtttgaacagggtatacgtggcagaatagcagctgtgaaaaaaaatgtgaaactgcagtattttaaagatagataattttgaaaaaccagcaaacaaaccctccacaaaactatgatatccctaacattttactgtctcagtacttctatacatagggtcattaagtctgccctcgggtcatttgtggtaagtagtactacccttattgaatttgtgagaatactgaggctcagagaagtttaagttctcttttcttttttttgagacagggtcttgctgtgtcacccaggttggagtgcagtggtgtaatcacagctcaagctccctggctcaagccatcctcccacctcagcctcccaagcagctggcactgtaggtgcacaccactgtgcctggctaattaaaacattttttttttgtagagacagggtctcactctgttgcccaaacttgtctcgaactcctgggctcaagcagtcctccctgccttggcctcccaaagattatgggtgtgagccactgcacctggccaggtttaagttctgaagctagaatgcaaacctgtcttttgtggtgaaatcttattactgttacccttgctttgttctccagagtgttgtcagatattaaaaatgaatggcttatattgtaaaatgacagactaaagattagtggtatagttttgattatttgaaaatatagcagataattcttgtacaaataattcggcagggcagctcttcggcttttggtttcttaataggctgatttttgcttttaacaggatgccttgggtatggttggaagtgcctacctgcctggctggcatgtaaatgatagagaaatctgatctgcctctttacaactttgcatcagagcagagggcagctgagatagtagagtttgttagatggtaccttttggctgtagagagtgttaatatttatgtataattaattagcacatttgggaatggaaaacaatttctctcctctgctggatttctcccctcttgtagattgcaagatttatgtgtttggaggaataagaatcttccactttctcagtggcatagcaactctacatgctaatgctttcaaaagaaacaaaaatcttaaaatggagtttgtttttttttaattgatatgtcatttcttatttggggctcacagctcttgtgctgtaaagagcataccaaatctttttttgcttggttaagatgtctccattgtttttgtttttaaaatatgaagtgttttttctctctcttttctccctcagtccttacttggtttattttattattattatcttattttttatttttatttatttattttatttatttatttattttaagatggagtttcgttcctgttgcccaggctggagcgcaatggtgcgaccttggctcactgcaacctccacccgccgggttcaagcaattctcctgcctcagcctcagctgggattacaggcgcccgccaaaatgcctggctaattttttgtatttttagtagaaatggggtttcaccatgttggccaggctggtctcgaactccagaccttaggtgatccacccaccttggcctcccaaagtgctgggattacaggcgtgagccaccacgtctggcctatttatttatttatttatttatttattgagacgtagtcttgctgtgtcaccaggatggagtatggtggcgcaatctcggctcactgcaacctccacctcctgggttcaagcaattctcctgcctcagcctcccgaatcggtgggactacaggcatgtgccaccatgcccaactaatttttgtatttttagtagagacggggtttcaccatcttggccaggatggtctcaatctcttgatctcgtgatccacctgcctcagccttccaaagtgctgggattacaggcgtgagccactgcgcccagcctattaccttattattattattattttttaaagagataagatcttgctatgttgcccaggctggtcttgaactcctgggctcaggtgatcctcctgcctcggcctcctaaggtgctggggttacaggcatgagccattgtacccagtctccttaattggtttaatgctaaatgtttaagcttataaacttaagaaggaacctcataatactttgggtttacagtggagctctccttttaaacttgcattgggtgggtaaacttgctctgtggttgccctggaaaaagaggggcttaggtgaggtgaacattgctttgattccatactgtactgctgttgagagactatctgcaggctgaagtttggataggataatttgtatacccagttagtaaattttttcttttttttgagatggagtctctctctgtcgcaaggctggagtgcagtggtgcgatctcggctcactgcaacccccacctcccaggttcaagcaattctcctgcctcagccttctgagtagctgggactacagtcacgcgccaccacacccggctaatttttgtattttagtagagatggggtttcaccatgttggccaggatggtctctatctcttgaccttgtgatccgcctgcctcggccccagttagtaaattttaatccgccatgtgctgagcactgtgctagatgctagagatttagaaatgagtctgacaaaatgccagtcttctaagagttcatggtctatactctagacagacaatgaaccagtttcaatgtgcctagggtgttttcacttataaatgtacaggattctaggggagggatataggaactgcctggaagaatgagaaggagggtatcagtggatgtacacacacaggctgtgaaaatattccttttctgggcagaaggagggttttagatggtcagatgggaacaggggagagaggtataggaggcaaggatggagaagtattagtaataaagccagcttctagcttctttttttttttttttttttttgagatggagtctcgcactgtcacccaggctgcagtgcaatggtgtgatcttggctcactgcaaccaccaccttctgggttcaagcgattctcctgcctcagcctcctgagtagctgggattacaggcgcgtgccaccacgcccagctaatttttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttgagatggagtctcgctctgttgcccaggctggagtgcagtggcacaatctcggctcactgcaacctccgcctcccgggttcaagtgattcttctgcctcagcatcccaagtagctaagactacaggtgcgtgccaccacgcctggctaattttttgtatttttagtagagacagggtttcactgtgttagccaggatgatctcaatctcctgacctcgtgatccgccgcctcggcctcccaaaatgctgggattacaggcgtgagccaccatgtccagcctttttttttaaagagacaggatcttactctgtagcccaggctgtaatgcagtggcttgatgatagctcactgaaacctcgaactcctggattccagcaatcctcctgcctcagcctcccaaatatctaggactacacgtgcataccatcctgccagctaattttttttttttttttttttttggtagagatagggtcttgccaccttgcccaggttggtctcgaacccttggtctcagcagtcctcttgctgggattacaggtgtgagcccctatgcccggcggacaacttcattatacccaaggaagaattaaggctctcttgcccaaatttctatgcaaatggacttttgtcttctgtatccagaaactagaagaggtacctcctattcttttccagtcagaattatttgcctcttatctttagttctttgtgcttcaatatgtacggagcattatgtctaatttgaccatgtgactaacacaagtttagagaagcttttgctgtctgtagaacacagttgtgtttacaaagttctcagagtttaaaaaatccacgtgtatttcagaactaaattttttcaagtttaattagaacataaggtatcaaataaagtagtaaaagttttttctggccaggcgcagtggctcacgccttgtaatcccagcactttgggaggccaaagcgggcggatcacaaggtcaggagattgagaccatcctggctaacacggtgaaaccccgtctctactaaaaacacaaaaaattagccaggcgtggtggcaggcgcctgtagtcccagctactcaggaggctgacgcaggagaatggcgtgaacctgggaggcggagcttgcagtgagccaagattgtgccactgcactccagcctgggcgacagagtgagagtctcgaaaaaaaaaaaaaaaagctttttctgctcaaagttgcctgtaacaccaaatgaataaaggatgtggtaaattattttcttcctgttactacacctcagaacctactgcgtcattgctgcattgtgttataggatgtgcttttttattgttagtcacaattagattataagttccatgaggacagatggtttgttttgctccctccctaatctcaatgtctagcatatagtaaatatttactaaatgaatgaaaaatgtcctagttttttcctgcttatttctgcatctctttgtttcttttccttcctattttcgttgtacttaaaatttacatgactcatgttgaaggactttcaatagttttttttttcagagctttattgagatataatttatatatcatgaaattcacccattttaagtgtacaatttatttttagtaaacttacagacttgtacagctatcaccacactttgagaacatttttcacccccaaaagttccctcttttgtgtctatttgcagtcactccccattccccctgcagccccagcctaccgctcatctactttgtgtttttctggttttaacttctctgggaattttacataaatggaatcattcaatatgtggtcttttttgagcctggcttactttttactttgcataatgcctttttttttaattgaggtgaaattcggataacatataattaatcttttaaagtgtataattttgtggcatttagcgcattcacaatgttatgcacccacggcagctctctagttgaagaatcttttcattccctcagaagaacaacctgtacccaataaataatcacttttcattctcccctcctttcatctcctggcaaccatcagttggctctatgggttaactattctggatattgcatataaaagaaatcatacaatatgtgatttttttgtgtctggctgcttttatttaaatgtttttggggttcatccaagttgcatatgtcagtaatgattcctttttatggctgaagacagggtcttttgctctgtcacccaggctagagtgcagtgccatgattgcagttcactgcaaccttgacctcccaggctcaagccatcctcccacctcagcatctgaagtagctgtgactacaggcattagccgctgtgcctggctaattaattttgtttgtttgtttttgtagagacgaggtcttattatattgcccaggctggtgatcattccatcttggcctcccaaagcactgggattacagacatgagccactacacctgccccattttttttaatttttaaagttaaaattaagagatagtctccctctgttgcgcaggctgaagtgcagtggtacaatcatggttcatcacagcctcgacctcctgggctcaatggatcccctaccccagccccctgagtagctgggactcaagtgcatgccacctcgcctgactaatttttaaattttttgtaaagacacggggtctttctatgttgtgcgggctggtctcaaactcctgagctcaaatgatcctcctgccttggcctcccaaaatgctgagattataagcatgagccactgcacccggccccttgtcaattcttataggaccattgcattcatttaaatggctacatagaggtttgtactataactgtaccaatattcccttaatttctttttctaggcaatttgtttctcccttttgaatattatatatgataatataatgattatggcgtttgcatatacacatgtatgtacatatgcacatatacatatatatgtatttactgtcagccctttgtatccgtgggtaccacatctgtggatttttatttttttaatttaaaaaattaaaaaaacatttttttaagagacagttttactctgtcgcccaggctgaagtgcagtgttgccatcatgcaaatactttcaggaaaaaaattccacaaagttccaaaaagcaaaacttgaatttgctgtgtcaagtactacattaaatccacaggaatgaagtagtgtataggcatattagtaggtattataagtaatctagagatgatttaaagtacacaggaagatatgcataggttatatgcagatactgtgctattttatatttttgagtatcttcagattttggtatccatgggggtctacggaaccaattccccatagatactgagggatgattgtatacacaaatatatgtatatattcatctatacgtgtgtgtgtgtgtacacacacacatttatttctctccacatgtgagttttgtttagaacatattcctagaactggaattgttgctgggttaaaggcagtttacatttaaaattttgacaaaggctgtcaaattatccttctcaatgttaagatcactctgataagtgtgaagagaattgattggcaatgggaaaaaaggtttggaggctactgcaagtcatccaagcaagaaatgatgtgcctcagactaggatgatagtggagatcaaggtaggtagactgatttaagagatgaagtgggagggagaacagatggaattgttaatgaagtagatgtgagtagtgaaaggaaggagtctagaatgactcaggtggatctgtgacttcaactagagttgctatgtgagatgaagcctacttgtcatggccagaccagatgacttcacagatactctgtaactctgacattttatgattttagaatttatgacagcacccttatttatagattgaatgagatccatattgaatactgtgtcttttatagcagtaaagatataatttcatttgattggcatttgtagagcaagcactgacacattaagtctgtcactaaactatatagtttttttttttttttttttttttttttgagatggagtcttgctctgtcaccgaggctggagtgcagtggcgcaatcttggctcaccacaacctctgcctcccaagttcaagtgattctcctacctcagactcctgaatagctaggattacaggagtgcgccaccacgcccagctaattttttttttgtatttttagtagagacagggtttcaccatgtttgccaggctagtctcgaacttctgacctcaaatgatccagccgcctcggcctcccagagtgctgggattacaatagtaagccaccgtacttggcctaaactgtatagattttttctcatctctggaatctatttgttttccttctgttcataagccacacatctaacctaagccactacctttgtctatcaactatagccaaagtgatctttatacaatctaatttgcaatgactccttttctccaggtactttatattgtaacagaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggctcacgcctgtaatcccagcactttgggaggccaaggtgggtggatcacttgaggtcaggagttcatgaccagtctggccaatgtggcaaaaccctgtctctactaaaaatacaaaaattaacaggccaggcacggtggctcacgcctgtaatcccagcactttgggaggctgaggcaggcggatcacctgtcaggagttcaagaccagcctggccaacatgatgaaactccatctctaaaaaaatacaggccaggcgcggtggctcacgcctgtaatcccagcactttgggaggccaaggtgggtggatcatgaggtcaggagatcgagaccatcctggctaacacggtgaaaccccgtctctactaaaaatacaacacattagctgggtgtggtggcgggtgcctgtagtcccagctactggggaggctgaggcaggagaatggcatgaagccgggaggcggagcttgcagtgagccgagatgtcaccactgcactccagcctgggcgacagagcgagactccgtctcaaaacaaaacaaaacaaaacaaaaacaaaaaacccatctcttaaaaaatacaaaaatatagccgggcatggtggcgggcgcctgtagtcccagctacgccggaggctgaggcaggagaatggcgtgaacgtgggaggcggagcttgcagtgagccgagatcgcgccactgcattccagcctgggctacagagcgagactccgtctcaaaaaaaaaaaaaaaaaaaaagaaagaaaaaaagaaaatttcactactttatatcataacattatcaataaatttggtagacttcttattcaattggaatgatacaaattagatggaatatagatgtgggcagaaataaaattgccaggttgaatatattgaaggtatagtttgttttcaaagaaatactgtatttcctatattgtcttaatattatcacattgaacaactatttgtgattgagtgtagaagactatgaactgacccactgcttggttttgaggggcttaggtctattgtaaaagacttttgcaaaaagggaggataaaaatgcggcctggtgacataataatgactaaatgttgcttctttattttgcagttccagttcctagcagatttaatagacgagtatcaggtatgtgttctatttcataacatacttctaaaatgttattttaagataggaatatattgaaaaaacagatattttgaataaaaagataagctcccatcacagaacattatctaaaagtaaaattacctatggtttctttattctgtttttattttaagttctgagtatgtatgtacgtattttatactataattggtacagtttgtctctttgcgtttatgtcattactgttttttcatgtttataattacagcttcaaaaaatgatttttcatattcctttttctggtattctggcttatgctgccattaactcttacatatacctttttgagccacttgaattatttcctcagttttggtgctggaagtggcattctctggtcagagactgagcattgccttggctttttctgtcttgttttgtagagagagtccacagattaggctactgggagaaaggcaccctgtacctgcctcttttccaccattatcttaataatatggaatttaaatgtaaaatagtacttcacatcattttatatggcatttcttttggttgttaaaaaaatgaatgctgtccaggcgcggtggctcacacccataatcccagtactttgggaggtcttggcgggtggatcacgaggtgaggagtttgagaccagtctggctaacatggtgaaaccccgtctctactaaaagtacaaaaaaattagccaggcacagtagcgcgcccctgtagtcccagctacttgggaggctgaggcagagaatcacttgaacccaggaggtggagatttcagtgagccaagatcacgctactgcactccagcctgggcaacagagtgagactctgtctcaaaaaaaaaaaagaatgctttccaaatatgagaaatctatttgtattttcttatatggtactagtttggtaatattttgcccttttatctggtatagtccatattattttaaaaataagtttgggtaaactttctatccaagtttctgaccttttgaaatttttaatgcaaaatttccctaggtggttatgctatttttttaattgagttagagatgttaatatatgactgataacctcaaacactgctggacacataggcactcagtaaatatttattgaatatgcacatcatcttttttaaaaaaaaaacaatgattgttcctgagaaggctccccttttttccatagagctggtaaatatattttatgaaagtttttcttaaagtgtttgactttttgataactctggaatttatttgggagtacagtggaatgttaatgtgttttaaaattgctaggcaaatggtatgttctttcatatttccttgttttaggaaggtttcttgatttgaaattgtcatctggcctattatagggctaggaattgcttttctatccctcaatccttgtctttgagaaaatcggctcatttatgttttcagaaagcgtttatcattccacataaaaatctgttgaaaggaggttgaagaatatgttatgttaagagagtcaatatcctgagagtagggattaaggttagtttgatacccatgagctattatcttccatttttgttcatgtctgccctgcacctttttttcctctgaaagattagttaaatcccttgacatctgtaggataggtctgggagatggagactatagtgatacctcctcctgaggtcacagttggtgttagtttgtttggccctctgccattgttgttcaaatcttgaaccttgtagaagactcagacaagtacatggtattatccctcctccttagattttataatcttaggatttaaaaccttttcatatcattgaaatgttaaatgaaaataaaagatttttcaaataattcaataggatgatacaggagagaaagtatcctttaataatacgtaacattttttaagtgcagaccgtgtgccaggtgcacagttataaggactttctaaatgccttccttgtattgttgaatataa

SEQ ID NO: 14868 - DNA, 52874 bp, Human
catgtttttgtagataagagaattccagcctaagctacattggatccaaaacagctttccatgaatcacccatgactatctgttttttggttttatattgctttccttgaagaggactgaggatactgtaccacttgaaatcatggtcactgttcataattttttcaacaaatatttatgacacatgttttatgttctagacattgtgctagatgttgggacaagatatgcaaagtctgagccctccaaggtgtgtatgacacaaaatagaataatcacgggaaatgttgagaaatgtcctggcttggatctagttatttctaatacaagaaactaagagaatgagacaggatctgattcttctgctcattgtaacaagctttagcataggcataggttgataatggatgtaggcatggggttagaatgccttgcccattcacatttatcttgtttggtttttacaaatgactctgttagtcgggaatgcagggcaggaattctctcgtagaagctggaactgaggttcaggaaaggtcagttgacttgcctaaattcgatgagactcctgccctattctccttactcgaagaggcctgagttaaatgcttaaaatcctcttcactgatggctcttcaggataggagtcagtttcaaatcttcagtgtaacggttttttaaatgcttctcaaagggagatatcagagactttcctgaatcagaatcacctaagatgtattataaaaatgcatgctcttgatcaagacctcctctgacctacccaattagactccctgtgagttctgggaacttgcatcttaaactcccagggtgatttttctgcatgtaagtttaactgggagagttttaatgtaaagcttcggtttgtttttgtttttgtttttgtttttgagacggagtctccctctgacgccaggctggagtgcagtggcgcgattttagctcactgcaacctccgcctcctggattcatgcaattctcctgcctcagcctcccgagaagctgggactacagggtcgtgccaccacgcccagctaatttttgtattttttttagtagagacgaggtttcaccatgttggccaggatggtctctatcgcttgacctcgtgatccacccgcctcggcctcccaaagtgctgggataacaggtgtgagccactgagcccagcccctggaaagcctcagctttgatgcagggttaacatttgcctttgggacatatttcgtcagcatctcaaagagtaacccatatgtccttgagcagatgggaatgcaacagccttctggccggaacctgtctctttctttctttctttcttttgagacggagtttcgctcttgttgcccaggctggagtgtaatggcacgatctcggctcaccgcaactccgcctcccgggttcaagcgattctcctgcctcagcctcccgaatagctaagactccaggtgcgcgccactacgcccggttaattttgcatttttagtagagacggggtttctccatgttggtcaggctggtctcgaactcccgacctcaggtgatccgcccgcctcggcctcccaaagtgctgggattacaggcgtgagccaccacgcccggccacttgtctcttttttatgcaagtgttttttggaatttgggggttcaggtgagcaggtgctctgctgctggtaactactcgcagttaaagatcttttgactctttccccgacacgctatttgtcagtgtcgttttccaccacagagccaggtatttgccccgccggccacggtgaggcgcgcgaggcgtgtgctgccagcttctctcttccttccccggtccgccttcgcgcccttaaggagacagtccctgggagtttctgcctttggtctccagttattgttctcttctcgcgagaactgctcctcccatcctcttctctcacgaagccccgcccgcggagaggttccatattgggtaaaatctcggctctcggagagtcccgggagctgttctcgcgagagtactgcgggaggctcccgtttgctggctcttggaaccgcgaccactggagccttagcgggcgcagcagctggaacgggagtactgcgacgcagcccggagtcggccttgtaggggcgaaggtgcagggagatcgcggcgggcgcagtcttgagcgccggagcgcgtccctgcccttagcggggcttgccccagtcgcaggggcacatccagccgctgcggctgacagcagccgcgcgcgcgggagtctgcggggtcgcggcagccgcacctgcgcgggcgaccagcgcaaggtccccgcccggctgggcgggcagcaagggccggggagagggtgcgggtgcaggcgggggccccacagggccaccttcttgcccggcggctgccgctggaaaatgtctcaggagaggcccacgttctaccggcaggagctgaacaagacaatctgggaggtgcccgagcgttaccagaacctgtctccagtgggctctggcgcctatggctctgtgtggtgagtgtcgctgggcctggggccgctgtgggcagggtggcccctcgcgcccgagggccaggcctgctccactgctcagcgttgcgtcaagtggcaggaattttcctcgggggagggcattgctgccccttcgagctctgcccgttctgcacctccagcacccctcgccctgcactcacgcaggtatgcggtccaccgtgtgcagcactcaggtccgctgcgagaggtaggtggtggtgctggagctcggttctggctagcaccctgcgccttcccctctcggagggttgctgctcggcaacaggcaccgggggaagggccgcttccttgggggtctccctgcctacctggagcagaaggaccctctcccgtgatgcgcccacgctggggctccggaccctgggtcctctgagcagacaagctcggggaactgccgggagaagcagaagggcacagcccaacccgaagactgcggtcatctgaacaaaactgaccaggaagggagctctctccgggcctttttttttttttttttttttcaaaactctgtcgaaatcccatcttgaaaagcgttctttttgaattcgcacttgaattaacagcgatccatagagcttaaaataccgactttatctcggtgagcactgtgccagcttgagtggtgtgtttccgattcggttgaaagcgtatttcctttccgtggaggggcggcggtggtagtgcctgcaagaacactgcagcttgagaaactggcaggctcactgattagtcacataccactgctcatttaagtattgttcgacaaaacaattttctcatttggagcaagaaagattcagatctgtaaggcgccctcaagatcaaaaagttattaacagtgctgggaggtattgtaaatattttttgagataattcctgcgaatactgtgttttaaaagtcccttagagagcttgcagggagttatctagttatctgcatttatggcctgaggtacacgatggttttcgtaaggatatggaaccacatagaaaaggaagggaagagatactttttagctttaatttacaccgtgagtgtgttttaaattaagtcgatagcatataatttccagacctgaaatatttcactaactgctctcttaacttccaaggttttataccctgtattttagattttctataatttgaaagctacggatcttaaactaagtatcagatttaactgttagctttttctgtgttttagtaattcgtattgtatgcgtcatttgaaaacgggcctgtaaaatcgtttttttgttttggaacaaattccaggcttttggatgtgttaatctttaaatatgatttctgtgtttcccaaagtcacatcatgaatttcctgtttggtagaatcttctgggtaattgagattgtgcaattgtgtccagcaacagatcatattgcattttctagttcaagttgcttaagttatgttgcagatagcaccgtgcttgacatctttctcccatttttacagcatggcagtttacattttaaaggaatttgcagcattttacattcagagagtgtgtgtgtgtagttggtttgcagcattttacattcagtatatacatattatataggtatatacattcagtatatacatattatataggtatatacattcagtatatacatattatatatatctagttgatttgctaattttcaaagacgtatttggatcattgctcttttaatattttatagctcattaatatacttccattttttcattcttgaattgacatacatttctgtagtatcacgttttcgttttcaatgctatttaaattttaatggagtgatacagcagaataactcaactatagagggtttgggtgaactccaattgaattgcttgcaagggttcgctactattggtgactagctctgcactggaacaggagattcagatttacagtgaagtaccattaaaattaactccacagttctttagtggtatacttttctgtggtatagaagccagcagtatctgacacttaaaagtacttttattttattgaacagattttttaaaatacattgacattgtataaaatttgaaagttttacaaaggtactcagtgggccgggtgcagtggctcacgcctgtaatcccagcactttgggaggccgaggcgggtggatcacagcgtcaggagatcgagaccatcctggctaacacggtgaaaccccgtctctactaaaaatacaaaaaattagccgcccgtggtggcgggcgcctgtactcccagctactcaggaggctgaggcaggaggatgatttgaacccgggaggcggaggttgcaatgagctgagatcgctccactgcactccagcctgggcgaaagtgcgagacgccgtctcaaaaaaaaaaaaaaaaaaagatattcagtgaaaagtctcctttcctttttgttctccagccactctactctctcaaagacaggcactgttaagtgtcttgtgtctttccagagaggcagttttttttatttgcttgtttgtttagtagtctttctactaaagggatttaagatgtaacctacagcatattggtgaaagaaaatacaactgaaactgaaattgtatgacaattgacaataaacaaattataactaatgttggaatgaaaataccagaatttagatttacaattaagtgttatcttattcagagattcagcgtagttatttgaagtttttcttttctttgagacgaagtctcactctgtcgcccaggcttgagtgcagtggtgccatcttggctcactgcaacttccacctcctgggttcaagcgattctcctgcctcagcctccctagtagctgggactacaggtgcccgccaccatacccagctaatttttgtatttttagtagagacggggttctccatgttggccaggctggtctcagactcctgacctcaagtgatctgctctccttggcctcccaaagtgctgggattataggcctcagccacggtgcccagcctgaagttgttctttcaatgagtacctttttaggtgtggcagaaaacattttttggaacttcttttagaatccactttggagcctgtgatattcttcttcttttttattttgagacagagtctcattctgttgtccaagttggagtgcaatggcaccatctctgctcactataacctccacctcatgggttcaagcgattctcctgccttaggctcccaagtagctgggatacaagtgcgcaacaccatgcccggatgatttttgtatttttaatacagacagggtttcaccatgttggccaggctgatctctaactcctgacctcaggtgatccacttgccttggcctcccaaagtgctgagattacaggggtgagccaccgtctctggccatccatcttcatttttttgagagcagatttgattttagggaataacagttcatttgaatccaaataatttagggaatttggactcaagtctgataagaaagataaggcaatcaggttggtgatactactgttttaggtcagataggagttataactataaagtaacaacacataattttttgtgtgacttcttgaactggacctgaagtctacttccaaaaaaatctccgaattttattttatttatttatttattttgtagagatagggtcttactgtgttgcccaggttggtctcaaactcctggcctcaagcagttcccccaccttggcctcccgaagtgctgggattatagggatgagccaccacacccagcccctgaattttattttcaagaatgaaaataaatgaatagaatatttcaatgaataaaattcattcattgaaatatttgtcagtttccgaattttattgctctaaagtgtggtatactttgtaacatttacaaattattttaagcctatattattttaatttatactaagtatagtaaaaaaacaagtagaagcctgtgtgataaccaactatgaatcaaaatagagttttacaaatatgcctttccgttaaagggtaaagggaactagactaggtcttgcagttttaaggaactttatgcattgtctgtgaggggaaatgaagcaaaattgtttaagaatacattgttgcaaagcattgattttggggttttgggacagaaggggagaatctttgtggtgagtttaaggaaatacaaacaggaacttaagtgcctttcctctggggtagggttcttccaggcccttgctgttgattagaggaggtgggacactggtaaccatgaaataggaggtgacagttgagaattactcttagatcttattcaactgtttattcaacagtgtttattgaatacctaccatgggccagatagctaggttctggaaatagagtgctaaacaagacagaaacaagacaatccattctctcctggaacttacagcctagtgggtttaataactacattttgtggattgcttgctatgttctagcattgtgctgtgcactttatcatcagcataaaaagtatataacaaaacctttggtaaaaggatagcaaaacttgctaagaaatcaaatacaacttcctaagtgctttgtggaacaagattattctagtataaaagaaataagtgaagctaactttttttaactattaatggccattcaccattttaaatctattttttttttttttagaatgagccagggcacaaagaaataaaagtgcatgattattaagtatacaagggtgactttcttgactcctgaccagtgagaagggtgtgccctttacttttctagtagtgatagtaggtccatgctgagctttccattcttttctttgtaaccaaaagtaaggtagttgcctgtatgttaccagtgccagtcaataagaagtctttaaacataattaacggcaagcatttgtattattgatgtataaagattgttttaagaaagagttcattcgaagctggctataaagtcattttattatcaaatcccatttttccactttttttttttttttgagacggagtcttgctgtgttgcccaggctggggcgcagtggtgcaatctcggctcacggcagcctctgcctcccgagttcaagcaattctcctgcctcagcctcctgaatagctgagattacaagtgcgtgccaccatgcctggctgatttttgtatttttagtagagacggggttttaccatgttggtcaggccagtctcgaactcctgaccttgtgatctgcccaccttggcctcccaaagtgctgggattacaggaatgagccaccacacccagcctccactggttcttctttaaaataagcttatcctggatctccaggttttcagttctgccagtttgatttcttgatactgaggagtactctgcttttgatttctttctagcccagtctcagagatgatgtgttgactttgcctttcatgggcaagagtgcagatattgctgagcccctggggcctagaattcaaagatggaagaattcactggggtagatcaccctcactttagaattaactgacatttttagggatttttgcagtttataaagtgttttcattcaaagcattatcaatcagttctcactagctccatggaggctcatatttattaactccattttatagatggggagctggactcattcattaaaggaatggcatacttgtcaatgctacttttagtagtctcctttctgatagatgtgggctgctgaggttgcgcggtggcaccttctcttatgcagttaacctcctcttgtgaaaaaggggttgctgagtcactcggaatagagcttgagtgtaggaaagcagttccaccagtgtcattgcccagtttatgtgaggggtaatgacttaacccatttaacccattagagtcatgtctcttcctcagaactgataaatcaaaaatgcactcattgcccagattaaaattttttctgaaggaattattaggcagtgcaaatagttaattcctgaatttatgaatcctattggattgaaattcttcagtgtacatttatgtaaagttgggactgtctgtacatgtttgtgttacataagtataggatataaatagaaataactgcctctccagccctttgaaaatacattagatttttgctttttgcagtaaaatttggggtaaaactgatttgttcttatctaagaggtataattactgcagtgctcagaaaagcctcattataaagtgggctcccctgacttggaacttagggatgtcttctcatggctgctatggaagtcatgcagctgtttcgtcaggaaaataaccaaaaacttctttaaacttggaaatgtttttgtaaaagaaactttcagtattcagagtagtttgtctttcacagtgcttccataaattaagcacaggcacaactcgttttattatgcttcacagataattgctttttttttgcaaattgaaggttagtgacaaccctgtggtaagcgagtcttttggcaccatttttccaaaagcatgtgctcacttcatgtctctgtgtcacattttggtaattctcgcaatatttctttctttctttttttttttttttttttgagacggagttctgctctgtcgcccagactggagtgccatggtgcgatctcggctcactgcaacctccgccttccggtttcaagtgattctcctgcctcagcctcccaagtagctgggactacaggcatgtgccaccacacctggctaatttttgtatttttagtagagatggggtttcaccatgttggtcaggctggtctcgaactcctgaccttgtgatctgcctgccttggcctcccaaagtgctgggattacaggtgtgagccaccatgcccggcagttctgctgggattacaggtgtgagccactgtgcccggcagttctcgcaatatttcaaactttctcattattattaaatattatggggatctgagatcactgatctttgatgttgctgttgtaattgttttgaggtgtctggaaccatgcccataggcagacttaattgataaacattgtgtgtgttctgactgctctgccaaccagctgttccctctctccatctcctaaggcgtccttattccctgagacacaataatactgaaattaggccaattaataacactacagtggtttctgaatgttcaagtgaaaggaatgtttgcatgtctcttactttaaatcaaaagctagaaatgattaagcatagtgaggaaggcatgtcgaaaactgagataagctgaaagctaggcttcttgtaccaaacagccaatttgtgaatgcaaatgaaaagtttttgaaggaaattaaaaattatattccagtaaacaaatgaatgattagaaagcaacacagccttgttgctgagctggagaaagttttagtggtctggataaaagatcagaccaaccacaacatgcccttaagtcaaagcctaatctagagcaaagccctaactctctttaattgtatgaagtttgagacaggtgagaaagctgcaaaagataagtttgaagctagcagagggtggttcataggtttaaggaaagaacctgtctccatagcataacttatagtgcaaggtggctgggggcggtggctaacacctgtaatttcagcactttgggaggctgaggcaggcagatcatctgaggtcaggagtttgagaccagcctggccaacatggcgaaactctgcctctagaaaaaatacaaaaatttgttttttatattttttggtgttgtggtgtacacctatagtcccagctgcttgggaggctgaggcaggagaattgcttgaacctgggaagtggaggttgcagtgagccactgcaaccaagtggcaaccgagatcgtgccactgcactccagcctgggcgatagagcaagagtacatctcaaaaaaaaaaaaaaaaaaatcaatagatgagaaattgcttctcaggaatgaataaataaagtagtttcttgaggtggaatctgctgttggggaagatgcttatgaacattgttgaaatgacaacaaagggtttagaatattacataaacttagttgataaagcagcagcaaggtttgagaggattgactcccattttgaaagtagttctactgtgggtaaaatgctatcaaacaccattgcaggctacagagaaatctatcacgaaaggaagaataaatcaatgcaacaattcaccgttgtcttatttttagaaattgccatagtcattccagtcttcagcagttatcaccctgagtagtcagcagccatcaccctgagtaggcagcagccatcaacactgagacaagaccctccaccagcaagaagataataacttgctgaaggctcaggtgacccttagcattttttagcaaaaaaatatttatttatttatttattttttctagatggagtctcgctctgttgcccagcctggagtgcagtggcacgatcttggctcactgcaccctccacctcccaggttcaagcaattctcccaccttagcctcccgagtagctgggattacaggtgtgcaccaccatgcccagccaatttttgtatttttaatagagatggggtttcaccatgttggctaggctggtctcaaactcttgacctcaagcgatcctcctgcctcggcctcccaaagtgctgagagtaataggtatgagccactgtgcccggctaataaaatatttttaaattaaggtatgtgcatatatatatttttttgacatactgctagtgcatacttaatagactacagtatcatgtaaatataacttttatatgcactgggaaaccaaaaaatttatgtcactcatttttttgtgatattcactgtgttgtggttgtctggaactgaactcatgatatctttgaggtacacctgtatgtatgtgttaaggatttacaaaattaaccagctttcccgtgcagtgttcaagtcttttaataatttattatagggaagaagaagtggtggtttgtaaattctgtacttgacaaatggatactgggttttgggcatgcttggctccaaggctgaatgttgggggaaagaagtataggagagtgaggagtctaggatttctaagttttggccttgggcaaatggatatattttagtgccattttctgaactttgtgttacaaagttacaaaagagtgttacagggtacaagattgtagagagaaaggggaaggagcataggttcatggtaatctccttgaggacaggactcattataccttgagtgcctaccatgtatggtttgccgtaagtgctggagatgaaatgtgaacaaaagagacaaaaatttctgccttaagaagctatattctggccaggtgcagtgagtggctcacacctgtaattcctgcactttgggaggccaaggtaggtttccttgagcccagtagttagaaaccagcatcctgggaaaaatggggaggctcctctactaaaaaataaaaataaaaaattagggatgcttggtggcacactcctgtagttccaactacttgggaggctgaggtggagggattgcttgagcctaagaggattgcttgagcctgggaagttgaggctgtagtgagctgtgatcctgccactgtactccagcttgggtgacagagtgataccctgtctccaaaaagaaaaaaaaaaggaagctatattctaatggggatggcagtggaagtagataataaacaaaatatatagtgtgtcagataagtgctgtggagaaaatgcaagaagggaaggagagtgagtgctaggatggctgttgcacttttaagaaaggtgaatacggtaagcatcattgataaagtaacaattgagcaaaaacctgaagaaggtgatataggacactggttggacatgggtgaggatgtgataacattctaggctgaggattagcaagtgtgcaaaagccctgaggtaagggccctgtgctccaggaaatagctaagagaccagtacagctagagctaaatgaaccaggggccaaatatagggagaaaagtggggtgaggagagggttgcagatatgcagggatcatgtagggtcttatttgcctttatacagactgtgacttttcctttaagtgagaggggaagccttggagggttatgaccagaggaaggacatgacctaaatcttgttttaacagattactgtgctctagggtcccaagtttttcgtttcggttccttacccattctaccctaaaccactactgtgaataggatagaacggtggagttagatgaattggtgcaagccctgacccatgctcacaactctcattccagcagtcccagagtgccagagccagtatttttgttgggccctagaaatttagggtattccagtccagctctttaaataacatgggctgactttactttttcaggtttttgttgccaaaaggaaggagcagagattagctcttgagtttagctgaaaaaggaagattagtctgctggcagattgagtgttttttaacttctttggcttttagggtttttcttacttttggatcatgttttaaaagtcatttttaccttctttcaacagttaaacatttaagttttatttgattttatttgaccctttttctgctttacattcctctgccttttccccattataatacttttagtagaggttagaccattgttatctgtcattaatgtcttagctttgaggccccaaggacttctctgttaaacttaaatatatcatatagattgaaagattatctacagacatgtgatcctataaaaacccatattatttattgtcctccctgcctttacagatgtaaacccctctcctcttttcatcagagctccccctcttttactgctctatcatcaggttgcagaaaataagttttcctgcaaacatagattcccatggcaacataacaaaaaggtaatagaacaaatgtttattttgtctagacctgctgtctgagtaccattagaccctgaacatgttggctcctgttatttgaatatgtggttacaaattccttattttcctcaaaacttacttctcttaggccttggtgatattgtcactgtgcctgtgatatgaaggaaggtgtgtgtgtgtgtgagtatgtgtgtcttactgtcattctactcaaaagtgtgtattgattgcattttcaaacttatggcttaaaatgtagacaccacacaatctgagcatgtgaagaaaaaaagcataccagttttgttctttgttttcgtaagttcattaatttaatatttccagtgcactatactagatattttgtttacagagattttaaaaaaaagaagggtccctcctttcgaaagtatcagtccaggctgggtgcagtggctcacgcctgtaatcccagcactttgggaggccaaggtgggcggatcacttgaggtcaggagtttgagatcagcctggccaacatggtgaaaccccatctctacaaaaattagttgggcatggtggtgtgtgcctgtaatcccagctattcaggaggctgaggcacaagaatcacttgaacccgggaggcggaggttgcagtgagccgagatcactcccctgcactcctgtctgggcgatagagcaagactcagtctcaaaaaaaaaaaaaaaaagaaagtatcagtccagaggagacatatttatgtttcctcatagatggctttggaagtcctctgtagttttggatcttgaagcattttaggttttggattttcagattagggatactcaacctgtataacccagggtaattcaacctattgacactttaggtgggataatgttttgttgtgggggactgacctgtgcagtgtagtatgtttagcagcatccctgtctccaactcactgtatactaatagcaattcccagttgtgacaaccaaaaatgtctagacattgccacatatctcttgacgggtagggagggcaaaatcacctttagttgagaaccacttatataaccctatatatttggattgataaccctgtatatttgattgagtaaaaactagatgggataacatgaaccttccacctgcaaaaaggcagaaatgctatactttctgcattataaattgggcctctctaaacatgatttttgttatttctaggagagtaacagcatttctaatggtcaaggtcctagctataacccaataagcttaatggatgggagaacttgcacaagcatgtttgcaagaggccaggtgtatcactggcacatttgagaaacaactaattagtgagggagacccaattttcatgaataattgtgttttgtcattgtcatggccccaacttagggtgttttgaattttttctggaaaggaaattagcatgaagtccaagttggtaggtaggtagcattttccctagtgtctcttctggtattctgtgtcctttctctcctgtcttctttcagtatttagcgttttcaaactcctagaaataaaatgctgtttagaagaccacaaagagagctgcacataaactaaggagcaagaagtagtacattgtgaattaattttctgtatgtttttgaaggttcttgcatctgggaaggcttgcttagttttaaaaatattaggtaataacagactgaaattttgaagatcttgtggatctcaggtagcagtaactcaggaagatcagccttctttgatttagaatgtcatttaggcacattatgtattctggtaccttagaagatacaatgccttttcctgaattatcattgctactgctttaattactttaagggtgtgaggcagtaactaactttagtgtcacaatgtatacatcttaacatttattgtgctcttttttttttttttaaacaccaccttaaagtactctgctattcagatttttccttgtgtttctctaattctcctatttcatccattggtcagttttttcttcctcttttctttctgctccatgatccattcttaaattttcttttctctttctgtgcatattctttttgaattcattatctgatagtctcaacaatggtcttgttcatatactatccttccaaatttgtactttcaaacctaatctcaagaatgactgatcctttggattctaaatctattgagatgtaatgtttcatgcttttccttgattactttcctacacacttcttgaagataccagagatgtagcactaacttccgttggaatgggattcatgttacaaacttgaatggttcagtttagatatgtgaagcggatgtcatcattagcactgatgactgacagtagttataaaaattacaatcaggaatgaaccaatttacctgaagttttcaataactctaggtattaatgcaacataattttgaaagtttgaaatatataggtataaatattgatgcttatattttagatttactgtagtgaaggaaatttgccagtcgtccatcagtgttaaatgcccaccaatgtgtaaaagaaatagacctaaaatattaataaattgtgtatatatgtatgaaggtattgatgtgtacagagaagtggagacattgtgagttatagtggtcagtatggttttatggagcagaaaggatttgaagattatttagaaagatgggtatttggagagaagaaaaggaaacattttcagacaagagaaaacataaaccatagaatagatatgaaaaggactgttctgacaggaggaacatctcaggtagggtgaacccagttgtggttctcattcttgttgtgcttcagactcacttgtggaacttttaaacatacctctggaaattaagaatgagatctggagtgggacttaggcagttgcatttctaaaaagtctacaaatggttctttaggtagtagagagctgttggagtttcttgagttgtgaactgtggaggaaaattgttttaaaattggtcttggtggagtgtaaagaatggattagaggaaacaaatgtattgctttgtcaaagtctcgtaaatttatgtgtgcctctgttcattttgactcctcggctagatttcttagttccttgaggtcataaacaatcagcttttaaagcttcagtgaaggaatatctttttttttttttttttttttggctgggttgggggacagggttttgctctgtcacctgggtggaagtgtagttacgcagtcaatggctcactgcagccttgaactcctgagttcaagtgatcttcctacctcagccacccaaagtagctgagactacaggtgtgtgccgccatgcccacctaattttttttttttttcgtagacacgaggtctcactatgtcatgaagttgcccaggctggtcttgaactcctgagctcaagcttcctcctgcctcagacttccgaagtgctaggattacaggtgtgagccaccgcacctagcaggaaacatcttataaaatcattctactttcatttggaacttgcaggctcgtgcctgcaatcccagcactttggcaggctgaggcaggtgaattacttgagctcaggagctcaggatttctaaaccagcctgggcaacatggtgaaactttgtctctaccaaaaatataaaaaaattagccaggcgtcgtggtgtgcctcagtagtagcagctactcgggaagctgaggtgggaggtttgttggggcctgggaagtcaaagctgcattgagccgtgatcatgccaccacactctagcctgggcaacagagcaagaccccgtctcaaaaaaaaaaattaaaaatgaaagtaagtttcattaaaaaatactatatatgtaattacagtggtgaaattgttttgtgattaaataaatactgttgtgttgacattaaaacaagatatttgagagttagcgaagatattaaagctaatgttttaaattttgagtttttaaagtcaatcttaaatctcctgctactctgaagaagataaatgtatataattttaatttttctatttcactaggtttgaagaatattttttgaggttcctaaatcaaaacttaagttccaatttttgcataaagttgcctttattttcaagacgttatttccaaaatggcaggacagagcatccgcttcagagcaacagtgatatttgcacatttacttgaatatggaaggaagaaaagctaggcttctgtaatagaatgtaacatgtgcagaaaaatatttccagtatgtcatttattgaaatttgttccaggtgctacaggtaaagagaaagttccaagttagtggtcttaattatttagttatttagaaggcaagttttgaagactattattaattatcctgattcagttggaaaaaaagcctgaaattgtatgatccggagaagaggtgtcatgtttttgcaaattatttcttctcactttatagatattcttttttctttttctttctttttttttttttttttttttttgagatggagtttcgctcttgttgcccaggctggagtgcaatggcacaatctcagctcaccacaacctctacctcccgggttcaagcgattctcctgtgtcagcctcccaagtagctgagattataggcatgcaccaccacacctggctaattttgtatttttagtagagacgggatttctccatgttggtcaggctggtcgcgaatacccaacctcaggtgatctgcccacctcggcctcccaaagttctgggattacagtcgtgagccaccgcacccggccctcactttatagatattctaatgaatttaatgtattaatgagactttgctaattcagtgtaactacagatttcaatatatttaaatatttccattaacttccaaaagtaaaccaaattgtgtttatcttcttagaagtcatctatgaccattgaaagaaattgtaaaatcacttacgatccccacaaattactcaaagacttgctgagtgattactcattcttcatattctgttgatgaaaacacagattgttttttgaggaaaatcatggtgcagtcgtttgtactttaatactctgtggacatgggcacttgtccagcaccttacctttcttaagaggttgtctccctttctctactcagctgatgttaaatttattgatctgccattaccttataacagaaaatctacaagtcaggtgcccatcatggaatataaacacaagttccctatatctctatacctatcaaaagctcagttgacagccgaacatggtggctcatgcctgtaacccaaacactttgagaggctgaggtgggaggatcgcctgaggccaggagttcgagaccagcctgggcaacaagcaaggccccatctctacaaaagaaaattttaaaaataataaacaaaaagctcattgatagctccagtcatctttggaggattgtctgaagaatatggagcttatctgtttttctaaatgtatttaagatttcctcttggattaagtctgtcagagaggccaggtatggtggctcatgcctgtaacccctgtacttattgggagtccaaggcaggaggatcacttagcctaggagttcaagaccagcctagggaacatagtgggaccctgtgtctacaaaaatcaaaataattagcgaagcttggtggcacatgcctgtagtcctggctacccaggaggctaaggttggaggattgcttgaggccaggaggttgaggctgcagtgagccatgattacatgactccactccagcctggatgacagagtgagaccttaaagaaaaaaaaaaaaagcaacaccgtaatattttgtactcctaccctctttgctaataatgaactgtattttggccttacgacagcaatctgtactgatggatgctctaaaaagaaaaccatctgaaacccactattatattcttttaaagatgttgattaggacatttttaccacattatatgtctccttcttgaacagacacagaatgaacttttccctggtttattacaggaataattatgcctctcttcagctctcctgagtacctggttggtttttattgtatggcttctgtgattcatgtcctaactgattctgttctctttgttaatggctttagtgagctttgagccaaatttgaggcctacctctaatgggtatttaaaaaggacctctggccgggtgtggtggctcacgcctgtaatcccagccctttgggaggctgaggtgggcggatcacgagatcaggagatcgagaccatcctggctaacacggtgaaaccccatctctactaaaaatacaaaaaaactagctgggtgtggtggcatgcacctgtagtcccagctgctggggaggctgaggcaggagaatggcgtgaacccgggaggcggtgcttgcagtgagccgagatcgcgccactgcactccagcctgggtgacacagcaagactctgtctcaaaaaaaaaaaaaaaaaaaaaaaaagaaagaaaggacctcatgatatatgctaacctcagctgtacagactttcttattttcccttaatcacttaccattttgtcaggttttatatatataattccagtctgctttaaatccattgtgaataaaggaaggtatacatcaataaatttagaagttaaacagaattatattaggatatatgaagaatctagtaacccacattttctatgtgtgtgtgacacaaggggaggcaagtatgaatgtgtaacaaaacattgaagtttatttaatgattatccttgtgtgttatgtactggattcacggtcagcagtagatgagtgagaatgacatcctaatattgtaataactgcttctaatttttatatttctttcagttattttttactataccaatgattttataaaatgtgaattaatttgataattttggaaaagttcatgtaaattcacaattgggggaaaaacttgttaaacagtatgtcctgaattttagtttggagaacctgtttatcataaagataatttcattttatgatgttgttcatgaaaacaaggttttacttgtagctctacttttacagatgtgattgagaggcgtatttgagctttgccatggaccaagctccttgccaaacctactataaaagttattacatttaatcctaacatatccaacagatgaaatataaacataattctcatttcatgaaagaatttaattaacatcctcaagattatatagctattaagtggcagaactggaattaaaatccagatagtctaattccaaagtcccagctcttatttaatcactctgttggagtattataaacatgtaataataaattgtgattgttggggtctatagggtactgattaattctagcctgccttttgctgaatagattcaggagtcaaatagagataaaaatatttacttttattagtaaagctggcatgcagagtgccttgggcgggcaactcaagtgggcttcttatttcttccccagttaattgaacttgcacacttaatcagtcagatcagctagaaaactgctgctgttccttgctccccagcaggcttaccaatggaggagagaagaaagtgttcagcttgcaggtggaaggcaaactctgaggtgggaagttgaagaagctgggtcccacaggggcaatggccatttttccagtctcaccagagctagtttagagaactgggtttagagatgagtatacatttacttgctacttttgagagggaagaagttactaatttatgggtttgtaggagcaatgggagtggaaaagaagagaaccaccaccctcttttatgtgagataaggaaggagtcagtgagggtgttgtgacagagtaatggcttcttagaggtccctaacaggttcctgagcaggtgactatttaaaccaatacttgaaggataaggatttagctatggggtgggatgggggcggaggagaagaaaatcctaggaaccaggagcagcctgtctgaatagttaaaagaactgaaaggagctagcagaacatagcagctgagagagagggaaagagtagcacaggaacaggtggaataatcagtggtgaccagatcacctgggccttgtaggccatcatgagaaatttgcattttactctgtatgccaaggagattccttgaatggtttgaaggaggggagtgttgtgatctaatttgtacttttattgctattttttatttttcatttttgagacagtctcactgtatcttccaggctagagtgcagtggtgccatcatggcgcaccacaacaaggttgagcagcttcagccttcctgggctcaagcaatcttcctgcctcagcctcccaagtagctgggcatggtggcccatgcctgactaattttttttttttttttgagatgaagttttgctcttgttgcccaggctggagtgcaatggcatgatctcagctcactgcaacctccacctccctggttcaagcaattctcctgcctcagcctcccgagtagctgggattacaggtgcctgccaccacacccagctaatttttttaaatatatatttttagtagagatggggtttcaccatgttggccaggctggtctcaaactcctaaccttagcctcccaaagtgctgggattataggcgtgagccactgcgcctggctgcctaatttttaatttatttattattatttttttgagacagagtctcactctgttgctaaggcttgagtgcagtgatgcaatctcggctcagtgcaacctccacctcctggattcaagtgatcctcccacctcagactctcaagtagctggggttacaagtgtgtgccaccacaccccactaatttttatatttttttagtagagacgggtttcaccatgttggccagactggtattgaactcctgacctcaagtgatccacccgccttggcctcacaaagtgctgggattacaggcgtgagccactgcacccaacccgttttttattttttgcagagacagggtcttgctatgttgctcaggctgatctcaaacttctgggctcaagcaatcctcctgccctggcctcccaaagtgctaggattacaggcttgagccattgtgcctggcataatttatatttttaaaagactgtattggatgcatttggaaagcatattagaaggaggtaggccagtgacatggactaatatgatattggtgaaatgaagagcagttgactttgagacgtcttttggaggtgaaaaccatgagacttgccaatagatttgaatgaggactgaggaaagggagaaatcaaggatgacaatcaaatgtctagctcgagcaactggatgaacagtccatttattgagataacagagccatggagaagaatagttctgggtgttttgaacttggtacgcttcaggtgcttatgtgtctttcttatggagacatcagggctcagagaagagatttcagtgagagacataaatttgggagttttcaatatatagatggcatttaatttaaagtcatgggcatagatgagattatctagaaagagaatgtgggagagagaagagggcccagtaccaagtcctgaagaactccaacatacagagtttgagtagaagcagcacatgcagtggagacagagatggagctgccagaggggtcatagaaaaccaatggaagtgttgatatagactccaggatggacagtatttagagaaagtggtgactatgtcaattactaatcttagaaaagtggatttggtagcagaggtcattaatgaccttgagaagagcagtttcagtggaattggattgaggaaagaatgggattgaaatgagtcagttgtgtagatgtgtgcttctcacaccttaagcggtatattaatcacctggaaatcttgtcaaaaagtaaattctattttagggcccaagatctcctttcctttccttttcctttcttttcttttttcctttcctgttgtctgcagagatcctgcattttctaatgagctcccagataatgtcaatgctgccggtccatggagcacactttgaatagcaaaggtataaattagtggttctcaaactgtaatatgtattagaataacatggagagcttgataaaatacagattattagacccacttcaaagtttcttattccattaactctggggtggtacctgagaattttcatttcttataaattcccaggtgaaactgatgctgctgatctgggaacctctggtgtaggtgacttttttggagaattttaactgtgatggagaactgttaagggaagtcttttgtttgttggctgaaggcggtaaacaagtagagcaaatttatgctgatgagaatggtccagtagatagggagacactgatgatgcaagagagaagaggaatgaagaagtgaaatccttgagaagatgagggaggtggctccaaagcatgtattgtggtcttgaattttgataagcaggggcatattcttagttatagcaagagggaaggtggagacgatgggtttatagatttggggctaagcaaatggagctcccctcctgatggtttctgttttctcagtgaaggcaagggcaactcttgagggaagagggtgaattggagatttgagagagaacatgtcaaacgatcattttcgagtaggaaaatgaacttactagaagaaaatggctttattgagagcctctttgagattaaggtcagaaactaagaatgaaaatctgattctacagtctttcttgttcaacctcagttccttggattcagtcatggagaattaagtggttgagattacccaaggttagactttatccaggtgagtacatcagagagacagacagacagagagagagaagtgcaagggagtgattataatcatggaacaggaagggagatgaagacagaagagggctgaaggatagaaacaagcaatgacaatgaggttaacaaattgttgtagtcagggtacaagtaaactagaggtaactaggtttttgatgaaaagcaaatgctgctggcattcaaaattttgtaggtggggcagtttttggtaggaataaaggtctagaatgtgaccatgaagatggctgggtgtggtggagtttcctagagaggtcaggaaacaggatgttgggtgtgccgttcacctggatgttgaagttgccaagaatgatgacagaagttgagagtgtagagagatcttctggatagaaactaacttttcaatgaatgatggaaaatttcaggtcagtggatacctgcagcagagagggatagtttatcagggttgtgagcaggaggtattttatagaacaaacggaaagtaatggtcctgaagtggtaacggctgccaaggaagactcctacgcacctgctagccaggaggtatctgggctattagagaatgctttctaatggcagggctataagagaagcagtgtcttctagaaatggcctagtttcagagatggaggggaggttcagaaaagaggttgaagatttataggagtttatcacaaattgggatttgaagattgagggtatgccataaaagtttgggagtgaaaggaagggcactggagtaggtacagagttgtaaaagcaagtttggcaggcagagagtttggtgataacagatgaccagaaagtcttggatacatgttagagactgagacaaactggaggatgaggcataatggaactggcccagacaatttctgttattactatttttttttttttttgagaccgagtttcactcttattgccaggctggagtgcgatggtgcaatctcagctcactgcaacctccgcctcctgggatcaagtgattctcctgcctcagcctcctgagtagctgggattacaggcacctgccactgcgcctaattttgtatttttagtagagatggggtttcaccatcttggtcagactggtctcgagctcctgacctcgtgatcctcccgcctcggcctcccaaggtgctggattacaggcatgagccactgtgcctggcgacgatttctaaaaataattaaaatacacatcgcatttttgctgtagatgtcctccatgatctagctgctgcctgcatctcttacgtcatcccttcccactctccccttgctccctgtgctctacccacacagcctttctgtctttctgtcactcactccagcatgccatacgtttcctacctctgtttcttttttcgtttgtttgcacttgctcttctgagagatagcagagtcaagtggtcagtagcataagctctggatccagactccctgctctgccgcttttaagctttgtgaccgtggtcaagttacctaacttctctctgcttcagtttcttacttgtaagtgggagaatgataatagtacttatttcataggggattcggggaaatacaaaagctgaattgagacaaataaatgtaaagggcttagaacaatttcttgtatgtgtgggtaaagactctataaacattaatattattattatttcttctgcttgaagctctttttcttatatatttatatagggaatttaatcattatattgtttccttctcagctcagatgtcattcctcagccatcctagctaaagtggtataactccactggctttctgtcactctttatcccattacccttttatttagtcatagtattttcatcactacttgaaattattttattattctgttctgctcttcccccattccctgaaggtgccaagtactttgtaggtgctcaagaaatatttgtggcaatttattgtcctgaaaacatggtttcctgggcctcgactctgagcaggcagcagatgtggcaaggtgacgacagtgaggcctaggcagggaagacagaattcaactctgtttattaatctgttggctcatctagatcaggcagctgccagtttttgtaaattttattagaacacagccacacccattttaaaacttattttctggctgctttcctcatacaaccacagagttgagtagttgtgacagaggtcttacttacaaagttgaaaatattactatctggcccttcattgaaaaaaatttgctgacttctgatttagatacatagaaaagacaaggagaaaacaccaaaaataataacagaagctttatttggataatgggataataggtcattttgctttttatctttatgcttttttttggtattttgttatagaccctttaatttggaaatagccttataaataccccaaaataatatttagaacagctttttaatggtgggttttttcccttttttctccttagtgctgcttttgacacaaaaacggggttacgtgtggcagtgaagaagctctccagaccatttcagtccatcattcatgcgaaaagaacctacagagaactgcggttacttaaacatatgaaacatgaaaatgtaagttattcattcaaggaagaatacattttgatcttgaatagactggggaaaaatgttttaattactgcagatggaaatacgctggagtgcatcaaacgttggtccctgctccttgtcctggggtgttagtggccacttggttatgtcaggtcaaagacttggaatgaaagtgatgcatcttcctggagttttagttttactcaaagatttttagaggagaaagaactctttaaaattttaaaattaaaggatatgttatgaaatacaacacaaaattcacaataatttttaagagaaaatattaaaaagaagttatgtattctttgcctggttttcctaaggctatattatgagaatatgggagtctgtggctattaaaagacaaaatagccacagactcccatattctcataatatagccttaatatttttaagtggaaaaatctgagaaagagtgccttaggctcactgaaagtcctatcagagatggctattattttatatatttgttaataatttttctttttttccagattcacgtattttaataaatatgtcagaggcattgtttaagttaaatataactttttcttttttaccaatttgttgattcagttgccattctgcaaagatgcttacaaattctaatacgataaataagtggatataattggaatactaactgaaagtaaaaagacagttgactgaagacacttattttactgaatttcaaaatcaagttatgaatttctgtgactgctatatgaagggtactgtgaagtttgtagcattgtggaaacaatggccatagagatttcaaagtcctctggctgtactgcttgttaccttgtggaagaaaattcaaaatctgtgaatttattatttgactatttagactgttttagtaatttaacttcttcatagcgagaaaaaagtcacagataagtgactcttcattagcgtacatttgtttcattagtgcaaatttcttctaaattgagaacattaagacttaaatttgtaattggattatggatgccattataatcacagctgctgctttttattttcacattttattttgattgtatgctattgaggaaatcctatttctacagacaacttctattcctgagtataattttacttaagtagctatgtgcaaaccagagttttaagaatgttcagtgtgaagctgcagccttcctaatcagtgacatgtttacaagaagttgagatatgcggaaaaagctggcagcagaaactttattcctaggtctgcataaaatcaaagtggcctggcagctttaagggatgtgtttgcgtttgatttttaacacatttaagtgtgtatgctgtttttcattacacattattatatgtgacagagacagtgtcacagctttgcaagtataaaggatattttgaaagtgaaatgcaagccaaacatttatggaaccccagagcacctttgggagccactaggatcctattgatgtggctatgctaatttaagaacatctggtttaggagattatcagtgctacactgattgttttgcttttcttcataaatatgttaagccaatgtttagggatcatggtattagaaaaataggattttaatttctatacattgttttataagtggcttgcttactagcagtcttttttttatataaagatgtttaagttctaacagttggtggtcacctagatatcagtgatttgttatttaaacaaaataaggcacatggctgaatgtctcatagttctctattccattggcaaatgtttgaagccaaaagacttgactcaatgtagaaaaattcctgcattttagcctattttgaaaacatttgttaggtgcttataatgtcaaagtagttttacccaataaagaaccaaaacttccggtaagtttaattgagggttttcagagaaattcatctcgtttaccctcctcttcttttttaaaaaattactgttttgggtcaccatccaatttttatagcggccaaacctcccacaggcagcagcaacaggcgcttaaaacttgtgaacattttaggtgttggtaacaaatacaattttcaggtgccagagggcacatgtgatcttttacacaaaaatgcctctgacccacaatcggtagttcatcttgaattgtctcttctgttagtgatcatgaataatagataaacatttattaggtgagtgactgaagctaggggatgtcctctgtgactgtgagagtttctctctgaacaaagttagttggaccattcctgattgaacttctgaccttgatctcgttaacacctgctctaaggaaagattaaagggaggcagcctgccagctgcatcctttgctgtctgggcagacactacagagatggcccatatatgggcctagagatctgtacattttagaatttaaaaatgatcaaggaaattgttttgtaaattttatttgggagccttagatttaaccttaccattgtagaccaagagattgttttggtgtgcttttgttaaatatgctaaatattgtctctggatactgagttaaagtatttttttttggatgtgtgctaatttaataaaaatacgacttaatatttgccaggctttggaccatgatgggataatcattagagatatttgctgcttatttgtattatgaatgtcttttctaaaaatttgattcctgggttactttgaggtgactgaagtcatgtaacagcagaaggagttaaggaaatagactaaaatatgacttgatttagaagggaatttccatttaagaaatgagaaatggctgggcgcagtggctcatgcctgtaatcctagcactttgggaggccaaggtgggtggattgcttgaacccagaagtttgagaccagcctgggcaacatggcaaaaaccagtctctattattatattaaaaaaaaaaaaaagaaatgagaaatgaatagattcctaaaatattttccagatctattttaatgctgataagcttttgttttacagtattttccttatgattaatattcataagtatgattaatggagtgagggatattttgtaaaaacccatcaaaaatttaagtactttgatttagcatgggtagttttaatctcaaaattgttattttcggtgtgcttatgttaaacacattaaatattgtaaatattgccctttttaggaaattaaaatttggtagggtatttactagttggcttttctctattttttttcaggttactttatttttcttcttgcagtcatggtttttaatcatttgaatagttgagctttatgtctcatattctgttaatggaagtagctgcttcagatagtttgcttaggtatattgtattttgtaattgtctattcaactgtgtgggctgtggtcaccacttattttgatgatccacagtgggtcagccttttgtactaggcaccttcagatacattgtctgctcagtcttgctgtcagtactgtgaaaataagcaatgatgtcctcatgtttttcatatgaggaaaatgggactcagagaagataccaaatgtatttgccaattattatttacataacagccattcattgaactcctgctgaatgccaggctccattccaagtgccagcgttattggaatgaagaaattataagctcttggacccaagaaatcacaaactgatactggggttcaaacttacagctgcttggttccaaaatgtctgttgtgttttcagtttgaaattggagtttttatttgaaaatagttttgacttttgtcttttgaggtaactcttgcatgtgtaaatcagatctctaatgatttagttttatttccataggaggattttcacaatcacaatggaaacactgtaaaacaatgtaaatagttttaaacttttctattgttttgaggagatgggcatctcagataacaagaatcattgattagaaaatattggaacggtgaataaagttagcttctagacctcagttaccttaagtagaagtgggtataagggagagtgattaaaagaccagaggtcttaagccaggagtataccaaactcaagggaaacgattatggtttagatggagaaggtaaaaggaaatggatttgacttaaatttaaagcactattgtgaatgaggtcacaggtactctattgggaggcatgtaagttggccttacctctatggaggaccatttgacaatattaagatccttaaatatattggtgtcctttgattctgtaattctgtttcttgaaatttatttcctggaagaaaatatgagatgtgcaaaatacatatatttttcttgcagtattccttaaatgtctagagataggaaattggttaagttatggtatacacaaatgatagatatgctgtatacaaatatttaaatattaagtaaaaaggcaggatataaaactatgcatggtgtaaccccaatttaatttatgtacatcagaaaatcaaaggaaatatatctcaaaatgttaatgatagttataatgggtggtataattatgggtaattttggttttcttatgtactgttgtctgggtaagatctgaaagtgattctatttcctttggaacaattttcaaggacttgaaacctattcttgaattccaagtatgtgtcccaccacctccttttcaggttcagactgtaaaattaaagttgcttttaaaaagtgacatttggagtcgggcgtggtggtgcatgcctgttatcccagctactcgggaggctgaggcaggagaatcacttatacccaggaggcagaggttgcagtgagctgagattgtgccatgcactccagcctgggcaacaggagcgaaactctgtctcaaagaaaaaaaaaaaagtctgatatttggatgagtggagtaacatcctaattagaagatctttttcatgataatgttttgagtgttaacatatcttacttctagagctttgtgtttaagttggcagtttagaacagtgtgctagtgaggccacagtcttgcttcataaccagatactctcaaatatggctgggcgtattacaaatgaattatatatttcttatttgccttgtcaatgcctaactttgtagaaatgaatggcctgggttttaaggaaaatagatgggaggtaggggttggagggtgctgtatgtggataaatcagtataaattcctgatcagaaaaactgctcaaagaccatgggttattgagtattaagtagctctttgctttatccctgtgtaaaaatagactttttttttcatttttaaattgtctgatttaaataccctatacattaagactttgtgagaataataccaagaatatactgagaatattttgagactttaaaaatgtcagttttgaagcatatacagttaatatggaaatttttcgtggaatacatttttaaaaaacacaatattacggtaacaaccatggacgtgtgacctttttcacctgttggattaattcattagaccattagtacatacgtaaggcaaggaccctaaatctttttgccttctgataaactactgactacatatgaataaattctaaagagatgaagatttttaatggtaaagtgggttaatatgagaattgatgttaacaagtagaaaacaaaagcataatttgggtagaaaattagttggagttattaagtatatgatgtgatgttatggaactgaggtagctggttttgaattagttcctattaaaatgattgagacgtggctggccgtggtggctcactgctgtaatgccagcactttgggatgctgaagtgggaggatcgcttgaggccagaaggtcaagaccagcctgggcaatctagtgagacacatctgtacaaaaaaagaaaaattagctaggcatggtggtggcacgtgcttatagtcccagctacttgggaggctgagacaggattgcttgagctgcagtgaactgtgatggtgtcactgtactctagcttgtgtgtcaagagtgagatcctgactctttttttttttttttgagacagagtctcactctgcacctgcactctcccaggctggagtgcagtggcgcaatctcgggtcactgcaacctccgcttcccaggttcaatcagttctcctgcctcagcctcccgagtagctgggattacaggcgcccgccaccacacctggctaatgtttgtatttttagtagagacagggttttaccatgttggccaggctggtctcgaactcctgacttcaggtgatccgcccgcctcggcctcccaaagtgttgggattacaggcgtgagccactgctcccggcctagaccctgactctttaaaaaaaaagaagattaagacctgatgggtactatactgagtttaatatttatttactttttaatttttatattttcttacaggtgattggtctgttggacgtttttacacctgcaaggtctctggaggaattcaatgatgtgtgagtaaattttttgcatttgccttcctggtctacagaatgaagactaatagcccatttctattcctgaaccatttagcaacatatagacttcaaaaaattctttattcctatcatgcacctctttttgggtgtagggatggataccagaagatgtatgttatgggtggtgcgtgttagtatttacatcatttcaggcacattgtaccccattgaagagtcagtcttgaattcttacaaaagttccatggagaaaggagtggagagagttttgactatggattttcttttcaaagtgtttatcccaggtttggttttgttgttgttgttgttgttgttgtttttgttttaaaagacacggggtcttgtgatattgcccaggctggactcaagctcctgggctgtagtgatcctcccacctcagcctcctgaggagctggaactacaggcacatgctaccatgcctggccgatcccaacttttaaaggtgctcttcaagaaatgtaacggatccccagccatatagactccctcctcttttatcgcccatgcatgtgggagatgatactagaactacatgctgatccttgaagtattagatttctatactgggataaggggcagactctacctgttgagaaaggcttcttctctcagctttgtaaccacctctgttgttttagcctgggatacccctagaaagcagagcctgggattctcaggaaccagtagtggggggctagggaaaatgaaacaggaaaggagagaaagcttctatgagtatatgttgagttggtcaccactatggacaattgggctgaaaactgccaagatctaagaagctgtacgtaatgcacctcagatggggatcattaatacactggctcctgaccccattggcaagggttgccacgtatgtcattagtgccttcacatgcccaggttgcacattggtgggccataagacagattccagcaagtgttcccatgtatgtgtgaactctctactatagtagcttttctagtatctgagttgacacagctctccctgcccccagttcacatatacactataccatgaaagagaaaaaaaccttaaacacagttatacttttggtcacattgaaattttggcattcctaaatggagagtgttactattatgaaagccaaaacagaactgaagatcgtgacttctcttccttaacctccattcccccattgaccccagggctgaacctaaccagtttctcctcacccttatcctggtttcagtttctcccattcttatcctgggctgattgcaaacaccgtttactccttccccacagaacacaaaggggatatgtttgaacttctatgttctgtctaaggaaagggagaaagaaataaagaagatgaaatggaaagggaaggaggaaaggtggcaaaaacatttctccaccatttgaatttagttggaacagtgtatggctgagagtagaagagtagaagttaagagaggagaatttggtccacctacaagatctccttggctacattaaccttgatcctgctaatgaaagtttaagaaacaaaggaaaaaaatagccaataactaagaaaaattgttcttctcgcagccctgcttgatacaacaatatggaggcttccagagattactggatgttactcaggggcatgtatattacagtttgttgagccctactgtatgctatagttggaaaagggaatgttacagaatgatggtttttaaaaatagttttcctaaatgtagaagaaatgctgaagtaatgtgtttgtgaattactttggaaaacatttgagttagatctgagctgtatcccaaaattttaggtatactaaggatggatttatataacaaaggaaatgatttgctgacttgtgcaaagtgcaaaatgctgtattttggcctaattgggcattctggaaccggattaagaacctatttttcctatgtgaaaagaccttaattaaggccagtgtctatttagaaggttaagtgttactgatagtggtgcctttgtttggctccttcatccatgtaaggacccagcaactacaaatctacctttgaactaaggtttcattcattcattcaaccattcattcattcatttattcaataaatactatggctgttgagcaggaatctgttctttctatttaactctagctggatactgttttttataaacaataactgagtttacctcttggaagcaaatctcattactacttgttgactacttactgaatgcagaacactgagcagagtgttagcacaggctcagaataatcagaaacagtcgcccttccttttgatgaaagtgtctggttgggggaaacgaattcaaagcacttttgtatccaagctaccaattggccatatgaccttggacaagtcactttaccactgtaggcccagtcatttcactgtaaaatgatgagaattgaggtcgttgacttctgaagtgttttaaattacagaaagtctctgaaaatagaatgaacttgtttgccctaagaaaaatattccattgtttactttttattgtgatgttcatatcactgaaaaaatcactgtagttcgactatagttatttcagtgttttctttttttttgagacagcgtcttgccctgttgtcacccaggttggagtgcagtggcaagatcttggctcactgccacctctgcctcccagctcatgcaatcctcccacctcagtcccccaagtagctgggactgcaggaatgggccaccatgtccagctaatttttgtatttttggtagagacagggttttgccatgttgcctaggctggtctcgaactcctgagctcaggtggtcgccctcctaggccactcaaagtgctgggattacagacatgagccgccacacccagccatttcagtattttctaaagttattttgggatatgcataagaaactaaacatcttcacctacacttgcagggtttgcaaatttaaataccttcagggtcacacaaagaacataaatgaggttcagtgttacacaattgggagtggtggggtctgtggcaaaatacatctgcacctcctaaaagtattcaaattcacattgaaacaaaacaagtaaacaaacgaaaacctacacttctggccaaaccagacataatttaggctagagtggttctacaagctgcctgtttagagcaggctataatttgaacacaaatttttaaatgctaattagcaaaatctctataattactttcagatttatagttttttttttttctttttcttttcttttttttttttttgaggtggagtctcgctctgtcacccaggctggagtgcagtggcacgatcttagctcactgcaacctccgcctcccaggttcaagcgattctcctacctcagcctcacaagtagctgggattacaggcgcacatcaccatgcctggttaatttttgtatttttagtagaggtgggatttcactgttttggccagactggtcatgaacgcttgacctcaagtgatccacccacctcagcctcccaaagtgctaggattgtaggtgtgagccaccgcgcctggcctacagttggcttttaatcatgtgatacgtgtatttgtccctttatgtttcggttagcacttttaatttatatacagtcatgcatcagttaatgactgggatgtgttctgagaaatatgtcattaggtgattttgtcattgtgcagacatcatagagtatacttccacaaacctagatggtataatctacacacctaatctatatggtgtatcttgttgctcccatactacaaacctgcatggcatgttactgtactggatgctgtaggtaactgtaacgtgatgctatgtgtttgtgtatctaaacataactaaacatagaaaacaacagtaaaaatatggtactgtaggccaggcttagtggcttactcctataatcccagcactttgggaggccgaggtgggcagatcacttgagcccaagagctggagaccagcctgagcaacatagggaaaccccttctctacaaaaaaatttaaaaaattagccgagcatggtggtgcatgcctgtagtcccagctactggggagtctaaggtgagaggatcatttgagcccaggggcagcggttatattgaaccatgattgcgccactgcattccagcccaggtgacagagtgatatatgtggtccactgttgactgaaacattgttatgtggtacatgactacttcagatttttgctatgttttaaattttaattcttacaaatgaagactatacctttgagaaaggaacaataggtagtgcattttgaacattaggaacaatatacagttactgaatctggatggagatgatttttggaaaatgtagtgttaaaagatggatatactaagttgctcttgaccaccataggatgtggttgtacagatggcaaaattttgtaaagatacagtacatctagatctcttaaatgactggaaatcctttgggcctttctgttggcttcttgatagtaatgtttggcaagatactgcatgcatatatattcctgtgtattcagcagatattaccagtagaaatgcaaaaatcttaaatagccaatatttgaacctaacaccagagcaagctgtaattcagtattactataatattgccttttctttgtgtgtgtgtgtgtgtgtgtgtgtgtttgttttctttttgtagttggggctacaggctcacaccactagactcagctgtttttatttttttgtaaagacaaggccttgctatgttgccttggttggtcttgaactcctggactcaagcaatcccccaaccttggcctcccaaaatgctgggattacagatatgagccaccatgcccccccccccacccctttttcttaactgtagtggttctttgcgcaagcatagtagacaagaattttttgattcctcctgggaactatttcctcaaatttcatggaaactgaattgtcatgagttaagtggaaattagtcttctgatactttttcctttattttacaagttcccatcccaggtttcttatactgaattccttatctctgcctcattcttgaagagggaaatggaagtggggttttggattctaccatgatagaagggaagacctacaacaaggctattcagcagcctttgttttagtgaaagccaatgagaagagatcacttcttccacttactaacaatgattgctcaactaataagtttagcttttttatttcaatgtaaaagttgctgaaaacactgaattggtaaaggaaatttctggatttacattttaacctgatgttgttcaataaatatttgaatatctaccttatgctaggcacagtaatagtctctgaggaatataacagtaaataagagctgaggctgttaatgggagagaagaacaatgtaaatgatcaaacaaaataccatgtggtaagacctgaaaggtcctacatgagttggtctccggtgtactctctaatctaacctcacctagtcctctttccactctgtctccaccccagtcactctggcctcttgttctttgagtacagacaaccacatttgcaataagacctttgcaccagtttctgttattgccctggaactttttccccacatacctacatgactgtctcctttccttcaggactctacccaagggtcttctcatcagaagctcttcttttgttaccattctaactgaaatagtacccctactgtcactgtttactccttaccctgctttgttcttagcaaattttgttattgtctgtcttctccctttctttgtaagctgtgttcaagcacggagtttgttttcttcgttgctgaatcattattggagtatatgcactccattgtttgttaaacaggtgaacacaagaattgccattatagggcaggtatagagtgctaaaggactgcatagtatggccacctaacccagacatggggtgtcttcaggaaagcctctgcaaaaaaaatgtatacacagagggcttaacggatgaaggagagttggaaaggtggggaaagtacaagttcatccaggggccgagagagggagctgagggcagaaaaggtgtgtgtgtgtgtgtgtgtgtgtgtgtgtgtgtgtgtgtttggtgggaatagaggtgtatatggcaaaagatgaagctggaatggggagggactagatctttggggctttataagctaagcctcattaaggtggttgctttagagaagagatcaaagggtactgggaactggaaatgggattggaaaaaggatgaaaggttttacttttatgtgggatgacatagttacaactctctcccccttcctccccacacaaacacattccatagtgtgtgataaaaagatatcattttaccagaggcagttttctcctggatccttaacacattaggaaatattttggatgagcatactagttgaaaatctgaaatggatataagacttttctgggaacttaaatttatgtaatgatgcttctcattgttaatatctgactttaatttcttttggtttgacttcttgccaacattacaactatgtcctttcttcaaaaaacagggtcttatgcttatgagtgaaactgacaaaacatgtgggtgagcagttctataaaaactctttttttttcagtaacatcttggagggtacaaagggctttcacataatcttatttgacacaacaatcctgtgaaacagatggtattatctctaattttcagatgagggaactgaggttgagagagatgaacctaattgtataatatcacatacaaaattgcatctctccctggtcttttggctctaaacctatttctcatcacatttttctgatctaaggctatgattattatttgaaagtctgctaccccttcttattgagtaaatattgtgttaagttctatgtaagatgccaaaactaagggcctgtctcgttttccaattgctatggtcttattaaagaaatgaggcatttcttattaagaaatgcttacctaaaataactgaagggctgagtcaaatctgtaatgtctagacaacttacagggtgctgcatgaaactcagaatattagagaagcttagtggagaaaagcctctaaagaaggtaataactgtgtccgaagaaacaaatagggataggatgtggaagttgaaatttattccagacagagaatgaaggaaatatgtaaagtgtacagaaaagagatttgtatggaatggagagtgttaaatgagaataactattgatacttcttttgtacttggataaaaattgtgcattgatgaattctgggtgtgtgtgtgtgtgtgtatgtgtgtatgtgtgtatgtgtagggttattcctgatttagctaataaatgtgatctttttggaaataatggtgaaagaaatacctagccgagttgcttggacttacaggttatttcctaatttagctaataaacatggtagttttggaaataatgctgaaagaaatactagcctagttgcttgaaactaggctaagtgctcaagatagtgaacacaggaagagaagtggtctaggaaaaagattaatgagttaactattaacatttatgtttacaattttttttttatcagagaggtctgctgaaatggagatggtgggtggcgaaactccttgtagatgtttttacaaactcacatttgaaatctaaataagttacatatctcttaagaaaatatcattcagtttttgcctgacatgatcaataagatgccacctttttctcagattagctagttttaaaaggtaaagaagcttcaaggcctagcttagagtttgagtccttcagcaatctctctctaattcacttcttcctaagtctgtgctgggaccctctcctgtgtgttctccatcaccgtatgtccctttattatgattatatattcatatatgccttcctttcatctaaaggctgtatctgtctttcccactgctgcatccccagggcccagaaatacgtatttgttgatggagtgatagaatgagtgaataactttgtgctgtcactgtttataactggttgatgatttggttgtctgaaagcatgctcagtgctctctcctttgactagcttttttgttttcatcctgtaatgtagactgtgtggtaaaatattgagtctagtttcactgatgcaggtaatgtagagggcatcttttagtaatctttgcttcaagtgagaataatttgttgtgaaataagcctactaagctgcctacttggctgctgaatgattcttttacccctaaattagaacagtctggtctgcttaccagtaagatctttggcacatgtatttcaataaaatgagcccttgtcttatcttactagtagtgctgtgtgagttgtcctgagtcattcagtggtaattgagtgcctactatctatcagacactgttctcggtactttagatactacagggaacaaaaaataaccctgtcctccacgaacattgtacaagcagataacaataaacaacagtgagcatataaaaaaggaaattacatagtctgttagcagacaataatgctataactaaaaagaaaaggtagaaaggtagaacaggaaaggggaattaggagtacaagggtggggggaagatgaaattttaaatggataggccttattgagatgaattttgagcaaaagtgtgaagaagtagaggaattagacctggggatatctagaggaagagcattccaggcagaagaggaagtcagtgcaaaggtcctgaggcagactgcatgatatattggaactggagcaaggaggccagtgtggagctgagtaagagcaagggacagagacatagactatgaaatcagagacataattaggggcagtgtactggattaggtagggctttatctgccattgaaaggaattttgtgttttactcttagtaaaatagggagccttttgaggaaaggagtgccctgatctgagttttatttctaaagaaacactcttcccctgtgttgagaatagactgtagtaagtcccaaggatcaataggtgagttgcagaagcttgtgcttacaaattgtcaatccctgtgattgttttaagcaccctgtttaaatatggaataaatgggtttttttgttttgttttgttttttgccttttgataattgctttgaataggactgatagtagtaagagacgccagtctatagatatcgaagagttttttctacataggttctttctgattgttctgtgctttaaaaagtgggaggtggggaggaagagggcgggggcagtggtgctggtcttaacaattgggtattatccaagaagtataaatgaagctgtaaaatggggtgctgtctagagtactgaaaagcatttatgacagagttcttccttcttgctgtcacagtacattttactcacaggagtcacattgagaaatgtgatttgtgctctctatactttgattaaatttaaagaagaccaacttcacaagaaaagtgaaaaacaagatttgtatcagtccatgaaattgttttcagcttttagcctaataaagtccaacttaacttaattcctttgtaaagatgtgagaactagatagctttccaaccatactcaagtctaaccttccttaatttactttaatttactttacttaatttactttaggtgttatatacattgacaatattaggcatgtctttactaaaatgtaattgactatgctttccagaaacaaatactatagaaattatgtgactctccattaatgcctcttttggaatgtgcttcttaaaatgtgctcatttatattccttgccccccatcctgttcattatttttagaagttggtgcatcttccataaacaatcagcaactttgcatgatgcttgcttttgtcccctgttgtaagacttattttgaaaatctttctatatgggagttagaatgtaacaattggtggtcatggattggtctttgggcctcctggaaacaagtatagtgattaagttagttcctgcaagatgcttctgccataaataatgcctttcagtttatttcattgtagcttagtagtaatgcttgatagttattactatatagactgattaatcttataaacttacataatgttttggcagtctcaccctcgttctaaattttggtgataaaatggatgtggtctctgagggggaaaggatttgagagaaattacatagtggtaaactgttctaattaaaagctctttccctctctctctctctctctctgttgccatgcagtcagtggtcctctggctgcctaagatttcttaactcactggtaaccatttacacataatagctgtacttgaagttgctatggtttcattagtagttttgcctaacctttgtgaactggctcaggcctattagttaggactagtattatttttatttaaaaataagttatgtttgtctcttctccataaaattatttagaaaagttcaaagaataaccctcttattatccaatgtcaaaaaatataattatgtgcaaagtagtcttatatgaccgaaattagattctgtcttcctcagcttatgcatcaatttagggttaaaaaatacagtaactgtgattaggacagaatactgctatgttcttgccagcctgagaactttgttaagattaactttgatagtaaatacagtattgagaattattaaggaaattattcagacatattgcttccctagttattgtgacatttaaagagttttaaaaaggtcattcccttgatgtaaattttgtatcagctgaaagaattgttggaagaatatgtgctgtgattaagatcatggtctgtggggtcagttagttttagatccaactcctgacattactactctttttgaccttgagtagatggcttatccttattctgtctctatttccttgtcaatgaaatgggaacgctaatggacattatctcacagagttattgggaagagtacatgagacataatgagtacatggacataataaactgcttgctgcagtgctggacacagaataagtgctagttagtgcctttggttatgttgtgttgagattggaacatttcttaaaacgtttcagtctcatttacttattaattacatttagagtctactctttcctcaaggccgtataaacatgcaagttttaaaaatatgaaatgctaacatcttaaggttgcaactaggttaagtcctgttgatcttcatgaaattgagaactgaccatggcagccctaccaggaaattatgacagagaaaaaaattccattcctcttggaggacagaaagtaataaatatagtgtattagttgtgtgtgtaggtatataaagagaggtcacacacacacacgtttattcttataatatattaataatagatctaaattactgacctgctttcttccctccaaaattcataaaaaaatgaaaatagaaatgaaatcagcattctttatagctcagctgatatatattattacccaatctcaggaataggaatgattcttagacagtaaataaaacttacacttatttttaaaaattcagcctcttagccaggcacggtagctcactcctgtaatcccagcactttgggaggccatggtgggtggatcacttgagatcaggagttcgagaccagcctggccaacatgatgaaaccccgcctctactaaaaatacaaaaattagccaggcatggtggcgagtacctgtaatcccagctactcgggaggctgaggcacgagaatcgcttaatcccaggaggtggaggttgcagtgagccgagcttgtgccactgcactccagcctgggcgacagagcaaggctctgtctcaagaaaaaaaaaaaaaatcagcctttttagaaccgatctactttctatgtttccatagctgtgtaatacagtaatgagtgggttaaggcattgtgtctagaatatgtgtggtgaacctgttggacttgaatgtaatcattccctaatcttaccacataaagatgggattaataaccagcaccacacctgtgaggagaaattctggaatgcctcatcttgcctccagataaaacatgttcctccttcctttaaggtaaatgcaggaatattgtcaatgaacaaaatcctttcactagtcattcctgaaaaagaattacagttggaaaataaaaaaaatactcctattttagaacctgtaatgtggaagacttataatgaggtgaaaatgtagcggtggatttaaaactacaagatacttaattatagccatgcagtaagttatactatatatttgtcatgcaagaataacatttgtaagaaaactgatactgacacatgtatctttctaatccctacctttgctgtttttgttttcttttctcttttattttttgtagagatggggtttccctgtgttacccaggctgatctcacactcctgcctcagcctcccaaagtgctaagattataggtgtgagccacaaagcttggcctggtttcttttttcttgagataacctggaaaaagatatgtcaagtaggaataagtatgtaaatgtttagaacagatggcaggtagttaaagttagaatagtaatgttgggaggctaaattgggaggatcacctgagaccaagagttagagcccagcctgagcaacatagtgagaccccatctctacaggaaaatttaaaaaaattagctgtgcgtggtggtgcacacctttagtcctagctactcggaaggctgaggtaggaggatcacttgagcccaggagtttgaggttgcagtgaattactatgattgctccactgcatgacagagcatgaccctgtctctaaaaaaaagaaaagtaaaagaatagcgatgttgaaaatgaggtaatgaggtgcccttccccccaaaaaatgagtagttgttagcttttagctgtcatcgtggtacagctaccattttaagggaagggtagccttcccttaaaaacttagaagtcgggccaggtgcggtggctcacgcttgtaatcccagcactttgggaggctgaggcggggggatcatgaggtcaggagatcaagaccatcttggccaacacggtgaaacctcgtctccactaaaaatacaaagattagccgggcatggtggtgggcacctggagtcccagcaactcgggaggctgaggcaggagaatggcgtgaacctgggaggcagaggttgtagtgagctgagattgcgccactgcactccagcctggcagtagagcgagactccatttcaaaaacaaaaacaaaaaccaaaaaaaccaaaaaacttataaaagtcttctgaagataagaactttcttaggggttctagattgttatgtaacttttcactaatttctaggtatctggtgacccatctcatgggggcagatctgaacaacattgtgaaatgtcagaagcttacagatgaccatgttcagttccttatctaccaaattctccgaggtctaaaggtacagataatacaagtaataattttttaaaatgaattctccctttctcccctccttttagggcttaaacaaacaagtaaacaacttttctaatggaaaattcaaacacataaaatcacaggtaaaggtcatatagtacagtaaactgccatgttcactcagtgacaacagttaccgacatatggccaatcatgtttcttttgtatttcccaagccctggattattttaaagcaagtctagacattatataataccatccatagatacttcagtttgcatatctgaaagataaggactcttcattcttacatctaaacaataatttattgatgtaatctaatatctggtcagcgtaatgttgagattttcaaaaaatcctcaagaaagactaatttatttgttggaggggcagataaacagtgttttaaaattaaacccatctttgatatttagctgctttgagtccttattgagctccagagtgccaaccagaaaatagattaaaagctcaactgagtggagtcaatggctgtggaaattatagtaatggtaaatgtacacaatactgatagttacttatgctgatttctaatcttactattaacactagcagttcttactgattcatgaaaatgtgcagcaaatatgttatataatatgacaatagagggttggaggtaactttgacttttttctcttttgcagtatatacattcagctgacataattcacagggtatgtattgtgactttgattacattattttggggaagtggggtgagagtggaagaatggcatttagccaagatcctaatctaaactttagccattgaaatgttgattgattgcaactttactgtaggtttaagctgattaaagaaagaagatgtgtagtttttttctatgtaaggctaacttggactggatattgactgtaggatggagattgtcttttgatagctggatgaagtcttttatgtctggatcctcattattacctgtagggggagaattgatcatgcatcataaagttgatcctgtcttccctgtatttgcttcctaggacctaaaacctagtaatctagctgtgaatgaagactgtgagctgaaggtaaaatgaagagacagtattcattgtttgctttactttgagattatatgtttgactaagcaggcagactttcttagggagtagctttgtgagccatgactatctgaaattcgtattatttttattatcagactttgaaatttaaaccatttctgagtaagctaagtgacattgaaagtggcatcacttgtttttattttaacataaagttaaattataaatttgatatattagtcataataaaggaggataatagtcaaatatcaagtaagtaggcccaaagaggtgataactagattaaatacatttctaagaggagaaatggcagaaacccactcactcaaaataattcaaataaaaaataagtgaattaattgtttctaaagagcaagcagctctagaacttttgttccatttcatttttttaacttgaaaaaatgtctgtacattagaatgcaccatttcatttggcaaaattatatatccacttaactcacatttatgataaagaccatttctttttttttccttttttttgggatgcagtctcactctgttgcccagtctagagtgcagtggtgtgatcttggctcactgcaacctctgcctcccgggttcaagcgattctcctgcctcagcctcccgagtagctgggactacaggtgcacgccatcacacccggctaatttttgtatttttagtagagatgggatttcaccatgttggctaggatggtgtcgatctcctgacctcgtgatccacctgcctcggcctctcaaagtgctgggattgcaggtgtgagccattgctcccagccaagaacatttggattactttaaaaagtttatggccaggcgtggtggctcatgcctgtaatcccagcactttgggaggccaaggcgggtggattatgaggtcaggagatagagaccatcttggccaacacggtgaaacctcatctccactaaaaatacaaaaatttagttgggcatggtggcgggcacctggagtcccagctacttgagaggctgaggcaggagaatggcgtgaacctgggaggcagagcttgcagtgcgccgagatagtgccactgcaccccagcctgggcaacagagcaagactccgtctcaaaaaaaaaaaaaaaaaaaaaaaagtttattgtgtcccttcctagtcaatccctacccctccacccctaactctggctccaggcaactatggatctgcttctaacactatagattaggtttatcttttctggagtttcatgtaaatggaatcatatagtgtgtatttttgtgtgtctggcctttgcttggtgtaatgattcggtattgttgtgtgtgtcagtggtttcttcctttttattggtaatagtattttgttttatgaacataacagaatttttaaatctatccacctgctgatggacatttgcttgagtttgaggctgtgtaaagcaactgtgaatgtttatgtgcaaacctttgtatggacgtaagttctcattgcacttgattaaatacctgggagtgacatttttgttttgctttttgtaatttcattttaagttcttgctgtatatttaccatacattctaagtatggaccaggaaatctctttatgaaagtgctattttgttctcctttttaataaggcaacagaggtttgtttgttgttgttgttttgtttttttttccctgcctgtttctaagtcttagcagtttgtctgttcctcttctgccctttagattctggattttggactggctcggcacacagatgatgaaatgacaggctacgtggccactaggtggtacagggctcctgagatcatgctgaactggatgcattacaaccagacaggtattactcgccttggttatttagggccttatttaattccatgttggatgcatttgggattctcagaaatagagatggtgggagtgggaagaaatgtcttttcttccctcagtgatccttttaaagcctgcaagtaaaaatatttcacttcctcagatggggaagtggggttttatacacagcttttaaaccttgtgatttagcaattgggtttttatttatttagattttgaatatattctctgagtacttatacctaaagacaattagtccataattttaacccctcaatgttacttggaagaatctaccattctactaataagaaacttgcccctttttaaacagcttatttctcttaagtgtgttttgacttaccccacctttgaacagccctttagtcaggtgaagatcttagtaagctatttatttctgtaaaaatgagtatgattgttgagcctcagatgtcttaaatagtaatttgaatatttcacccctagttacggtttcatttgttgccaagaattgtaacagtgacattgcatatacttttacttctttttaattttgccagttgatatttggtcagtgggatgcataatggccgagctgttgactggaagaacattgtttcctggtacagaccgtatcctttaaaaagttttggattcttgtttcttatctgtattccagtgtccatgggtgtatactccttttacttatctctagggaagactctcagtattttgcttttatagtctagataatgcattatgaggtctttcttcaaactgagtagcttgccttgccaagaaagaggcttcagtttacttttgtgagttggaaaaattcctcataagttgaaaaacccatcaagtctgtcttctttttgcaacagtcccttattaatcatcccacagcagttctgagacctgagcatactcatgagaaactccagatcccagtgacagttttagtcttcttgtataaacacttaatgagcacaagatgcccatttataaatgaagggcatcttgctgttatgtttatgtattaaaagggctatgtttggtacctgcagtgatatactgcttacttgttatgtttgttgtttgacaacaaatagtaaaagcaagaagtgaaaagcttaccatgtaatgtacttttgtttttccagcacaactttttcccagattgcagccaaaccctaatttactccaagacttactgtctagtttatggtttattatagcccctttattttagctcctttcctatctgcggtatgcttgtttcatggtttagtattaatgtcatgaaaaatgtggtctgttggaactctcatcagttctacttatggaagatgtttaggtgagaaagattgttaaaatatatgtctagaattagttttggggattttttctttttttaatagaattgagttaactagccttcaggtggttttggttaggcaatattagacatgctacctctgatctattatgcctagagatctaaaagccattttagtcccttacctaaataaactaattgagtttataaaccagaatgtcaattcacttgcttacagtttgggatatacttctgtaatggctatgatgttcatgatatctacccacgtgttctaactatcttctgctagagagaatgtactttcattatgaactgaaaaaacctctatttctcaggtaaagctgtttctttctctctgaatattaggattgataacagagttcagtctccctgtatttagcttaccttattactccctacctctggattttaaattagtttaatacctggtgtttctcctttgtcctttgtttcattcaccttatatctgtttctcagaaatttggtatatatatattacagtccaaggtaagagaattagggaaaattcatacttccccctttcctcaggtacatatctcagagtcccatccttgctttgtcctctagagtagctgctgtcctgatgctattctctgttccctgctccccttcctcttcttgtgtctgtatctccagctaccatttagtcagtcacagacctccatgccggtgtagacacacaaggtggcagagagggaaaggcagtataacatacaggttaagcacatgctctggagccagatttcctggatttagatcttagctcttttatttccagctatgtaactttgagtaagtttcctaacctctatttctctcagtttccttaaccgtaaaatgataataatcatacatactcacaaggttgtcgtaagaattcagccagaaaataactggaaagtactgagacgagcctgccagtaaatgttagccatcatgttcagtaatggccttgcaaaacagattaccccttcaccttctcacttaattgtctacctatgaatcattaatgttttgttttgtttttaattctgtgataggtaggaaaggatggaactccttggcagactagtgttagaaagttttcgaagcagtgtgagtcttgtacctttgtggtcctgtctcacagacacctgtctattccctgacccttttaaatgctaactttctgcctgtaggaaatcttccctttgtgcttaggtctttttcttctgtgagctttagataaaca

SEQ ID NO: 14869 - DNA, 15141 bp, Human
catgattgatctttggagccaaggctaattatttcaaagcaattagataatcctcattttttccttgaaaagttttgtcttcctttatttccccaaatatacacatagtttactgtggcatgcatattcccattgcagtgctctattcccagagaaatatttttcttgtagggaccctctctctgttatttaggttgacagtcactaaggatttactatttcaacaatactagcactgcatgtcatccagtatacactgggaaaataaagtgccgcaagtgcatatccaggagactttgtggccaccagattatgaggaatgcatgtatttaattatttatttttgggacagagtctgtctctgtcgcccaggctatagtgcagtggcaccatcttggctcactgcattctccacctcccaggttcaagggattctcaggcctcccaagcagcggggactataggtacgtgccatcatgcctcgctaatttttggatttttagcagagacagggtttcaccatgttggccaggctggtctcaaacccctaagctcaagtgatctacctgcctcggcctcccaaagtgctgggattacaggtgtgagacaccatgcccggcccatgcattattattaatgttgaagtagataatttaacaaacatcaatgaagtataagatttttcactcatagttgcaaaatatcatgccaattgccttctatgagctgtcataagccacagcctagagattcaattccatttcaagattcaaccaaagccaactcatcaacaagaacatgtaaaagacagaaaaacccactaccggcaggctgaaacagatgctgtgacgtggccctggcctgtcatggcgtgtcacagcatggcacaggcctatatcatgttccctagattgctgactaccaactagttacagctgactccaatcaggtcgggatttgaccatctctgcactgaacctgcaattgcaacttttaaaattgaaacgctgcttctcacctctcctccctagactctatttcacagaggaaaccatcacagggaaagcaagcccttgttttttcttccttctttgctttgctttctttctctccttccttctttctttccttcctccctccctccctccctccctccttccttccttccttccttccttccttctttcctttcttccttcctgccttcccttctttctttcttttttttgagacagggtctcactgtctgtcgcccaggctggagtgcagtggcatgatctaggctcattgcaacctccgcctcccaggttcaagtgattctcctttctcagcctcccaagtagctgggattgcagatacgtgcccccacgcccggctaatttttgtatttttagtagaggcagggtttcactatgttggccagacttctttccctccctcctccaactcttcttttcttccttgctgtctccctccctaccttccaacttttggctgtgttgaatttgttgactcatcctgaacaagcagaaactccaatgatactgtcacctaagagagaactttgcacaaggttgccatgtttaataattcattcacagaatcctcaatctcacaaaagcctggaatggatttcctgtttggttatggcagggaagctactgtggccaggctccaactcctcccactgtagatagcagcagccttcttaagcagcctgtggccgggcacagtagctcacacctgtaatcccagcactttggaaggccgaggtgggcggatcacctgagctcaggagtttgagaccagcctgtctctactaacaatataaaaattagctgggagtcacggtgggcgcctgtaatcccagctactcgggaggctgaggcaggagaattgcttgaacccaggagacagaggttgtagtgagctgagatcgcaccactgcactctagccttggcaacagtgcaagactgtctcaaaaacagcaacagagagcaggacgtgagacttctacctgctcactcagaatcatttctgcaccaaccatggccacgtttgtggagctcagtaccaaagccaagatgcccattgtgggcctgggcacttggaaggtaaatatgcaaatctttgcacacccttcttctctggaggggcgtttgggtgttttctctttctgcattcagccaggaaagcctggaggtcgggcaggggttggagaggtaagattcagccctggagccaggacttaggttgctttcttttctcagagctgattcaggctgcaaagctccaaggctggctttcccagcagtgatgagagcttctctagcaagtatcaaatttcaagcagctgttggacttaaaactgttttccagggcagtttctctctctggttctaggacacttaattgggctcaacgtttcccccaagtcttggctgtgggtttgttgtgggctgggtggttgaggagaggatgcagagcccgaagtccttggcacccctttgcagatcacggtgtgagacttgggctagcagcatccctatgacctggaaacttgctagaaatgcaaactggccaggtgtggtggcttatccctgtaatcccagcactttgggaaatccagacgggagggttgcttgagcccaggagttggagaccagcctgggcaacatggcaagaatccatttctacaaaaaataaataaattttctgggcatggtggcacgcacctgtagtcccagccacttgggaggctgaggtggagattgagtgttgagcctgaggggtcaaggctgcaatgagcagtgattgtgccactgcactccagtctgggcaacagagtgagatccaagaaagcaagaaagagagaaagagagagagagaaagaaagagagacagagagaaacaaaatgcagagtctcaggctccaacccaggctacctaatgggcatctgcactttaacaagatccctacgtggttcctgtacacattgaaatctgcaacatgctggggctgcagagagcctgggctgggagtcgtgagcaccacccggctgtgttaacgacagctggcaaaatgtggtaaggcacatccaggactcagtgaggcaggttcccgagcctctgttaggctaagtttcaagttgttccatcaccacctccctctgccttctttgccatttccatccatgatagcactaccctaactagtgatgagaagcagtctttggagttcctcttctctcctgtccctcatggctaatgtccctgctgagacttctgcctctggctctctttccttctgtgcaccctgatttttcttctcttctgtcccaagctagaggttaggaccctctgctgcagcactgggtcatcctcaggatacattcttggtgtatctggaggaacagatcacttccagcttgattcatgcagagcgtctcttgcttgaatagcaagatttgcccaaaatcagaccttcaatcctgtataaacagaataaataatcacttccagatctccagggaatctactcaccctgggtgagtttaccagacagtttcataattttggaattgaatgaaagaattatgaagggagctgtcttcaacacgtggggatgatagactaaaggattatgaacttagcagtggaggtgaagaagggtgtagcgtagcggttgggggcacagggctgcttctgggtgcctggcagcagctcgtttcttgtccaggtggtagggtagctgtgcatctctgttttgtgtactgttcaatgtttgttatctcacaattgaagaggtttaaaagaccattttgtgagagatcaagttttaagtgcttttttgcccccatcattggcttggctaggttagaacaaaatgtgataattctatttcccttcttttctttttttctttcttttcttttctttccttcccttctttctctccctctctgtcattcccctccctctctctttctttttacaggagtggaaaacaaactctattcctataaggttttctatttctcttttttttctgaaacgatcattgtataatgatggcctctactgaaccttactgtgtgtcaggtaatgtgcaaaaagcttaatattcattgcagcatctcatcaccacaaaggcctcatgaggctggtgctatttttttttccattttgcatacaaggtttacagagattgaatcacctgcttagacccacacacccagtaagtgatcgaatccagattgatggtgtaatgaccattatccagatccttatcaccatttggggaaattgtctgaaaatcccttggggttatttagagtcaagctttcatctgggtcttcagaaagttgtagtggagcggtctgcacccccacacacctgaagacatttcaggactaacctggatgaaaagggaactgacttttagctaggataggacataaggacataatcataaaataattcactttccttcttttcttttgaaaagttttgtaaagtgtgtatcctcccagagatcccctggcaaaggagaccccagtgaggccttggtttggagaaactgggccttgtggggcagcctgttgaaggtggcctggggataagagaatatgatggttgctgagagtggtgtaattccagctactcgggaggtgggagggttgcttgaacctgggagtgtgaggccagcctgggcaacacggcagggccccatctcttaaaaaaaacacatatgtgatgagcttttcttttgcctttcagtctcctcttggcaaagtgaaagaagcagtgaaggtggccattgatgcaggatatcggcacattgactgtgcctatgtctatcagaatgaacatgaagtgggggaagccatccaagagaagatccaagagaaggctgtgaagcgggaggacctgttcatcgtcagcaaggtgcaatggtgcatttggtgggaggccttcacttcaaggcaggcagaagtatctgggtcgggttggcagcaagaactctgtcagccttttctacatgtaccccttttcatctctgccttgataacatccgtgaatacaacactatccatactccaagccattattgatatttgaacatgtcgtggctgccccacctgcctgtaggttggttttcccatagtgggcttggttccatggaaccctgcactgccctgggcctccctgttccccatcagagggatctaccatctgcccagaggcaatcagaggccaagggtgcaggcgggtcttgatctgaagcctccctttcagcactgtgatctcagtgactgtgcccctgagactctcagccagggggaattttagaaaatggtaggggcatttttctattgtcacatatgaatttctttattcattctagtaaaaggtgagggatacaatgttataaaaaagaagaagatgttgggtgtgagagggctgagaatcactggatctatattatacataacttgctgaaaaaaaataacactagttctaggtacttggaaaatgcatacatctggtaggacaaatagacctcactgtgtagcagccaagtctggataaagcctttgtaaaattatcacttggggccttataggcttgataagggacctatcagataggtcagataaaggaccatctgctcccaaaggcctaagaatgcttgacatttaaaagctacacacaattcctgctctcagagagcctacagctgaggaagagactgagacaggtaaacaaatttcaaatctgtggccacatttacttcaatgatctgagacacgtatagagtactaggacagttgaaaaagtcaattgcttttaacacttaagacatgtcattgaggtgctgagccctggtgatgttccacactgtgtcgtggatcttaatcagctttgttacaaatggcttgtggtgggttagatgaggatgcaaatcaaaaagcagggacaatgagtacaatgtggcccttccttttcccagtattaatagctcattgctacactctttgcagttgtggcccactttctttgagagaccccttgtgaggaaagcctttgagaagaccctcaaggacctgaagctgagctatctggacgtctatcttattcactggccacagggattcaaggtttaagacactctctttctcagcctctagtttctgagcaggtgccagaaaatagtagctgcaccagggctgtggggtggtgtggactggggcaggaggccttgcatttcataattgggaatggcaggtggtcaggaagagaccttggagaagaaacacactggcctggaagggaggttgaggccatgtgtgctgctgaggtggccacatgcctgggttttcttgcagttatgtctgagagaagacatgatttctggcagcccagacaagttgcaactgccatatcacctttgtcttgattccacgccccagggttgccctcccaggaaatctcttgggttactcttgcataactatattccagggcataattatcttattaagcaaagtacacctgggagtggcatcttggagaaaagcccaagtatggtgatgctggaaggaagccagtagtgatccaggcacccattgcctggggctctgctcttacctgctcctgaggggtgggagagacaaatttccagctctctcccctcctgaccaactggagtgatgatggcctgccacccctaattccacgcctcttctagaggctgcaaggatagaagttggccaatatcttctccagaaaaccacagcttggatatctaatccttatccagtaatattgaaatgaaagtttgcccttggttgtatatgggatctaggtgtatgaggttaatgtccatggtgataatgaacttctggaatgtactagcagcaaatcttaaagtcaagccagtcgtttctaaaatattagtatgctacagtagatacagagattttaattaaactcacattcctaaagtatgtactccagaacttgaaaaagtggtatgcagatgtggtatttagcaagagtcaggatcctgaaaccttgttgaacagaaccaagtgtcctgatgcagattccagtaaacttttcattctgtgttcacagtctggggatgaccttttccccaaagatgataaaggtaatgccatcggtggaaaagcaacgttcttggatgcctgggaggtaggttcccagcttcctctaagtgtgctgggagagaaatcttcagttatccatgagattcgcatggatatgaatgaggccatgtgcctgatgctttctaatttcatcattgtgattttctagctcttctaatatcttcctcatcacctttggcttttgggtacatctgatactatttatatttcaaggctaatagtcttcaaataagactggaaatacaatgtaccccactttggggaatacacatgctgttctcaaaccagggcgaggcatttggaacaggaggtttgggcctgggtgtgctcatagcagctgagtaacctagggtcagttttgtaactcatgtagggctcagttttctcttcttaaaaagaagttgtataatacatactaccaatatatatcttccagtgtgtgataaagattaagatggtttacatgccaggaacattagtcataaagcccatttaaccctaggagacagggttaacatccccatttataaataatgacatttgaaacctagattgtttgatgacttgcccaggtcttgtcacaatgtgtgtggcagagctgggattagacccagactcatctgaatcacaagtccaaccaccaaagccatcagcatggtgcttggcaggcagtgaagacacatccagaaatcagggagcctgagtgctctgcttctcagatctaaccatgacctgtttcacgtcattcacattcaaaatgaatgaagggatgaacattttctctggtcattttttattatttatacccttttgcaaatgctagtagagaatgaagtggaggaataagttataaatgaacagtggcttatgactccaagagttaatcgtgttattttggtagctgtctgtgtaggtgtgcatgtagttgcgagtttgtattgtgttttacaagcaaaaatatattatgtttcaactttctgaaatgcttataattgacatgattcaatgaaatgtagctttttctgtgtattgtttgttcaaaagcattaatccacaagcacagctttttgttgtttttattgtcttagacactctcactctgtcacccaggctggagtgcagtggcacaatcttggctcactgcaacgtccctctaccaagtaaaagccattctcctgcctcagcctcctgagtcgctgggactagaggtgcatgccaccacgcctggctaatttttgtatttttagtagagatggggtttcaccatgttggccagtctggtctcgaagtcctgacctcaagggatccacctgtcttggcctcccaaagtgctcagattacaggtgtgagccaccacacctggctatttgcattacatatgataagatttttttatcttaactcttatgatgccatgaagtatggcaagtatgtcaatgtagcctgcttctcgcagtgctgttttttgaatgaatacaagaacgactgctaaataaaacatttgaaaggcatgaaaagatagcagtgatcaagatcagaggctctgatttgaaatgagcaggcttgaatatgtaagcgttggatgtttatgtagacccacaaccagttcagtagaaacctcactgaccacattgaagcagagaggaggaaaaatgtataaagaagtcaagttctaatacaggaaaactaacctgacctatgtgcacaaaaacttttaaattatctaattgccccatctgaaattttgggaaacctaatgatttcacagcttctaaattctactgcccaatttggataacatcatatatcctagtggttctcaacgtggctatgcattagaatcacctgaggagtttaaaaatcccaacgtctaggctacaactcagagaaaatctgtaagaaactctggggggtgaaatccaggcactggtaatttttttttttaatttagagagagtctctctctgttgcccaggctggagtacaatggcatcatcatagtttagtgcagcctcggactcctgggctgaagcaatcctcccaagtagctggaatcaaaggcacatgccgccacatccagctaattaaaaaaatttctttttgtagagacagggtcttgctatgttgcccaggatggtctccaacacctggcctcaagcaatcctcctgtctcagcctctggtaatatatatcagaaacatatatattattagtaggtattataagactttttttaagaagagaaagctaaggcctacaagagttaaaaaacttaccctaggttactcaaacctaggcccaaaacccctgttccaatcctcctgtcacctcccaaagtgctgagattacagtcatgagccactgcatccagccagtattttttaaagctccctggtgattccaaattgcagccaaagttgagaagggctggataaagtgttccctgaacatgtcgtgcttatccctgcctctgagctttgctcctgccttcctgtgtcatatgctcatgttttttccctcttttctgtctttttttttttttttttttttttcttttgaggcccagcttatactctacctgaaggactcccctgacaactgcgggctgtatgtatctcttctttctctgccctttctgactctgtctatgccgctgtgatgttatctgaggcagcctcagtgtcatgattgatggctccatagaagggaactctagcactttaattggactataagaatcccagaaaaagggagcacattgtatacatttacatcctgacaacttctgggcaggatctggaacatgtaatagatggctactaaatacatattgcactggaggctgctgctaacatgtatggtatctttgggcaagtttggaaaatgcccaatataggctaaaaattatacaaagattcccttccttgcgtgtccatgcagtttctgtaccaggaagcatggctggatatgcaaacagtgggtcaggcttcagtcccacacaactccatggccgggtgcccctatcagggtgtaatctgaatgcatgaccttcctgcaaaccaaagcatgcttagtgtgggagagagggactcaggacccacaagtgaggcttctccgtatgctgcagcctcttcctgactaacacagcttgcccaggtttgggtgtgcaatgcacacacacaacagcagctccctgctatcatttggattcattaaaaattaaatcatctcataagcttacaaatgttgatttttatttactttttatttttttgcattacaaaactttcatatttcccctgtgtacagaagtttaattttttatgtgtttcttcacgtgtaaggtgagagtggcaagaacataaaatctttacctgttactcctagtttttcttgcgctggggaggggcagtagggctggaaccagtcactgatgggcacccaggccctggactaaaatttcctgtgaatgcttcggctaaccctgttacggtggatcctttagcaatttctgccccagggaggactaaggcaagccagggtccctgtagtccctctagagctgcccataaggtattcctttctatgataggccatggaggagctggtggatgaggggctggtgaaagcccttggggtctccaatttcagccacttccagatcgagaagctcttgaacaaacctggactgaaatataaaccagtgactaaccaggtaaattctattcagtttaagggtaagggtcctgccctattacttcttaaacattgcgggaggaatgttcaatgctatgccctgagtctcatctcaggggtcagtgatcaggacactttggggaggtgtgaggctgatctcacgggtgatttagcaagtatctcagtgggcaggtgtttggcctttgcttggtggactttttttgtgtgtagaactccctaggaacaatgcaaaacagagccggctttccccgtgatgaggattgtttgctgttgcaggttgagtgtcacccatacctcacgcaggagaaactgatccagtactgccactccaagggcatcaccgttacggcctacagccccctgggctctccggatagaccttggtgaggcttccaagtggtgggtctttctcttgataatcttaaaaacattattttataattggtaaatgttggtatgggtccataagttactggaaagaaaaatgtgtgtaaggtaacacgtttggtacacacaaatgggatggcagtgggaaaaaatgggaattaaacaacaacaacaacaccaagggcgacatgcttgaccctctgggaatatttccagttcagccacccaagggtgaaccaggctttgcaaaatgctgaggcttcagagcccggggaaaggacccaagcttccaggtcctcctgcctgtctcccagatggagaggctctgatgatcagtcttgagaccctcattggagtggtgtccttctgtacatggtagccatggtgattattcacatcagcatctttctgcccctagggccaagccagaagacccttccctgctggaggatcccaagattaaggagattgctgcaaagcacaaaaaaaccgcagcccaggtgccatatttttatttttcttgttatccaacaactcattcttccagtctcgtgtttcatatcctgtgttgtcctcaacaaactccttaaaggggaagaatataggagctgaagccctctaaagtgtttcctttgaagtctgttggaacctctaggaaacacaagagctgtcactgaagcaaagatagcttctgtctcacagcttcctgtcaagccctacagcccagtggcaaagcatggctttggagtctagggatatgggtgcagatgccaactctacctctgatcagccttatgacccccaagctactttcttcattcctaaaaaaggaagatcacagggttgtctctaaggtgaagggagagaaagaggtgggggtctggcacaagtctaatagctgtgaagggctcagtaattattagcgattgtacctgaagccacagtgagctgcagagatgttttattcttcctttccataaaaggaggggtctttggagctgagtggaagcctgatgtcccctttccgcataggttctgatccgtttccatatccagaggaatgtgattgtcatccccaagtctgtgacaccagcacgcattgttgagaacattcaggtaagtttccggctggtcggccctggtattcctcagtggagtgggggacaggcagaccttctcactaggcttctcacctcatcgctgcattgtctttggccccctccttccccaccaccctatcattttccagcccagggagctaggctcggtagagctgagatgaatgacccatgggctaagaacatcctgggggcagtgcctggtaaagccctatcaggtctgagcacagttgtgcctcacaccactgagaagaccctcagttgcccctgagcagctaggccctgggccacacacaagaacagactgtcctggcctccctgctcacctcccagcagcagaggaggtgtgaactgtccttggagaagtgtcctctagaagcacctgtcatggagcacagggcctgtgcacgcctggggtttagtgcctgtgagcctggtctccctccccccagaacactgagcactacaaatactgtggtctttgtgtaggacctaatttagagaaaaatttgtatcccgtggacagaatgggaaaaactcctgtggccagtttgtgctgtgaatgtgagctccctccctgctagaatggccggcagtctccagccacagctagaatggccttactgatgatgtattggaactcctacctttccaggtctttgactttaaattgagtgatgaggagatggcaaccatactcagcttcaacagaaactggagggcctgtaacgtgttgcagtaagtggcatggagttaactagaagcattgccaggagtttttctaaactaatagagggttagttggaaggattggaaggctgctgggactacttgtgtcttcaaatactattttggggcaattttgaaagttaaaattggggtacctgggaatcactgtgagggacacatctctaattgctgctcattgtctgaacttctggatgtagagctagaatcataacagaaggtgggttgtcaataggcgggaggcagaacattcatttattcattcattcaatcaatatctcacggtcatctatgtgccaggcattttctaggtgcttaggttatcatactgtacaaagttgctgcctccataggcttagggagggagggaagaagagacaacagaaataaatcaactcaaaatatagatgtcagacagcaacaaatgctagacagaaaaataaagtagggcaaagtggataggaagcggtgggtggtagtgggactgatcctttatacagggtgtgtaaagggaggctttgctgtgagggatataccatatgcatatttgggggaagagcattcttggcggtgataacagcaggtgcaaagtccctgaggtgggattgtgtttagaacattcaagcaagaaggccagggaggctggattaaatcatctccaaatgcctcttaaaggaggtggtgctaactttacttaaaatcttagataagtggtgaaaaaaagctttcactctggctgggcaggcattctaaatcatctctttacaagcaatactttctgaataatgtatctaattaaatgtatcaaaaagagttgtctggcatttattactgccagatctgtaattcaatgaggatttgaatctctttcaatgtttctatagccaaaaacgatttttcaccttttaaaaatgatttcggctgggcgtggtggcccacggctgtgatcccagcactttgggaggccaaggtgggctgatcaagaggtcaggagatcaagaccatcctggctaacatggtgaaaccccgtctctaccaaaaattagctgggcgtggtggtgggcacctgtagtcccagctaattaggaggctgaggcaggagaatggtgtgaacccgggaggtagagcttgcagtgagctgagattgcgccactgcactccatcctgggtgacagcgcgagactctgtctcagaaaaaaaaaaaaggtttcagtatctcaagcgctgcttgcatgtcatgatattccatatctatcctgcccaccctaagtatcataggagcctttcctcatcttacaatggcttacttttattggagcttaacaaagtagtagctacttagagcaaaaaggaagggtgaacgtaaagtgggactcacccccaaactaaactgcttaccttcctatgagcatcatttctggcaatgggtagcaatggaggcaatgggttggtgggctctgcagtaaatccacctggcctcaaatccaactttaacactggtttattagctgtgtgacattgggcaaatttcctagtttttccaagttggtttcttcacttataaagtaggatgataatactaatcgcagctaacatccattgaaccttagcttagaatgtgccagggtcctgcgcccttttccggtggtattatctcatttaatactcagaacaatccccaagctgtcaattctgctgttgtttcctacttcatgatgttgtgagagtggattgggacaagacttgtctgtcacctcgcctgacaccaggcttactatgggttgtcattacgagtttattctgctgccctgctcactgtctgccctccttccgagcaaagccctcatatcgatttgagggaaggtcaaagtgtgggcaccctccttatgttcttgcagggaggaggctaagagagcacaaatatgatagagtccaccagggaagaataccttctcaaccagagttgttgttttgatgg

SEQ ID NO: 14870 - DNA, 186734 bp, Human
gcactttcaaacaggcctcactgagttatggagaataccacctggagatcatgcacccggaacgtctctggacacaggtcatatctttgcacagacatcaccaattgcagctgttttctgaactcctgatgtctgccctacaatatgttcaagcccagcagtttaccagactatgtagtattattctatctttccttcctgtcagatatgggatgtccccatcagcaaaactggccgtgttccgaaaatttatttctaaatcatttatctgggatcagaagacattttcccacaggaacaattttataaacagtggtgttccacaaatgcctgcttgtgccacagtgtacctgaaatgcaacattgactgtatgattcccaccaaccattatttattcttttctctgggaaagtgcattcctcttgggatgcctgaggctcatctctccctctgcctgggagcctcagctatagttttttgggctgtgcagcagtagcagtcaggaagaggggagggaagcaaccttcccaaaaaagagatgagtgtagagagttgatatggatgcctctgggtaacttgttaatgctggaaggctgaagaaggaaaccaacagtgcgaactggctacttcccaactgttctaaaagaggcacaaagggcagggacattttcgtaaacagagatcatttctaagtcacatcttcataaacagggaaaggcatatagtaaaacctcccatttttaaagaccagtatctggacttgtaattagccaggaaaaatattgtgaaacttcttggtcagtgatgaaacagtctcaaacatataacaatgagacatagatcttgcacctatccccaggcctgacaaatagtaagtgctccaaaaaaaggggatttcaattttaattaagtactaattgagtgaattctgtattgaaaaggacaagactatgtgtgggccagttaccttaattctcattagcatctactaattctgaccctcttatagcacacatcctaaccatgaagagttggtcggagcactttcaagacgtcacctgaacattatgtcacctctgcgggatatatgcatctgtctaccccagcccaaagcaggtggtgggtctcttcataccctctctgatgtgcatcaatttctaggaatttctagtactatctccacatcaccaaatctgaggaaacaaaagagataaggagaggaaagtgaagccagtgaggatatccaagcctgtaggaccttaggtttattctggccagtattacctgctaaaaaagacctacgcttttggtttccctttggtcacttatttttataacacatgcagacgtattttggggaggtgtgcctctttcaggctagaatttagtctgctcagcagacccgggtcctgtctccttcaggttttagaattgcataacaatttaaactcattttgtatgtgcaagtactttgaaaagaaatatactattaagactccctctggtaagaagccttccccacccccacgcccaataaactgatctgttaactttttgtttcagagactgtgctttctttttattgctgcatttgtgttctacaagacagcctctttctccaagattaacatttcttatgattgttcctgacaatggattcacttccagaggccctgctaaggataaccaaaaaagggcatggagcaggctggttttggcagcgtgcacgcagtttcagagctttttaggtcttgggttttctgatgagtgatttcctgagcatgcctagggaatgacaggcatctccacaggcaggctgcatccaccttggctggggtgtcgtcattggctgcctattagaaaaacgacaggacaatgcataccaccgcctcccgactgtaaacataggggatatgtgttcacttagcatggacttctgggaggggccaaggaagggcggtctggagttttattgaatagagcagtgtgtattcggctgcctgcctgcccgcctgcttgctctctggctgtgctcctgcttaaagaaatcagtccttcctttccgacttagtcctcgggaagaagtttcagactacaaggtaaggcacagaaggctttcttttttatcttctagagagaatctggggactttctccggctttcagtcaacattcctggctaaggtagctggagatgcaagaatgttcaaggcaataaaccatgcaaactcccgagcctgactgggcttcactgccatacggatattcccggaaggcaaacaggatgagatttccagttttgtttttagaattgggacaagaagagtgaccatatagagacttacatttagggaacactggcaactttgattaggatagccttttgtttaggacagccatatgagattatacctgatatccaaaggccagtgttagcaagcctactgcaccagactgctcacacagtctcttctgcatcttttattgccaaagatttgaagaggttttgctttaaaaacaaaatcaacaatcctttaggttgatgagaagccaaaagggaatgatttttttaaccaaaggcttttgcgttatagtctgctgccagtatttaaaactagacttccagagttgcaaggaaatacggtcagagatggagagatcactagcacctagcactggttgggttaatgtcactgatgggatatttgctaagacagaagatgcctaggctggtctgtttcctataaaacctaataacaagagaatgcatgcgctagtgggtgtgtttttttagaaagcacatttaacgtcctaccaaactattttttaagaaatctttttttctgtttgaaagtgtgcctgagtgtgtctagagaatctaaagagatgtcgattggcaatgtgtttcagaaaggaaggaggcaggcttttatatctagatagacatatttgggtgtctgaaacagtagtacaaggcagctagttggtagtagcctggaattccttttagaaagagctgatggcaaggggtgggggaattttagtgctgtggcaatacatggtcaaaaaaagtggatgagaacaaagtgcttgatatttatagatgccttctattaacaggactatgcagatggacttgtaaactgaaaatccttctaatgtgtttgtcaaaaccagacatatacagctagaacctgagtgaagactagatgctatatggcaagcagggtaaatctgatgattttttagtagtgctggctattaaagactaccagctgcaaatgactgattcaactggattttattccatgcaatgcggtagtttggggttgagattcattaaataaagttttctctttgtatttagaagtttggggataattttcttgggaatgcctatttctccttctagaagtgatatatgagaacagaattccttgtgaatttccttccctggaacagttctgagtaagtgtgagagaaaagctgcaggcaaaagctatagtttaattactgtccttccctcgaagagatcaagttccaaactattttcacagtgtttttaatgtcaatcaaaatatggagagcaatttttcttttaactgttctctaaaccatgaagggaatgcagtttggaaggagatctataatcttgggatttgaggataaattccattttgaaaccaacatctccgaatccctgaaagttcaaactgtgctatgaccactctctccagatcccccatcccccttctcttgggctccccacccccaacaaccataaaaacactcatttttttccaagtaacactttaggtgttctgctgttataggtagagatagagtgagaggatttgagtttatgctgaattttaggcagttctttgtgctacttccttcctgttgaatgttacctagaacacatttccccacatagtgaggccaaaggagcacaatgaaagcacagtaactttcatttcagaaatataatcacaaaattccagaacaaaaagtcactaagagttgatcctaggacacacaaggaatgtatgtacaatggattgatccataagtaaagtgcagggttgtttcaagtattcgaagcaaatagaaggtgtaatttaaatcattccagtcaaaagattgccttaagtaaatacacaattcttatattaaagttaggagaaggagaaccaggctcaaactgcagtttaaaggattttaaatgagatacatgaaagcatttcctgacagtaaggcaactgccttattatgagaatcattaacaattctaattggctcctgtgactggcctgagaatctcctggtcttaggtagatagaataagttgatcttatggccagccatgtaaaggtccagaatctagcccaggtattctctgttctgataaataaaatgcacctcagcaggcatttttgtagaaacacatgtaattgtctccatttgccattttcttgatagcatgattaccagttagtcattccttagcaagacgcaaaagtgattcagagatgggcatgaaaagagatttgctagttccccatttgcctgtagtctatcacatgtctcagaaatgtggtcgggggacaggaaaaatgctgatagagtggtatgcaaatagcatggtaggactaaggaggaggttagaaagatgctgccaaagaattttcagacttcaaaagggcgttttctgcgttaagttctcttagggcctgagaagataccattagctccttactgaaagtccttcatctgtcaggctaatccaagtttgctattggagagatgcccataagtcctgagtagatgggtagtttaaagagaaacttttggcacaggcttaacttatgagaaccactacaacatctcagttctagtattggttcctctgcttaagtaaccctgacctttttgaggaaatcatcagcttttgacttcatctgttgagtgaagaacggacattggtaatgcttctccgatgtcccacagtggttaagacgtccaaatgagatgaagctgtttgctccctcttccctgcagattctataccctgaactgcctatcatttgagtcctctggacattatgctcatcttggctggtatcctccacttcttacctagtatccctaatgatctcttcctttctcgtatttaaggacccttgagtgatatcttctcgctcctggttatttctagagccctgagccgtgtccagtgaatactggtctatcccaatgttgtctgaatttttactttgatgatcacagactaagaggacacaaatataaggaagtggaataagatgggccatcagtggtacaaggcaccaggaaatccaaagatccacttgagcataagaccagtgagaaagtgctgacaacagaaagcccttaagtaattgaggcagcttctctgcctccagccaaaagcatggaatgaaccccggaacgtcatgcctgggccttgtaggaagggcaaggaaggcaggaacacctggctgtggttcctgttggtattgaaaccagactgctccacggagctcgcctctcacctctttgcttctgtctttagtgctcccagctgtaacggaccctagttgcatccctaacttccttacccccaggcctccacctgtaacctcttccccagctcccccatccctgtaccggatagggagctttcttgatccaacattgacaatttgcaggggccagctctaagatgaggcccagagtacagcagaacactctagcacagataggttctagctagggaaagccacttgcacagacagaggagatgtcagagcatgttttgtggtaaggacccactctgcttctcaccccaaactcataattggcaggctgtgggtaaggctatgggagcggggtcggggggaaactatgacctgggctgtgagggaggggtgatgaggttgttccctgtgttgttcttccctgtgttgttgctatggaaacctttgagaatctgataaaaactgtgaacccttaaggtccctttgtaaacccacgcttcatgattgacaggtaagagacctttgagctggggcatgtaagatggggagtggggtcagatctggattcccatagaagacaagggtggatgggatcagaacatgagtggaggtgtccatgatctggaaggaagaaaagagggggtaaatacacagatatataggtggagattgcgtcatatgacctccatttcaaagaaaaagaggtcatttccagaaaagaagcaattttctatggggagctcgtgggggctagagaaatccaggaatggctgctattaagtgtacgtaaaaagaacacccagaagttaataaaaggcttgctaagcagcagtaagggaatagttgaaggaaaatacatttttaaaagattttagtatatcgggcactcattttagtacatggcttttctttgaaaatatatgtatatgtataaatgatgtataacttgaagataaattgctttttgatggtatcctgaggcttctggcattgttttgtgaatactccatgaaagcacttgactaaaagggaataatctcacttggagagaaacatattaagtaggaatatataattagttcctctgacacccacatataacattccccctcgcttgtctcaagatacattgctggggaaccaggctgacttcaccttgtgctgaagaccagaaggaccaaggcaaagtgcccaagagggccaaggaccagttggcatcaaagatattagttccactggggtcaggaggaccagtctaagccagaatggatatcagttacaaaaatgggctaagttgtgcatgacagccaggtgagtaaagaagaaacagcaaaaatcagaagtcaggcagagcttagtgaagtagtgtatggatgaataaggtgaagtctgggagagcacatggcccagtgttaggaagaaatagacctctatgtgagcaaactttggttgctcaagtaaagggccaggattgtaagacacagattaacgaacggatgaaatcacagggatatccaagagcagaagcccaaataggaccagggcccaaagagagtagagttagagtcaaggtgggtgagaggatcccagccgcggtccatggatatttactccatccctttccactagtgtgactcagctcagcgcacgtgtctgcctctttctgttgttctatcaactggaaaatttcttctgtgtttccaggtccagtcctgagagaggagatctgattggttcagtcaaagactattgtctttggcaaatcctttagtaggaggaggacatcaaaggcacaggcgcgcctaaggatgaattactctaatccaggcagtggtcacccttgggcaaagaagagctcaatgggtaattttagttagaagagaaattgagcatggaaggcaaattagctgaaatgtccaacagctctcaatgggaatcatttgaattttgaggtgaataaactcctagagaggcaaacacccaatgaatgatcacacagttcttgatgatcactgtgacccactgagccagtgttaagggagattaatctagaagtttgcaccactggtaactgaaaggataagaatcatccatctcagaaagattttgggaaaaaacattctggatattattgttggcaagaaacttcatatgaatcttccatgtgatatggctcccttcaaatgaaagcagtcttgaagatttaatatgtaatcatttaacaattttaataaataaaaacaagcacaactcaatgtaaaccacagtacataataaggtgaatgcataaaagctggtgtactcttaatcactggaagtttcagatctaagcaatatttgctatgtaatttttaatccattgagcacccatcatggtgtttgtcaagtggactaaaatatcccctgagttctgcatagttcggatcccatttgggaacttgtgctctgttctgggctcatttttctgaaaggcatggatacatatgcattctagggttagcatcaaaggctggagggagtcaggaggcaaaacatatgctgaaccgataagggatctagagctgtttatcccaaagaaaagaaaatgaggccacataaatatcttctaatatttggggtacttttatatgaacatgggagaaggcatttgtgtttctcaaggcagcagaacagaactgaatatataaattcatagaatttttaagctgggcaagaccttaggagctcattcagcccaaggagtacatataacttttcatctgtatgccagctccaaccaattggcatgttaagaaggattctgaggatgaatctaagctcagaggggaggggaaaatgtggtcactgatagtgatatctgttgtggaagagaagggccatatctactcaagtaccatgttttagtcttcattaatgtggtctgtaggtttttaacctctgggtggtggatccctgggaggccacaaagtcattgcaagaggtaaacaaatctgtatatgcagcaagtgcttttggcaagctactctgagtaaataatatatcttacatcatatgtgctactatttttctaattctatacatacattataatgataaaatgctaatttatttaaaagagttattgaattcatagtagcttttaagtttgtgtttttgtgttttattaatgagtggacttaaaacatataattatattatgtgtgggaaggttgggacaggaaatttgggatcttaagtagaaattctttttaaaagatgaaccagtgatctattttttattctccaaagcctagccacaccaagtaaaattatgtatgtatttgtaggtttcttcgattaatgtctgccctgtcttattggtctgtcagatatataaggacaggaacctctatttttttttcattcgtatatacccagtgcgtggcacacggcagaatctcaataaatatttgttgaatgaaataacaaaccaagtgacttgaccaaagtcatccagttaattagtggtaagatagttccaaaacacacagctcctaagttccaagcagttaaccttttcaatataccacattacttcccctgatagtaagagagcatgttttaacagttagcaaatttaggttatacaatgctgcccaatctgcctatatacccatgcatcttaaccagtatcttaatcagaatcaactgtagagctttttgaaaatacacatccctgagacctatcctctagagattctgattcggtaggtctagaagggggtccaggcatctgtagtttgtaaaagttccctggtgactctgataaaacatcctggctcagaaacagttctgtgcacctatcgttaaaataattgatagtagatgtatgtagttacttattcctcagaagcctatttctttagttttgaataatttctttctaaaaattatagttgcatatgccaaataatccgtttggccagaagagcaaaacctttagttttgcttttttttcagtttaagcacaaagttatcaaccctgtaaggtcaaatttttctgatgagatttccagtgtttgcttttgtaaaggactggaaatgtggcaagaataaaatttctcatggtatttcccacttccttttccagccatcattactaagggaaatttaggcttagagggaggggtgaatctaggagaaaaaaaattttaagtatttctgttcttaggaggttttgagcagatatttcgcttcctaggaaaagctgaagatgtttttctctgtttccactttgtggtgaggatgcacaaatcctgaagaggggagaagcttcctccacctccaccctcacccctacatcttctctagggcaggagtcatcacagcccctggtttagatgcttccctgggtggcccttttgaaagtatgtggaccctaagagacaggagactttgagtgcatggatgggggataatttgcttttgcagaaggacagaaaatttatctctaggttcttcctttattcggcagttaggaattacatcctctgtattgcacagaagaatctaccatattcagagcactgagtacatggattatattcactaaagattggagagctaaaagtttctctgcaagagtgacctgatctagtaagaatgtcaaaattgttactatatttgtacccttgctcttcggtttagagggcaggtgcttccgtgtgtacatagaagcagagcttgttggagaagaggagctaaaaaggaattagattagaatccacctctgtacaatggcaccatctggactcagtctccttcatctctaacactgtccccactttctctgcaccccaaactcatactggctcccaaaagctcattgttaaactttcgagaattttgagagccagttgtaaaacacagccattataaaaactaaatcatataaacttacaattaaacacattatatgaagagccaagataataaatactcaaaactcttcctaattattttgctatgtttcactattatctattctcttgaggttagttacatctattgtggctatatggtggaaatactgtataaaatgctgtgcaactgagcttctcctcccaattcttcattcagtgatgtcatattcagaacttgaaattgaccatgatggaagtaattacaccacagaaatcagcccatgctacaaagcagactcccctcccctcacccaagaacttgttgctaaacattgactagcacatcactgaccctaagggatgcggtggtaaaattagcctctgcattggagagccaagcggaatacctctgtggttcagttacatgcatattcataatgtatgcttatgattgcatatttgtttgtttgcttgcttatttatttctcatgctcctagaacataagctctatgaaagtagagactttgtttggctttttcagtgctgtgatttgaacctaaaaatgtgctgtgtcctgcacatagtattaataaatgagttaaatgagtgaaagaaataaatgtcaggctggtagtggtagctcgtgcctgtagtcccagcactttgggtggccaaggcaggcagattgcttaagggcaggagtttgagactagcctgagcaaaatggtgaaacactgcctctacaaaaaatacaaaaattagccggccatggtggtgtgcatctgtagtcccagctacttgggaggctgaggtgggaggatcacatgagcttgggaggtcgaagctgcagtgagctgagattgtaccactgcactccaccctgggtgacacagtgagaccctgtctcagaaaaaaacaaaaagtaaaaaaaaaaaaaaaaaaaaaagtctacaatttctactttaaaaatacctgaagccagtgttcatgttggagctcattgattcctcatgaattgtatcattgttcagtgtttagaacagtgcctggcacatgctaagtagcatgtagatttttattaggtaaaaataaaataagttatcttcataacagctaattttacagatgaagaaactgagttacgattagattaagtaatatagctaaggtcccacagctagtaagtagctgggtcaggatctaaacccgggataatctggaggcactgcccaccttctttaccactgtgctatgctgcctcttgctagttactccacgtcactgagactcctcttttgtatgtggctctagaaagaattgagatctatttgagaacaaactttggagtcaggagaacttgagtttgaatctcaaatttaccacttttttcacttacaaaatggggatgatttctcctccactttgtagttgtcacaactactagaagtaatatcttgaaactgctttgcacgtacatgatagacactcaattacaaatggtcagctattggctgtgatttcctgtggaggctacctgttagcgtggggcttagccacacactgtcccctgttgcctcctctaggccatcctgtagacagattaaaaagggctcactgcttctacatttggggtctccaggaggtaagactaggaccaatagatacaagttctaggaagtcctatttcagatcagcttacagactttctaaatagatatttctgtctctgaagcacgaacctcgctgctctacagaagcagacaacttccactgtcctttccaaccagaaggtttacctgcttgcccttatcaacaaatctatgctgcctttaacattttaaatcattttatctagtatagctaaagagttgtattattcctgagattgggttgttttgcaggttttcagtgttttagacctggaatgagagggagtaagaaaagagggagggagaggaaaagagaaaaagaaataaggagagagagagagagagagagagaaaggagaggacagagagggaggaagggaaaagggggaagaggagggaggggagaaggaaattggaatttatctggagaaaaagtactgaacttgggagagagactgaagagcaatggattgatagttatctgaagtcctcacaggttaaggatggttgagaagataagctagctcattcagctaccttgctggcatactagctatgtgacaggcactgttctggttgaggactgctctctcagagcagtaaagtaaatcaaataacttgcccaaagtcacactgctggaaaatgccagagctgttcaaagctcctccctaactccaaccctctccaattctctacagctatctgctctgtgtcttcccccaagaaagcgatggaaaccagagcaggaggtttccgtaaccagtcattataatttgtcagggagccatactgcagttcaactagacaagcacattgtcattccctgccatataaggaaacagagctaaacaccattgctttcactattgactggagaggttgctcaagttagagttagacaagatgaggatctagacctagagcagttaaattaaattaaaaaaagaaagaaagaaagccagagaagtagttttgtgttttcttttcctggtaccagagatagtttaacaagcagtttccatccttctccctgactcaacgggagattttccctgacattaggcactaaaggattcaactactcgtacaaatacttcaagctgttttggtgtttgattatgtcaaattttaagaaaaggcagaggatcagttcaggtattcaaaaggccaacatatccaaaaggtattcaaaaggccaagacagagctgcttctgtgtgggtcaggtagaaagtcaaggactgtatttctctgtccattgatttacaaaagaaattagtgtccactcaccttcccaggtgagatactacttattaagaaataaaatcagaaatactacttattaagaagactttacatttaagtttgaccttcttgtccaaagctaagaatattcacggggtcactctttgccttaagactcagacacaatgggcactttatttgtttgtttgttttttgagatgaagttttgttctgtcacccaggctggagtgcagtggcacgatctcggctcactgcaacctctgcctcctgggttcaagcgattctttcacctcagcctcctgagtagctgggattataggcacacgccaccatgcccagttaattttttgtatttttagtagagacggggtttcactatgttggccaggctggtctcgaactcctgacctcaagtgatctgcccactttggcctctcaaagtgctgggattacagggaccatgcccggccacaacaggcactttagaatgcaggctcagtaaccaactttatgaagggagaaacagaggcatgaacagttgaaactatttccttaaagacagccagttccatcttgccatacagagtgcccacattttcagataatccgaagaggcatcacttagtgtccccagggaaatgaaaaacaaaaaacaaaaaacaaaaaaacctgtaaatagtctggtcatcttctcctaactatcatcttggaccagattgcatctggagtactagtttattaggcatacccgagactgggtaatttataaagaaagaggtttaatggactcacagttccacatgattggggaggcctcacaatcatggcggaaggcgaatgaggagcaaagtcacaaattacatggtgacaggcaagagagcttgtgcaggggaactcccatttataaagccatcagatttcctgagacttattcactaccacgagaatagtatgggggcaactgccgccgtgattcagttatctccacctggccctgcccttgacacatgggattattacaattcaaggtgagatttgggtggggacacagccaaaccatatctgatgccacaacaaaatgcacaaacaaatttatttctggatggaggttagaagtccaagatcaaggtgtcagcagggttggttccttcaagggctgtgagggaagtctctgttccagccctctctgtttcacttgtagatggttatctttgtgttcacaaggcattctttctgaacgtgtatctgcatccaaatttcctcttcttttttttttttttttttttgagatggagtttcgctcttattgcccaggctggagagcagtagtgccatctcgactcactgcaacctccatctcccaggttcaagcaattctcctgccttggcctcccgagtagctgggattacaggtgctcgccaccatgccaggctaatttttttgtatttttagtagagacaaggttttgccatgttgggcaggctggtctcgaactcctgctgtcaggtgatctgcctgccttggcctcccaaagtgctgggattacaggagtgagccactgagcctagcctcctcttcttataaagacaccagttgtattggattaggggccaacttaatgacctcattttaacttgattacctctgtaaagaccctatctccaaataaggtcacattctgaggtcttaggggttaggactgcttcaacatatgaatactcgggggagatacaattcaacccatagtatgtcccaactcacaatggtggtagaaatccatatggcacattttctgaagctcaagtgccaaagaccctactgctgctggtattctatctttccactgggtctaagggaatgctttgctagaaatcccttggccttttgaatttgcctttgacatttactttctgcctttctcaatatgaaattctgatcccattaaaagtcaaaagaggttttcgaaatgacgcactgaagtacagcttcacatactgtggcctatctgtggacagctatgaaaccacggcggcagaccatctggtatgaggcctttaggagccaaggacggggctcagtgggaaggcttggccagggcagcctgcaagccagggaggcaggcgctgagaggggagcagcttcagggcagctggccgggccagggaggcagccacagagggaccttgtgcatgcctgcacagggcccaaagagggtggcccttttccgtcatttttatatatgctgatcacaaccacaaatccccagacacaaggaaaaatatttgaagcctacacatatttgcgctctgaatcatttgtctcttgtctttattttcctctctctcctctctatctatccttaaatttttatactttttctctcaacagtcctcctcactttatctgtctttgctctagttggtttcaagcacccatacattgtgtcttgtctgcattttccatgttctatttttaaggtattttattttagcctttttgtcccttttttgtccctttcctaaagctcttcttggtgcccatttcccagctttggtcctgctcatggcttctctgtcttaggccaggggtagtctatagacaggatgactataccatttatcgtcaaactgggacacgttgaagagggaaagaaggggcagttaataatttccctaaaatgcagtcccgaagtgggactgtcccagtgtggagtggatgcttattctatccatggtgtggttttctgctttccacaaatctctcttcacctatcaaccactccctccatttatgtaccattttttttttttaaaccttttatgttctggtccttcttttttatttcaaccccaagaagctttatgtgttcttgtatttctgtcttcttttatctcctcctcattccttcactttactctactctgctctctatcttgtctcaccacttcaattcttcttctcccttgatttccttcttttgggtacagactggactgcagctcacagaggccatgcctgtctgccatgatacatgcaggacatagtccctgcatttctgaaacaaatcaaggcacagctgagcacatacacacacacttcaaaataagccaccaaatgttacaagctgctttgggtctcagatgagccctgagtggactgttcaccccttcagcacctctacccagagactagaacaatccctacaccacgcaagcagccatgcctgttactgttacggaggcatgttctgtgtatgtgtctaggctcgcacgggatgcatttcctataggtgtacctatgtacactagagttgaaaaatgatgaaagcatatgacccgaaagacaaaaagaaagtgacaggtgagctaactgtgcattgcctttgttatgacttcagtaatctggatcatcttatcctctaaagaaatgtataccaaaggcctagcaatggctgccataggttttttgttgttgttgtcaattgaaacagagtctcactctgtcgcccgggctggagtgcagtggagcaatctcagctcactacaacctccacttctcgggttcaagtgattctcctgcctcagcctcccaagtagctgggattacaggtgtgtgccaccacgcccagctaatttttgtatttttagtagaagtggggtttcaccatgttggccaggctggtcttgaactcctgacctcaagtgatctgcccgcctctgcctcccaaagtactaggattataccatgcccagcctgctataagtctaacataagtaacaataaacttttaggcaacaagatagaataaatatttttttcagttctttttaaatgttctcatgacacagtcatctgcaacttatggtttattctgaaaaatcacttcaattttccagatattccttagacttaaggttgtgcaaggaaggcctgaaactccttcccaacttgaaaatgagaaaggaagagtattttcctcttgtaagtcgctggaagccagtccactgatacctgaaatacttgacagaatggcactgtgtcagctgtcaggagctgctctcgtcttttttatttatttatttacttatttgggaattttgaccacaattttctttctctttttttttcaaatactctaaaaattaaagaatgaggaaagaagactgtgtccccacccaaatcttatcttgaattggagcccccataattcccacgtgtggtaggagggatccagtgggaggtaattgaatcatggggatgggtctctcccatgctgtcctcatggtagtgaataactctcacgagatctgatggttttatacaggggagttcccctgcacatgttctcttgcctgccgccatgtaagacatgattttgttcctaatttgccttccaccatgattgtgacacttccccaggaactgtgagtcaattaaacctctttcctttataaattacccagtcttggatacgtcattattaccagagtgagaacagactaatacaacagtgaaatagatattttatgaacggaaatacaggttttgttcaagttctctccttccttcctctctctttcccttccttccccctcctccttttctttctttctcttcctcctcattcttcacattcttccagtttttgtttcttctcccactgagattgatatggctggaaatgtgctattatgattgggcagccttgtgctttatccatggtggcctatagctctcttgcttatatatatctttttatgaagatcgatggtaacaaaaaatacttcacccacactctgctgggaagatgcgacggtggaatggaaatatctatccagagagctccctacgaccctaagacttgacagagtcatccccagccagcctggagccactgacccacctgtgtctgagtaactgggaaacaaggagtgtaggagtttgagagttatttttgttttttacttttttaaactttcatgcctttccatatttctgctcttagatattctgttaaaataaaacaacggctctttccatgggagtagtttctagcttgctaattcttttttgagagagtgtttgcatgaggttttaagtttttaaagtcttggctcttatattttgtaggagccctagactccagatagtggtctaatagaaaattagccctggctcctgcctcatgtccacagctgataatctgtgtgactttgaatggcctccttgtgcctcgggcttcttaattataaactgccaacagccttttcccttctctatgatgccaaggtggggagcaatgtgatctttaatacaaaaggatgttaggcagtaaagtgtcttaaaacacagacatggatttcctttcttcttcctttgaaatatgaagacttttcctggttggttttgggggaagatagaaatcatatattcataaaggacacaccccatattcagagttcagaatttggagtttccaataatcatctcatgcacgagagctgactccctctgctggggctgccccacccccagttccagcctttccttctttcatttttatttatttattttcttagagatagatagagtctcactctgttgcccaggctggagtgcagtggtgcaatcatagctcactgcaaccttgaactcctgggctcaagcaatcatcctgccctagcctcctgaatagctaaaaccacagacacagcaccatcacgccaggctaattttgtatttttttgtagagaaggggtctccctgtgttgcccaggttggtcttgaactcctggccccaagtgatcctctgcctcagtttcccacagtgctgggattgcaggcatgagccaccacactggccccatcctcatctttaaaagcaatattgagaatcatcttgtttggagaaactctgaaaccctacagtgctgaaaagggaggattgagacagactgccattcaattgaagcttttcctctaatgtagtaagaattttttttttctttttttcttttttttgagaaaaagccttgctctgtcgcccaggcttgaatgcagtggcgcgatcacagctcacggtagcctcagcctcccaagtagctggggctaccacacttggctagtttaaaaactttattttttgtagagacgaggtttcattatattactcaaactggtttcgaactctagggctcaagtaatcctcccaccttggcctcccagtgtgctgagattacaggcctgagccactgcacccgacccagaaaacttttttaaaagctttatctgaaaccaaagcacatagtgcacaatggcagactcttagactcttgttgccctcagattttctaaaattgtcttttatcagcatttaagtttctaacacatgagatcacatatgtgaaagtgcttgtgctttgtaatatctgtgattttactatctatagcagaatatattaaagtgtaaaagtgctccaggaacctaagaagagtagaagaaaagcatgtttgaccccagcaactgtgcttgcagccaggcttgaacgagcaatcatgtgggtgggttaaattgtttattttttatttttgagacggagtcttgctctgtggccaggctggagtgcagtggcgcaatctgggctcactgcaacctccgcctcctgggttcaagcaattttcctgcctcagcctcccgagtaactgggactataggcacgcaccaccacaccggctaatttttgtatttttagtagagacggggtttcaccatattgtccaggatggtctcgatctcctgacctcaggtgatccacctgactcggcttcccaaagtgtttggattacaggcgtgagccaccatggctggccaaattgtttatttgtattgttctttaaataaaagtttattttagaatacttttaaatttacagaaaagtagcaagaatattacagagttctcatatgccccacacccagtttcccctattgttaacattaaggcacatttgtcacaaataataaaacaatattgatgcattattattaatgaaagtccaacctttatttggattgttttaggtttctttaagccccttaaaatagaaaaatgtttcatatggggaaaatgtaatgttcacattgtagctatatagttggaactctaatacatgagtgaaaatggtttaagctaactcttttcttgaacatatgcttactggactgacaatctcttgaggactttccacctgtaataccttaggcctcttctgttctctggtttgtttcccttgagaccgttagcagattgctcagcctgacccaccctggtgccagatgttggaaccctcttgctgctgccaatctgactagtcattccaaacagatggtaatatccagcatcacaccccctcccacaatttcacagttttaggcagaagccttagagtgaacacatttacctggctgttgaattgctgaaactctgttcttaaagttgcttcataccacagtgacttgtgagagctttgacattaatagaaggtccaaaagaagacctgagtgacgttcccccaaatcttgagatctaaagactttggccagtttaaaaacactacaatttatggaaaatacctgttagtaacaaatagagaaattataaaggagattgctttttagaaatcaccccaatgaccgtattccacatcccgagcttccaagctttctttgaaatacgagttaccagcagacactagtggaaagaatctttttaattcaatctctgcctttgagcaacttgctgactgacatctagaggcatctcagtcttctggggtggcaccttatggtggaaaggctggactagatgtggtctctcttagttttaaatctgcttggattggggctttataacgttccctcagaagtcttgttggtgtcctttctaccagatttctttttctactgtttcactttcattaacaaattgcttcacaggggacaaaattctagatgtagttcaaatactagttacaaatttgctgccttcaagatacctagttatttgattgatcacagttgtttttaaagttcattttaagtagagttatgatcaaacatgtgcaactgaatcaataaagttgaaaatatatcacgatgaggaaatgtaggtatcttctttggtatcttcatatcaaaaaattaattgagaggaacccttactaatgagtgaaactaatattcttgactcagagaacttcctcaaagcctcaaaataacaacaatttgaattggtcatctaagtataaataaagttgggaagagacacctttcatgaaaggaatggttgaactaactctcaaataggaagacatcaaagtcaaggaagaaagtaagagctcacggcttggggtggaaatggttactaagtttagccatctgctttggtctttcctgttccacatgtagctatatagtttacataaaagtatctctccagaggatcagaaagaacagatttatggaaccagatgtgagttagcatttctacaggtgtggctctgcagctgaaagaacatgttgtaccagggatgaagtttcttattatgtaatcaatataaattaccactagacttttacagaggttgataaagcaaacacgtgtcattcggattggccttctggtatataaagagaccctgcttcacaacgtgaaaaaatgtaccgtttgacattcataaaagacttggtagaaaataccatgacaataatcaggcaaggttgttcccccttgcacacagaggggatagctggtggctagatggaaattgtgttcatatgtttttcttcatcaagaaaaacaaggaaattttcataaatatttttaaagtctctcagaatctgataagaaagggccaagaggatgaaaatgagaggactggggaaaaataacagaatgcaagagaaaagatgaaaaaaggcagaattagttaacctatagaggaatatatccttaggtggtatagaaaatcagggttataaaaaaagattggtaaattgcagatcatttaaacatttgcacacaaaaagagaattttaaaattctagacaataaaagtaaaaatgttgctgataaattaatttgtgtcaaagtatttaatacaaatgttttgattttttaaagctgagtgttttatgctagattttacaatgaaacaaaaagaaaaacttctatttttgggcttctaatttgcttaaactttttcaatttagtttaaatgtattgctcaaatctctgatattcttactaattaaaatttttttcttaatcaattcatttctcagacaactgtgccaatctcccataatgattgtggatctatgacagtcttcttataaaatttctccttataaaatttgccataattactgttcatgtttctaactatgttgcttaatacacataagtttatgatttttacatcttaaagcatattttgtctgctattaatattgctacatgtttcttttgttatttacttattacataaatttaaaaccttttatttttaatatttctgtctaattatcttaaagtgggtctcattaatagcatatagataaatttcaaaatctagtcacagagatttctatcatttaatgtatgagataaatccattatatttgttattatggattatgtacaggatgtctgaaaatctgaaaacagggcaaacttaatttaaacaatatattagtcacattttaaaaatacttgcttaatatgttttcttcaagtttcagacaacatttcaagtaaagtatctttaaatttaaagcaatgtccaattttttaaccctaaaaagtataatgaatacactattttctgaatttccagaatttttagaccctatgtaatgtatttattgtacaaaacataggagcatattatttgaaatgtatctaacctacagtataagtgcctaccctatattttctgatttttttggactcaaggtaatttagtcttatttttaacatcatattttgtatttcttctttcccatgtgtattcttcacgtctttattttctcccttcctagtgttttattatgtttattgattcccttttagtctttactgttttggttatatacatccctattctagagaatatttctattaacatttaatatgcatatattacaaagtataaactttattttccctcaaaactatccgtgttcatcctataagctattattgtttaataatctgtttcgtttttaaaccttgacaaattcatttttttttaaaacagccaattgttacaataatctaccaatatattttgttgatttctttgctcacccttgcttctagcatctcactccctatttctgggttcaaattcctatttgctgaacttattctttagtagttcctttagagagtgactttgggttgtaagctcttagactttgtaaaaatacactttttgcttttacttttaatttagacctcactcttggatattcgtttagctgagtatagaatatttttgcttggtacattgaagaaatcacattttcttctctctctctctctctcttttttgaaacagggtctcactctgtcacccaggctccagtgccgtagcacagccacggctcactgcagccttgacctctggggtcaggggattctcccaccttagcctcccgtgtagctgggactacaggcactcaccactacgcctgctaaattcgtgtatttttttaaaagatgctattttgccatgatggccaggctggtctcaaactcctgggtttaagccatcctcccatctcagcctcccaaagtgctgggattacaggtatgagccaccacacccagtcaagatattattacattttcttctcacatctatttaggagaggttggctgtcagtcttgctgtcctgtcttctgccaatataattcatgttttctctctggtcacttttgtaactgaagtaaaaaagcaaaatttccacacagagaaatattcagattttaagtgtaatatatatgtgtatgtatgtgtgtagtatatatatatatatgtatgtctatatataaggtataagtttgccatatatatgtcaacatatatgtgtgtgtgtgtatgtcatatatatatacatctgtctatatatgtcaatttccattaccacattgcctaccttacacatctactgttctgatttctatcaccatagatcacatgtgtctattcttggaattcatataaatggaatcaaatagtatatattttttatctggtctgttttgtgcaacataatgtttttatgattcatccatgttgttgcatgtataagtagttcattttttaaacttaataatatttcatagaattaatatacataacttgttttccattgtcctattaatggtcatttgaatcgttcccagtttgggatattatgaataaagatacaagagatgcttctcaacttatgatggggttatatcctgataaagctattgtaagttgaaaatattttaagttgaaaatgcatttaatacacctaacctactgaaacatcacagcttatcctagcttaccttaaatgtgctcagagcacagttgggctaaattatctaacacaaagcctattttataataaaatgttgaatcttatgtactgcatatcactagccagagaaaagatcaaaatctgaaatttgaagtacactgaaattgcaacagttccatactgttgtaaagtcaaatcttcgtaagtcaaggaccatctgtgtaagattcaagtacctttttccgtgtttgtgtgtgtaaacacaagtttttatttcttttggctaaaactgagaagtggaattgctgagtctaatgtacatgtttgtctttacaagaaattgccaaactgttcactgcggtgatgctgtttttaacacttacaagcaataaattagcattccagtggctccctatctttaacaacatttggagtagtcagtctttctaatttaaacaattctagtagttgtttagtggtatctcattgtggtcttattttgcatttgtctaatgacaaatgatattcggcatattttttgttcttattgaacatatgtatatcttctatgaaggatttattcacgtttcttgcccaatctttaaattaaactgtttattattattttgtaggagctcattatactttctggatacaagtcagatatatgtattatattaatacatattttctcccagtcagtggctcaccttttcatttccttgatgctgtattttgataaacaaaagttttatattttaatgaaatcccatttatcattctttaaaattttatggctagttctttttcttttctctttaagaaatatttgcatactctatctaggttgcaaggatcttctatttaaaaaaaacttttagtttttgtttttatgtttagatctgtggtccatgtagaatgagtatttgtgtatggtgtcagatagcagttgagtttcatttttcccattcatttatccaattgttccagaacaatctgtcaaaaaaccttgtctttatgaattgtattgactccttgttgaaaatcattcatctcctgcataggtgtgggtctaatttttttttttttttttgagacagtctcactgtgtcacccaggctggagtgcagtggcacaatctcggctcgctgcaaccttcgcctcctgggtttaagcgattctcctgcctcagcctcctgaatagctgggattacaggtgcaggccaccacacctggctaatttttgtatttttagtagagacagggttttgccatgttgaccaggctggtctcaaactcctgacctcaggtgatccacccgcctcggcctcccaaagtgttgggattacaggcgtgagccaccacacccagccaggcatggttctatttctatagcttcttttctgttctatagattcatttgtcttttcttgcaaataccaaactgtcttgattactgtggcttcattaatgttagacattgcttgttacctttctactgttggagataaggatttagtacattcatacaatctccccgttcaatacggcatcttccccatactttcaatattataataattgtatgaatacttcatagcttaccacatagtatactatgattacattttctttctatattaccactttccttgctactatcccccatgatttaataatgacttcgtttcttttacctgtttgttttctatcattaatgcctgccccagggtatctgacaggaatgtcaaaccctttttaatacagtcaaacacatcaggtaatttgtcaattatttttctttaaagagacttttctggaaacttcttggcattttctaggtttggtgcacagcttgctgttctaaatcttcacttcacagtcatctgaggcatttccttcctaggactgaaaggaatttcctttgtatgtgggctgaaatttgaatcctccatttcctggttcccattattcctccttctttatactcttgttttgatgaagaagattatctaagagcatcttgaacaagcgtccagggacgacaacatttcttaaaacttaattgtttttagtatctttgatttaagacatacttgattaatttattggctgggcatagaattctaggctggaaatcatttttcctaaaacttccccaaacatacctgcactgtaacctcccaacagggtctccttgcccgcttcctagacagagctgatttgtcaagatggggaattgcaatagagaaagagtaattcattcaaaaccggctgtaggggagatcaaagttttattactgctaaaatcagtctttctgataactcaggatgggaatttttaagggtaatttggtgggtagggggccagtgagttgggagtgctgattggtcgggtcggagatgaaatcatagaagtagaagctgtcctcttgagcttagtcagctcctgggtgggggccacaagcccagatgagacagtttgtggatttttattcattctgaatactatgggcctgttcaatccagaaaaacacatcttatagttagaaattttcttatataattttggtgataatttccttctcctcatttcccatgttctgatacacacagtctcctctgtcactgaattattgagagcttgaacctcctaaaccaactctctgattttgtattttcttaactatattctacttttctgtatcttattctaatttttgagagtttccttaactttggctatatattgtttttagccatagtatttttaatttctaagggttctttgttgttgttgttgttgaacatttctttttataacatcctgatcctctttcatagatacagtagttctctatgcccctggaaatatcatttatattttcagtgcctttctgcccctgccttatctgagttttctctgtgttcctgttttctattatttgtgctagtctctgtctttcattcttccctcagaatcctggtgatccttggctgtctgtccatatataggagcaaggcagtaaaaagctgattaaaagctatgggttcaggagtgctggctggcagaaaatgggccagttattttcttcccatggcaatctccaaatacccatatctctagatcctttttcttgaacaagtttatccaaagattttctttttgctctgttacccaggctggagtgtggtggtgtgatctcggctcactgcaacctctgcctcttgggttcaagtgattctcctgcctcagcctcccgagtagctgggactatagacacgtgccaccacacccggccaatttttgtatttttagtagagatagggtttccccatgttggccaggctggccttgaactcatgacctcaagtaatccaccctccttggcctcccaaagtgctgggattacaggtgtaagccaccacacccggccccaaagaagattttccaaaactcttcctctgagttgtaagcaaagggtcaacattctgagaagtcttagggcattacctgcattgcagagccatccccatggcatagtttccccatttgcctttggtaggccctgtcagtttcactggttctaggccatgtttcacatcagtgtcttggctggaattcctaagcagatagttcatatttgcttcccattccctcccacaaaaaggggtttttctccccccagcccacggtttagcttcctcattagtaggctgtcatgggtagagggtttccatttgtgttcgtagatgaaatgccacctttctagcttgtggctttacacaggcgctcagttccagttttctgccgtgttaccaatgaatgctatcatacccttaactcaggccaacttctctgtctttgagtttcctctgtattctggaacctggagatgttcttctcttgcttacaagctcatttaagtgttgtttgtaaatgttttgcttattttttctgcaacatttatgcatttgaagcagagtagaaatgcttcttggatctgcttagtccatattgaccaaaagtctaaagttattgattcagaattctggactctgagagcaatcagtaaattatagtgcctcggtttgcttgtgtgtatattatcaatccttcgccaacaatttttttctgttaaaaaaattcctgttagaatttttataatacttatttttctatatctgtccattagtgtaacatggtggtcaaaggagaatttttttctggtagtttttcctgtcacaacatggctcccaaagagtagatctagtaaatgaaacagattgccttggactatcttaataaccattgccatcatttttcccccaaatttcacctatttattcattcagattgcattattaattgaggaaaattaaattatctagtggagatttagctttgaaggtaatttcagacatgacagctgtggtcggaggaagattctcagtttgtatgcaagtggagaagcatcatcatgggcagaggacttagcccctggtcctaatttctatttttccatgctcaaccttttaaatagaaatgagtcttgtaatgggaaaaatggaaatattgctccttgaggatttgaagaatatgagacctgaagacctcagattttatatctattaaaacattggcacaaccatgcaacattctttccatgataccatgactggtttattgaggagtctcaactcactgggggtataaagaagaaatgatttctatttttccctatcagtactgttctgtgtcaaacttccttttattactagctacagggggcctttaattacatctccgaccagtttctaaactcaagaaggataaattgctcctaccctcaccccactcccccaggctagagtctagtggcttagaattgtagggttctggctcttaaacagcttattttccttcattccagtgaataaccctggaatatgggggagcatgaagagggtggaggaagaagaggtctgtactagacttctcataataactggtgttatgaaatgacctaagccaatctgcctcttcacagttgtctggagtggagcgatctcagctcactgcaacctccgcctccctagttcaagcaattctcctgcctcagcctcctgagtagctgggattacaggtgcccgccaccatgcccagctaatttttgtacttttattagagacggggtttcaccatgttggccaggctggtcttgaactcctgacctcaggtgatccacctgcctcggcctcccaaagtgctgggattacaagcgtaagccaccgtgcccggccgattatctccaatttttagatgtaggcaccatttcctcccagataacctcaataccaggtgatatgttacaatggaaacaagtctcagagactaaattctgccacacatgaaacaaataggcataaaaacaattacaaagcctgttccatacatttggtaaagtccccattccatctttttttttttttttgagacagggtcttactttgtcgcccaggcttgagtacagtggtgcaatcatgtttcactgcagctccaaactcctgggctcaagcaatcctcccacctcagcttcccgagtagctggggccttgggcatgtgctatcatgctgggctaatttttttttttaattactttttgtagagacaacgtctcactatgttgcccaggctggtcttgaactcctgggctcaagtgatcctcccaactcggcctgccaaagtgctgagattacaggcatgagccaccacctggcccccattctattttttaaagtgctctgacaagtgcttttgcactttaagcaaaagatccactccctggcaaaagttacaatattctaatggcagagccagctcatgttctagtcaggccagaaagtttcattaaatgggcacaggcctgaatagaatcctagatctatggcacgcctctgaatgctggatttgtcagatttcttaatccctgtacacacaaggatggagatgcctgaataagtctttctatccaatccaatcacatatattgaacacccactcatttgcctggtgaagcattatttctctgtcctttatgccaatttgcagaccttcaggatttagagaatgatattgaaaacatcaatcttaggctttctggagtgtgtactcctgactagagtccttcatatgctaacagttcctagggtgcagattagaattaatttacatatattgtctgcactgaagtattttaaaacaaattttcaacagtataacattggtgacaatgctgagccaactcttaggtgatgaggggctcattgccaagggataaaaaagtagttgaatattttaggatgaaaataaactaatgttaagaaaatagtacaaccaggggagagactatctcatagaatatctatatttactaaggaaagaatatgaaggctagaatccatgaggattttatattcctcccagcaccctacttttaagctgaaattaccagtaaaagttcatgagagacactgtagtacaataccggggacacaggtagtatacgtactacaatcctgcttatgggctcttgctaatgaatcatggttttaaattcttttaaatttttatggttttaaaattctttttaatgtagtattttgggcagctgaagctgacgggtcagaactgatgcataagagagaacttcattgtaatacaaaagtcactgggtctgtcctagctgtgagaacttagataaaatattgaatcctttgcgcttccatttcctcatccattaaaagataggggtgaggggtgggagttataagaactaaatgaaataatataaataatttagccactgcctgttgaggctggataaatatcagttccctcctcttgtagccacaaagttttaactaagctgatatgtttgttacattctgctcatgtcttttccaggagaactccatctagaacaaaatgtgcattcagcaaggtataattgtgtatgtttttattgtcagttttagtcatatctgtcattttttattttccaacatgaaaagagaggtttagggtagtcacattggaaaacaaagaaaataagattaaaattccctcaaatcaactttggagccctaaaatattaatgccttgacggcttactcacaatcacaaaaggctgtgagccaacattcagctttgtattgcagaggtgatgagaacatattttcattgctagaaaaaaaattaagctatacagacagaaatgggacatgggagccaaattccacaagaacaccctcgagtttaagggtttttcccccatcttttgacaatatttagaaaaccaaagactataaacttttaaaaggaatcttggatgacttacagaaatagtaaggtcaccaaaacactttgtagatattgaatttttataaaagtatttaagttgattaatattattctcagaggtagcataaacttaaggatcataaatgcttactaaaagtgaacatattgggactagttgccaactgctgcctaatcaacccaactggtccaatcctgcattttcagtgaattgacttaaatcctactcatatgaaataaatcagtggtcggagatagcaaatctgccaataggttactctcagctgtcttaattagtgtttcctacatttttccagtttctggtacacctttgaactgccagattacacctggcagattacagctgatggaggatctatttgccctttatttagttatatcataattcatgtataagaatatgtattatgagctcactattagtagggtacatgcatgctgtttttcaaagagtcaatatcctcctgcctagcaccctgggacaagagtgtcccctgtgtgatggctccctggggagagagctacaacaaccattgaactggccatcagaggatcaaaccattgactttatctttagggtttctcccatgatagctgaagatcttctctttctctgcacccacatgagtgtgggccaatttttgaaacggcagcagtttcataaaacccaaagtttacctgtgaggcctgctcaagccttcattctgtgctcagcctttgcattctcagtctgagaatgcctcccatcctcttttagctgacgatgcagcagctaggtgtgtgggagttagcctcttggcaactcctgggccatggaggaatggccaaccacccaagttgcctacagattttcccaagcacatgtctatcaacatgtgctgtcagccaggcaaattgtttcattggtcttggatgcttttccattcactctgtactgattgaaaattaatccataattcaaggttcagctcatatacctccaccacttccttattgccccagtgagaataaatggttctccttttgggttgccacagcacaaacctccgtgtattatatctgaccaatagggtttactactctcatctccctacttcattaaaaggcaagaacaatttttattgatccttgtatatcctgccctcaattctagtgccgaacacagcatcaaacacaaagcagaggctcaacaaatgctgaatcgaactgaattcaattaattgaagaaagggttgtttactgacactgtactaacacttctaatattatcctgcctcactagggagtcttcactgggggcaggggtctggagtacaatcagaatcaactggacagttttccaaactatacaggctaatggtagtggactgtgttaaaaagctattcaggatactccgaaattatccctgctcacatctcaccaatccttatgctagttgaggaccttcaaagaaccctccctgtccaaaatacatcattcagaatcttctgtttagctctcttcattttagtgaaagtctcctaaaactagtcctggatgtgttttcatcacacttgaagtttaattaactgataactcaggcacaatggaaatacttagatagatgctcttaaattacatttaaacaaaactatttacaagcgatctagtaaaaatctgtgtctttaatgggctatttttaatgtttcctaaacaaattattgtaggtgggccaattttccctctttacttgttacttagaagcccatttggacatgttctaccccgatctggttctctcaccccactggctacagaatagtgtgtttttgtttgaaagggtcaaaacattaagaatgtgacatccaaaatatgtgctatttttttttcctggagtcaaaacccctaaagtataaatcgtttttaaatgaagaaagcagtgccaaaaggaatgaaacatatttggtccttctccaaaacagagagatagcactgaaacaggaagtggatgatttaaatatccactcggcatcttggcaacatatttatgtttaagggacttaaggttaaaaggtttttgtctggcctgggaacactctatcttccctagggtttggaggtttggggaaaacttttaacaacttatcaaatatttgcaattagccattttttggagaacaaattgttactgagaatgtcataggaaatgttccctatatgctgcatgctaccattactctcctgcttcttatgataatctctttagccacctagcttcatgtggtagaaagttattgttttattttctataaagaaagaagaatgtggttcgagttcttgtaactacttctcccaaagttggaactacacagaatgactgaataagcagaatgcaaaattggggtttaattgattttgtgtgtgctgtttccaaggaccacttagtggccccattcttatagctagaaatcgacaatatcgggagtgtttacacaaggaagtaggccttctcctacttcccacccttcagagatgagagactgctattatccatttaccagcacaccactggaaagaatagtttaaaaaaaaaaaaaaatgagctcaaggtttttggtctaaaagactggaataatggtgttttcatttaccaaacttaggaagaacatacaaggaggaactatgggagtgcaagtcagtagttcagctttgaacattttatatttgtcacaacaattaggcatttgattggaattgttaaataagcagttggatatacaagtctggggttcagggaagaggtcctgaatatatttttttgggagtcaggcatttgcatggtatttaatgccaagagacaagacgagaccaagccagtgagttattagatagaggagctcagtcccaggataatttttagggtcttccaacatttaaaggtcagagtaaagaccagcaaaggagactgagaagagtggccaatggggcagaaagagaaccaggagggtgagatgtgctagaagccaaatgaagaaaggacttccaaaagaaggaagtgatcaactgtgtcaaacgctcatgtattaattaagatgagaattgagaattgatcattggctttggcaatgtagaaatattgatgatcttgaaaagcatcaaggatggtagagaaaaagcctgattggcatgggttcaacagaagatgggaggaaaagaactcggagcagtgaatagagacaacattttcagaattttttttgaaagaggggcagaggattggaataggagctggagagttgtatgggtttaatgaagatttctttttttcttttagcttaagactagatatattttgacatgcttgtatgatgatgagaataatctagtagaaagagatcattgatgatgcataagagaggtgacaattgctagagcaatgtccttgggtagataagagagcatgaaacctagagctaagtagggttgaccttcaataggagcatggacaaatcaggcatcgttgcaggagtaaagacaaactatccagattcagctgtaagtatattggaaaatatgatggtagaagcctgtgatgctcttatctgattgcctctattttctcagttcaataaggaagcaaattcttcaactaagactaggttagggaagcaggaggtttggagacttcaaggcaacagaggatgtttggacttgggaaacagcagacttgccaggtagcactaaggacccagttgacattactggtaacaaattttaagtaaaagcacttagcttagctgcgtgttttcctccagctggatttagcttcctgtctgcttgctacatggagagcagtgtttagagtgatgaatcaggggatgtcagctggtaaaggacggtgggtggctgaggcatgtgggaacacaagatcattggaggacagaagcccaaggaactaagaggccagggtattagaatgatcacagacatgaatgttgaaatcgctgagaattatggcagaagtagcattggaaagagttaaaaccaggagctaacatctagaaatgaagggaagtaatgcagggatcaggaaatgactgcaacaaggaggggtagaggataatattttcaggaaggaatatagctgtggagcaaggagacaattgcgtctacttccaggctctgtgatacaaagggtatggaagctgtcggaagagctataaatcacgagaggaagtatagagcatgaagttgcagggaacattcaaagaagagtttgagatacagggtcttggctaatgacttatctggagttccagagaaatcagaaaggggaaagacattgggtcagagcaggagatgcatagagccagttggctgtgggagtaggggttccacaaggagctggaagtcctgggggtcttgcagaatgtaaggcatcatgcagtcagtcccagtggtctctcatgaagagtgtagtggtgagactgggactgctgtggagggatttccttccaagaacacacagaattctggggctccctttccctttctactgaggttgattggaggcttgggaaggagttggttactaagagcacacaaagccctggggaccaccttcattcctctaaccctacggaagatgctatttattccataccttgtttaatgcttcagtgcagctggtccacaagtgtttgctgtatccagaagaaggtcagataaagagtgaaggcacacccctgttggaaaagaagcaacagtctctctatgattgttgattcactgtttgcctgttgactcctggaattaacactcaacagagtcaagaaacctgggtattggtcttgactgagtgtccttggataaatgcctcccccagtttgaatttgaatttcttctctgtaaaataagggagctggatcacgtgacatctaggttcctttcaagccctgaatctgagtctttaactgtggcttcctagattttgggattggcctacattggcccctgcttcctaccctttattctcagttttgccgtggtctagcttttcatttcttatgtcaggagcatgggccagccacagtacttttgactaggttgcttgctgtcccttaggtgactgtgtcctcatcatgtccggacaagtgatgccaaggattgctgcaactctagctggcctttggggatgaagtgggttagaacccaacacacactaatatggttggaatttaggctgtgcatattgtctgagaagcaactatcaaattgcttgtatgtctgtgacacaaagaacaagaagagatgaaaggagaacatatactccatgttgtctctccggctggtcctcaagttgtagaatttctgcctcttttttccccagtgctagtgggacttcccagtcccagtgcctcctggagaagtttcccgtcattgttcttggataaggaaaactctgcttggggttttggtacatgtcactcttgctttgtgaatatttactaaacatggttttggctgtatagctctgatgcactgtaatgatatcattcacctatctgaagtctcactgtttagaggggtgaccctctaaaccatttctcatgttttttaaggttgaaggaatgtttagctgagcctatgaggtcctataccaaaattttacctatcttctggaagctagcaaggcctaggatttttactaaactgaaaaattcaatgaattagtggaactgagaaatttggtgtttagagaaaatgaaaatatagacagaatacttaccaccatttacaaatatacaatattctcaaaagaaccaattatcaaataaaacattttaagatatctatcctttgaaaaacaaagcctattaattttttaaaaactatcctcgaactggcatatatcccctttgtaaaatatcaattccttaagaatctttctttcaaaatagcaattgtgataaccagggtcattcacttgtgaacttgtcttgtctcctcttaactagatccagaacatttgttttgctcagtgctatcctgctttcactcagcctatctaaagttttactaatttagttcagttgtataacttccctccaggagtagtcatctccagctttaaaattttatttttctggaatcatgcaagagtttgttatgcacaaatatggactataggctttaaaaaagctaaattttatgtcaaattggaatttatctcagtgtctgattatataatgtgatgttgcaaatcaatagatgtgtccctagcactgcatcaagtaaggatgaggaacacaggggccatgtcaatccaagagcttcacagtttgtccattggcagccatttattgaaggaaattgctagattcttggattttccacttattaattttcacatgctggaaaaggtgcgaatttgactagttccatttagtctgcaatttaaaagctaccccaaaatatttgaaagagcttatgacatcattcttagatcatgtgtacatgctcagaaaccaaacctattcctgaatagcccctttctcttcagccaatttaagcaatcagtagactgttttgtatatgcaacattaactcatttggaagatttatgcttatgctgttgctctgactgagctggtcagaggattttagaagtttccaggcgaatgggtaaaatgtagggagtaagcacactttgaagtgaactgtgccatcataggatcaatgtattcaaatagacactggagaagacatttccactgtttcccatactagttacatttcattgacaatcccatggcttcaataggtgagactctactgtgtcagaaggtagaacaatgagcttcagtcttcttgaacttctcttgtgaaacctgtttccttcctggctttattaaaaaattatgtcttctgtttttggaaaagtagctgtcagaggattagagacaattcattgaattggattacttgttgtcacaaatattataatagtattgtagagcacagaccaacggagagctgttcccatttgctaggatgttgttactgcttcggttttatttttatttaaattttttatctctgctattctcctttatggtcaaaattgtaaagagtgcatctttggaggaatgcaaggtaggcaagcttgctaagagcttctacaagactaccttaaaagaagacttatatttaacaaacagaatctcaacatatggacatagaccctcttgagctggttagaaaggacttttttctttatttgctctttttgaccactgacatttattttaatttttttcatttttaaacatttttattttgaaataaagtaaaagattaacaggaagttacaaaatagtatagaaaggtcccaggtacccagttttccccagtagtaacatcttgcataactacagtgcaataccaaaacccaagaaattgacattcgtgtgattcacaacgttattcaggtaagaaggtctttttaaaacaagaaataattcattacaaccacggggttcctctaaaaactgtccctttaactgaagaacacctgattgtttgttgtttattcagtacttctccacattttgcagaggcacacaaaatcatttttataaatcccaacctatgaaggacagaacaaagtcattgttctatttttcaaagtatacaaaagctaaacgagaaaaaaatcatctgggaaggcagaaatccattggtgcaaagtttttagaaagctaagtgaagtagtaattatcttactcattccattattgaagacctcttcaaaattttattcatttacaataaaatttcaataaattcaattccattctattacaataaaatttccccatatatttctaaaaagtcacagttttgtggcaacaagatttagaattttcaaacaatactttttgtcacacttgccgtcagcccattttgttataacctcatctgtaataaacccaaaagagtttactctttttctttatttcttggttaactgtttttgagttttatatgcacagatagcattccttgaagaaagaggcaaggtatacatacacacagttgggttgctattttttttcttacaatgtatttatactgttgtcaatttaaagaccaaaatattctcaggaaaatacaatattttactttttaagcttcatattctatgagtaataaatttagttttgagggataagatagcaaaccataaatatggaagcactctcttaaggtcaacattaaatctgataatatgtagaatagatttaagactatttcgaagtttcaactagagtttcacccagtgtgctttcttcttaggttttaatgctggtttacaaaaggaaaagtaaattgctttctggtaacaaattattgcagaagatcttctacttaaagcatagatgcatttttatttttcatttacttctctgtttttgaagggttcagtgtttatttggcggaggtttatgtcaattatttaatcagaagcaggccccagagtttgccagtgatattttggaatgtagggtctacttcaaagaaaggttccatgtctcttgacccagatgaagccaatttttcatagtgaagagcaaggtaattcgattttctttttcagagcaaaaattatttttagactgaatttgatgggtcatatttctctgctcagtaaatcttgcaattatcactccacactggaaaatgtaactcaatgacccaccattgcgccagagcttctgtgggcagccgagctccgagaggcagctggacatgatgtgaagttggtgtctatgacatactgcaagatggaaaccaagcagtcaaccagtggcagtagttcacatgccaacatttttgtttatttgtaatggaaaactttaggaggaaaacacaggagactgggtgccatgggtgtgaggtagagatttcaatcctgttcagtcacaggaaaatccaaattggccacgctaaaccagatccaaaatcccagactaatttcctctcctctttcctctgcgagtgtttctgatttcacacaaggcaagagcaactgagaacagggagcctgactagatgaagtaagaaccgtcgtgaggcccaggagcaagaaaaaaaggcctggagttgtagaacatgctagaacatgaatgacagtctctgcggaattaagaagcattctccactctattccatggcctcttgctgacctaactcctagtcttccttcacatctcaccttaggataccacttcctaaggaaagcttaacagactcaagtttgacttattacctttctctgtgccctgacaattcctgataccctctccagagcagggttatcacaccacattgtaatatttaatattgacatccctactggactgcaagcctaatagaacttgggccataccgctcaagtttacaattgcatgctttttgcttagcactgtgtctagcacacaggaaatgcttaatatgtatgcgttgtttatgttatccatgccttaatgtttgggatgctccagatggcttaataaagtgtttaactatctttacaacctcaacccagtccaatgtattgaaatcatctctaccaagctttgggaaattcaatcagcatctaagaagcccttgtaaaaaacattttagtacccaatgatgactatacgtaaaccctctagctcctgagccagatgtgatggcacgtgcctgtggtcccagctacttgggaggctgaggcaggaggaatgcttgagcccagaagttcaaagctgtagtgagctatgattgtgccactgcactccatcctaggcaacatagtgacaatcccatctcaaaaacaaaacaaacaaacaaacaaacaaaaccctggttttaagaaaacaatgaagatagccatgaaaatacacactggcctataaatgtatatgctaaaagagaatggaaactgaaataatggatctaatgaaaatcaggcatggttttgaaattttgttaatgtgcttcttttttcacccttctattcactttagttggattttcatggaaattcagatctaagagagaattttgagttcatgtctacacagatggtaaccagaaacttctaagacatattctcagtgtaattttcagcccataatgatgagggtggtctgtctacattgtaagaagattaaactgacagatctatgatcttgtacgtatagatggacaatgacctaaaagctatgcttaaaattgcccctggagacattttactcctgaatctgttggtttccatggtaaaatattcagttgtatgttgtcaaaaaggtgaaaaataaaatctaggagaaatctgtcatgggtagaagttggtggaacacatttaatccaccagataaaatgcttccggtctaaaagctgctgaaagatacttgaaagtctagatgttgggtgatcttatccagacagcattataagatatacaaaatatttgaagtaacgtcatattacaaggagaaaaatcattttcactgttcctggaagaagtctttctgtctacactttacccactacaaatgttgagatgttctgaaggactaccttgcacctttagtaattaatatcatttaaaaattaatctcttttaaaatgagattttccataaatgctagatgcccaatttcaaaggaaaaatctatgtgatactctgacatattggtcaaatattttattctaggggacatggtgggtagcaaggggtggtcgtggactgtaggaagtgttgacttcaaaatatatattagcatttccatcattttaaaagattttttaaaagactaacaatataacatatggacaaagggatacattccttagaaaaattttaatggtaacatgaaaccacagtaaacagtgaaggagaggggaggagaaaaatgatgcaaactatttacttccccttagaggctagaatgcagttgttttctattaaacttagattacgtttatgcgtaactgactcaattataaaatgaaagctaagcaactgttggaatttgtgattacaccatgtaaatgttacataccttggcaatgtaaaataataatataattttttaaatagagaagaaagagactgtaagaaaaaaagtaagtgtacaaatttccctatgctttatagtagggattcagataatgtctagtgataatatctgtagttaaaacaacaacaagcccagtcttttagtttttttcataattttaacttttaaaaacccatatctcattgtaaagaaacatttatctttagttcatcaacttctatcattgaagctgtttctctttgttaaattattgtaagtaatatttctaaatattagactacatttataaaactatttctacctatccatctatttttataattttagagatatccagaattttgttcaccaaatgttaacaatttatttctgagtgctagatataggtgattttttttaatgttctttatacttttttgtgtttaactttttaaaagagtcaacgacattttttttttttttttgagacagagtctcgctccgtcacccaggctggagtgcaatggcacaatcttggctcactgcaacctctgcctcccaggttcaagtgattctcctgcctcagcctcctgagtagctgggattacaggtgcgcaccaccacacctggctaatttttgtatttttagtagagatggggtttcaccatgttggccaacctggtctccggttcctgaactcgtgatctgcccacctcggcctcccaaagtgctaggattacaggcgtgagccactgtgccccgccaagagtcaacaacattttaataaaagagatagatgtttatagagagagatagttgactctctctctcttcatttctatctatgatttccttttttctttcaaaggtttaacaattaattctttaaagcattcgttcaattgtggcacaccgacctctcttgttggccagaaacttataggggtaagtctcaataaaactattgagtctaaaatcacaaaacagctgacaactttgtggcacatcacccaattcttggagacagtgccaacccttggacaggtctatattatcttgggcacgagactgcttgctaagttaaggttatatattgaagagaaatcagacatttttatttctagaattttctgtttcatgagggactgctggctatcttttatttgggccaatgcctaggcccaaaagaggtttaccagatgtgtgagaaaatgttatttctgctttatttggtgaatgataatgagtaaatgggatgaagggaaactttctagaatttctagaatcatatcttgtctgaacaagatatgaattgatcagttcacttgtcaaacaagaaagacatttgtatctatctacaaattttattcttcagttgaattcagaatatagtgatttttcataagaaacgacaaaatttaataagttatgcatttgttaaaaaaatactaacttgtctaacataatcctggaatctcaaacatattctgtagttgttttctgagtgaatgctaacactcactgtaaataaggcattgatacttccttgtataaaaatattttaaatttctaaaacctctcatcttaccatctccttttcaaacttcctccccaaatcttcagacaacttattctacttcatttgaagagaattaagtatggttttcattcattgcatttttctattatatttctacactctatgttctatttggcgatatagttagttgcctctatctccctggctagatcatgtgttccttgaaagcagaaactatgctttaatttatccctgcctctccactgtaactagtttagtactttacatgtagaagctctgtactcaagtcaacaatgtggaattgccttaagatgaaattggtgaataggtctgtagaaaaatgacttctccgtgggtcaccctgcccaccccacctgtccctccacatgcccccttaaaatgcaaaattgctggaagcttggggaagatgtatgcctctatatgtacgtacatatcatctcaaaaggaaaatttctgtaattttcatctaaaagatgcctatgagaacaaagccaaacaagtagctaaggcccgaagcactgaatgggatgaataaaatatctcgatatttacatggttcattttgaccgtacccacagggcagcaaacatctgcgtgaaaagtaaagaattcagcctgttagatgactggttgtgaagagccaaacattgggtatcatgtcatccacatgtctggttgattgaatatgaattgccccctttttatccagatagcttcagcaatagataaagcatggagatttttccacattttacatggtgcttggtgttgtagaattcagcctttgtgtgttcttttccccccgtcttgctattgcctggatctcattaggaaccattagtgatgtaatactaaacctatggaatcttaaacatgcttttaaaatcctgtggaataaagatgtctcctaccaaaccaaaaatgcagtgggaatagacaaagttacatttcttcaagaaaaaatgactcatttcatagttcccaaactgttttgactgaagcttctcaaaataaactttctggaatatggagcctttgatgtctgactttgaaaaaaatatatcatttctcaaacatacaattcaatccttttggggtgttcatgtatttctgcagattaacttacttttatttcaacaagtgaatgacacaatattaaatagccatctgacaaagaaagaaaagtatgtttgaagtggtcttaactcctacataaaccaaatataaagaacatgccatatgattttttaaattgccacaaaaatagaattttcagaacattaccagaagggggatttggtccattaagaataacaaaacagtttagatgtcatgaaagtagaagattaggagtgccattaagcttactaatgagatttttgattcatatgctatttcctaggctaggcaacatttttaatttttcacagtcttgaactttaatccttgaagggtaattcaagtttcagaacttacatactgcaatttgtttggggtggcaatttgccattgatttgcctctgggttcttttgttctctttcagctgggggactcaaaggtggtcatttattaagtccaggtctacacatgaccgctgaaacaactggttttcaatcaaatcttctaaataatccaaccatttttgtgcagttgatcagattgatttaagatatcaattgctctattcaaacaacagtgaatgaaataattgtatgactggacaatctttacttttctttcctcctcctccttcttctccttcttctccttctccttcttcttcttcttcctcttcttctttaataagagtttctctttggagtggtggaaggattggttaagatctgcattctagcttcaactcttccacctctatctgatgcttgaaaagtttctcttaacctttcaagcctcatttttcttttctataaatggagagaacaaacactgaccttgtgctatgtttgggacattaaatagatactgtggcatttgatacacaattggcctacaataaatgtaattttttcccagttccccctcaattgtacatacggagttttctgctttttttcattttctattgtgatgataacttctcaacagaagggttaaaagaatatttgacacccattatattacgctgttaaagaatattagaactagagatatacgtcacttggtcagatctgagctccagggcctgatgtctctgatgatggcaagaagagactgttgttggaatttgtgttattctctgagactttaagaatactacctttccttcagaggcttttaaatatctattatgcagtaacatctctaaactactcttgaacctatgcacatttttatcatggtaccagcattgaaagtaatagattccaagtgtttaatacttataatggaaagaggtttttctattatttgacctaaaatgatcacttcaaagctttaagatttagataaagtggggagaaagggggataggaaaaggagcatgggaaaaggggtaaggtaattaacatttataagatgatggccaagtttattagaaaacagatggagtcatacatttgggtagacctgaacttcacttccagctctgtctcattccagggcagagttgttaagagaatgtaatgtacccgcattaaaataaatttgctttgttaactataaatttaagtttggatttcctctttccaagcatttatttttataagtgattagggtaatttaaggtctttaaattgctataaaatatctaagcattaaagaggggtgagaaaaattagcattttaaaattctctatataaggataattttatactctaacttttggatttatagatatcttatgtatattttcccagaaaaaatgtgaagatttcccttttggtgaagtcatttagagttcattgttggttggtataatctgcaaaattatattcaattatgcaattaatgtaaaatattacatcacataataacccaaggtcattttatacttacaataaaaaattgttttgacccttcctgtagattaacctcccaaatgatttattggtcattaatagctcaatttttagacccaggggtcagagctcagggcattgcaactgagggtagatccctgtacagactgaccagaggagccctgggtatgccggggagaaatacatgcacatttctcaatgtctcaggctatgttttccttcagtttcaccaacaccatcttaattcaggtttcaagaatctccaaacttacctacacactctagtttagccctttcaagtatcattccatcctgtaaactgattttaaatcttcccaaactactgtttatataaaaaaaacttagtctcaaaatctccccaaactactgtttactttaaaaattttaaattaaagaggggtgaacaaaactagcatttttaaattctctatataaggataattttattattctattgtctgctccaaagaataaagtacaaaactgatatccaaggacccggtcaacattcctgctttctcccaccctcccaggcaggcttttgaatgtactcacccacgagcacagctgcccatgaccacaactgatgtatttctgttctgctgatgttgctccttcgtcatgtttgaaatattctcacacctcctttctagttatccaaatcttaactctttaagtgccaatcatcttcctgaagcatctcctaagtactccagcccacctaatcaacacacaccggagcttttctagtccattcttcaactttttacagtttaggagacccaatttgcagagtttgtgacttgcctgaggtcacaaagcaagttagtagtgtcaccatgacttaaaattgaggtcttttaccacgaacactgttgcctgaattccctaaactatcatgataacagacattttactgataatattggttttgtattgttggttcattgttcctaagtatgaaacctggatatgcccaaattgttcctggattattctttcatttcagatccaaataaaataattggggcctccatctcaatatttctgagaatccccaagaaagagataaggtggtgggatgccttatatttttgtcacctcctgctccaaattccagtcacccatttacctcctcagtccaacctctacctgcttaactctgagcatggaaaagttctttttttcttcattcccacaaagctgctgcatttaacagactttgatgaatggtttatggtgatagaagggcattaaaatgcagcccacactggatcacagctcaaaattaaatattttaatttgagaaaaaaattaactctttagctctttgccttaattctctcccatgtgattttggagtggacagggccattcaacttttacaaccacaaagcaaggtcaggatatttatgtaaacaaaatacaatagttatctaccctgggcttatgcccttagtaactctaagaagcaatagaagttttgacattagtttttctttaacttggcccaggctgaaatcttaggcagatctccctatctcagtggaccaggacaatgtcaggagccaatgggtattcatttgctacattcttagttgggaaaatgaatccagcactattttccagaatgtagtaagattaggaagagagtaaaaacagaaaatgggcattttttgccatttgctgagctttttctccataccaggttctatactgttatacacgttaccccatttccctctcacaacaaccatgcaaggtaggcattctccacttttcaatggagcaaataaacaatttgccaaagtcatccagtaagaaagtggcacaatccagaattcaaacccagatctgcctgactttaaaagcctttctggacttggccagatgacaacggcaatggcccaggcacaggaaagagtgaggaccatatcacatcacatgatattccaaatttatcagagtgctgagagtcagaataaacagaaatgtcagtcaaaggtgttatttggggaaggtgatggagggtccacgatggactgaggttcagatagagatgacttttttcattcattcttctgtttaaagctaccggatttaacacaaactcaggaccgtctacagaatctgaattggatatccccaggtcacttagtttttataacccaacaagggcaacatattcaatagactatcaccaagagcctttctgagcagcttgtatttattcatcttgcctgtgactgggcaaagggggcaggtgtctggcttttgttactgcatagaaatacaactttggtttcgttgatgtgaacagataagcactgcatgtgaactgaaatcacactatgtctaaacagaggactctgtggcacttttcttactaaaaagttgttaagtttggcaatcctcactctgttccagtcaaacattttcttaaccatattaggttatatggaaataagccaatatcgcggctggtgtatgagtaggtcctctgcaccaaggcagttttcttgagagcattttctcactggtttaaaagcaatagagacaaatgtggctcagagtatatttttaaatgtggctggaaagaaaaataaaaattcactgatccaaaaagaattcggaatcgcagctagaccaaagtcagatttttaagctggaagacttggagagatttgggtatttgcttgcttcttattgaaagactcaatcaattttttaaaagcccagccaaccttaacacagatataggagaggaaatcagaacaaaactgcatcatctgttccataattgtccaatgttgttctcgttgcttaatctcgtgggttagaaacccagcatttgagctctggattcactacattctgagtaatcctagacactgggcttaatttcattgtttgtcaaatgggggatgatatactacctatatcataggattcttaggaaaatccaatgagataatgcatgattcaactattaccaaaaaagcatattataagccttctgtttttcaaactacaacacttggagaaaagtagcagcagagaaaatagcttttaggtctgcccctggttgctctgatacagttatctgcttttcatttagatttatcatattctgctttgacagctaataattattcatctatatattcattcttttattcagaatattgagcacttagcaagtgccaagctcttaattaggagctcttattctcatctttgcaaatagatgataaatctataaagctccccccccatcttatcattagatactcttttgaaatatttttatttcaagatacatgttggccattcattcattccatgtatatttattgagtgactactaaatggcaggcaactgcaaagtgctgaggaatcattagtaaacacaataaatacatcctcatggagatttcagtctagtagaaaagacagatattaaatacataagtaaccaaacataaatatcattgcaaattgtgattgtacatgaagacaaagagcagagacttacaacagagaatgacgtggaagtaacatcttaaaactctatgtctaatgcaacaaattttaatttacaataccttggcaataaatggataggatacgtgaaaacgttatcatctgattgtactgtaacacaaaaattggtgttttcagggtgttgcaattatttagtactattccaactttgactttgtgggtttaagaaaggttaagaattatccaagtaagaagtatgcctttgtcattaggtaatggtgagggactcatttctggtctctgtggccagtaagctctagatccatgcaagaaattgaaagcaagcttgtgtgactggatcacaaaagagagaggcacaagaggaagctggagaggcaggctgagctagattatacacgacattgtaggccatgggaagagttggatctgtattctagatgcactatgaagctactgaaatgttttaagcatgggagtgacatgattagatttatgtttttaaaagggtaattgtttgcagatggctggaagatagaacagaaagaccagttgggaggaagagtccagatgagatgatggtggcttggatttgagtgacagcaacaataatgaagataaatgaaccattttaggcaaatatcctgaagggagaatcacctggatttagtaatttactgtagagggagtaacggtagatgaggaaggaggaagtgtatgaaatgattcccaagtccggagcttaagcaaccaggtaaatattggtgtcatttgctaagatgggaaaaacttgggaaacaaggactgtgttcaattctgtcctgtttgctgaggaaaaaaaaaaggggccagggagtagtggtggaactttttgtgagttatagagaggaaacaaaagtataaagcttaacacccatcttcagaatgcttgcaccctaagcattaaatccactgttgatatttccttaacaggctttctcaaaccaccagaggctctactatgatgtgtgttatctcactcgtagaatttattctttcttcacccttcctctgtgtgtgtccaaatataatgcagttgattttaataatttaatttgctacacctttgaattatctcatttatcaaggcatcagtcaatcttaaaaattagatctttattttttttttaatttttaagctcagggctacatgtgcaggatgtgcaggtttgttacacaggtaaatgtgtgtcacgggggtttgttatacagattatttcatcacccaggtattaagcctagtacccattagttatttttcctaatcctctctcccctcccaccctcaaccctccaataggccccagtgtgtgttgttcccctctatgtgtccatgtgttctcatcatttaactcccacttataagtgagaacaagcagtatttagttttctgttcctgcgttagtttgctaaggataatggccaccaactccatccatgtccctgagaaggatatgatctcaaaccagatttttaaaggcaatatattttttttggtgcttctataatcttggcagtgaataatgacaatagaagtctttaccattttgtcttcctgttatttactgtaactcaactacaaatattccaacttctccagtggtgtatgtggaaacaagaagagttcacagaaagaaaattatgatcagtttgattcccctgagagccgctgatagagtactaagctctacattacttagcaatgcaaaaacaaagtggtagagatttagtgatcaagatttatgtacaagaatgtccatcacagcactacttataatagcccaaacctgaaatactctcagtgtccagtgataagggaatgattacatataactgtaaagttatcatgttttaaaaattgtgtaaaaaatatgtataatataataagtgaaaaaattgagtgcataacatcacatttgtttttaaaatagaatcttacctttgttgaaaaaaaagactggaaggaaatatattgaaactttaaagtaatctcagggtgggaaggatgaaaagagactttagaattattttctgcataatttctttctttttttttgagacggagtcttcctctgttgcccgggttggagtgcagtggcgcgatctcggctcactgcaacctccgcctcctaggttcaagaaattctctgcctcagcctcccgagtagctgggattacaggtgcccaccacaacgcctggctaatttttttgtatttttagtagagatggggtttcaccatcttggccaggctggtcttgaactcctgacctcgtgatctgcccacctcggcctcccaaagtgttgggattacaggcatgagccaccgcacccggtctctgcataatttctgtattttctataataaaatgcatatttgtatactttctataataaaatgtatatctatatagcactcagagatggcataacttctagagatttgatgatttttgttagtggaagagatccgagttatctgcgagttaccggcggcgaatctgtaggggtccacagcaacttcagtccttgcctcctcagaagaaagaattcaactgaggggcgtgtaaagcagaaaaagagatagaggcaagtttcagagcaagagtggaagtttattttaaaaggctttagaacaggaaagaaaggcgcgcttggaagacatccaagcaggcacgtgagtgttaaagagagaaggtcgagtgtcccgtataaccgtgatcctaggacttttataagcccgtcttttccccatgcgtcttccgtagggtgggcatgcgcacagcccttcttacgcttgagaaatgcgcacgcgcagtgtatttagggagttatacacatgcccatctgaggctttcttccttcttccagcagagagtacccaggagatcttacttcgtcatttttgtctcttaatatgcatttccagaaagctgtttctctctggggtctgcactcagttaacacttttaaatgttaacaggtatggaccatcaggagattgtctctttctggctgctgtgaattatcatttttagagaggcaaagggataattgccaaaccatcacctgacatttctagtgggtggtgggagagccctctcctgctccctgctcatgactgactacctgtaacaatttgggacctttttcagtagagtgaaatagaaataaaagcagtctggaaaaccagcaatgaataattgtcaagtgctgcctgagatactgtggggtataaagttgtgtgaaaatgtgattgcttattcatggatcttatgatcaagttcccacactcctggatttcccttgtttgggttcaaacagcctaagaacataataagggcagttttgattttcatatctgagtttttcttttaagccacatcgggaaatgaaggaacacagacagacagcgggagaaatacactcgcaaaacaacctaagtatctgtgcagcctcaatatcatttaaattctggctaagtttaaggtttttcctttttttggtttcttccttcactcttcaagtgtattccacataatgtagttgtagctctgctcaaggttctggagtagcatttctatgcaagcttagttattttaagttattcacagttatttgttttttaaccctttaaaagtaatttgtcacaatcacatctttatgtgccagatatataagaattattgtcttgtctctggacagtatgttttagaacttttccttatgaagctgcaagacgtgttttacacttatcagctctatttagcctataactgtgtctgcataatgccagaattgccatttcaacagagaccaagaattccccaacagttatttggtggcaactgccaaaaatttttattgaattaatttatctttttcacttaattcaatccacttagctatgaatgttgaacccagtgaaacttctggttttggggggatttttttggcatatgaatggaagcattgctgtgtttaaaaatactatcctttggagataaacattatgggatgttcaatatgaaatatcttattaatgtggaaatgggtttcattaacccatctgtatctgcacgttatccttcatctggttaaaattccacattttaaaaaagatagcagcttgggtttaagtttgtggccacgtaagactgaagtttgatactgtccacgttaccatcaaccagctaatgtattaccaataaaaacagcagtactattcttcagtgagattctcattgtccaccttgtgtcagttttcagtgtagccctgggaagaagggcactggagaatgatgtttccatcaagatttagaagtggaaaaaattgagcttctggagacctcacttatttattcacttaacacacatttattgagaaactgctatgtgatcagagctatgctagacactggggatacagaagtgaatatgacataaataatttaatatttatttgcccactagagtgttagccctctgagagcagtgaccttgtctttctccatctctgctgtctccttagcaactcccatttaataactggaaatagaatcccaagcggggcctaactttttgtctcatgagataggaatagtagaagagcaaatctcaaacttttcccccatatgaggaatgacattcacagaaaagacccacttagaggaagacaaataggcctttttcttccacggaagaaagatgcctagaatccagttgaatgaatatcaagtttatatggatagctttgaatccttcctaatattttaaaaagtaaatcacatgaaacctcacatttctgatgatacgtcagagtagcaacaatactgtgatcagaactccacatagaaagctgctgtggtgggccaccatacctgatggaagatctattttgatgttcaaatgctttgagattaggacggttgcttgaagtatttatcgcttgttacactttctctgctgtgtgattactgcaaagacaggccagattgcaagggccacaaaggatcagttcttgagataattatatgaaaactgtttagcccatgatggcagttagaaatcgagcagtggattcttccaatatccaaaaacagatgtagtgattgatttgtcctaaaataaaaaataaccagctcctgctaaatggacttagttgttaactaatcaaacacaggcagaatggtgttctacaaaaagaacagatttggagacccagctcctcccatcactagctgagaagccttgggtaaaccatttaacctctctaggcctttctaggtcttatttataaaatgttgccaataatacttgtcttactgacctccagggtttctatgaaaatcatttaagaatagagatatgcaagccctgtttactgtaaaagggccatgtatttgtattcttaacccatttgtgatgtcactaggcacttggaaatcagcccacaaatggctgatctgattgatgatagaagcataattgccctgtgaccaacccacttcatccctaccaaacattccagacatttcagtgcaggaacaaggtctatgggaaaaagtcaaaaggagactgatcagaggaattccactggcccttcccagggccctgtgcacaaaatggtcccctgtgcattgttattttgctgtgtttgccgatgtccacagcttcctagacattaacagatggatatctgggtgatgatgaacagacagagtgagtgtgatattttaccagttttctagtgcaaaggcctctgtatctaatctatgggcttgcagccttcactagttactctttcagctgaatgtgcaaagagataaagtactgcctgcctttctttaaaatgctgaggaatgacatctagtgaattttttcaaggctacacatactgatggttttgcttttggttgcaagggtaggacaaggtgattctagatcctgacctgagccctgtgtcctgctgctgcccagattctctctgtcagtgtttcatgcttggcaccgactgagctcaaggctctggattaggtcttactgcacagctctgtggcagagaggagaggtgggcaatgccagttggttggaacgtgggaaagaggaacaggataattccacttagggtgttattttgctttgttttttgcttgctttaagcaactggccataaaggaaatatatggccctgtccttaggtagttaaatttcaatcagtagtcaaaactaacattagaaaaagttttaagcatactttaaacaaacaagaacatattataaataggaacatgaaatgaatttattacatcaataaagtgtgcctaaatttttcagagttgacttaattgcacaatagataatccgatcgtgatgacgtgtagcctgaactagaatttattgacttgagacactctttctttgtgaatatcgaaaatttctaagtacaacctttattgatgagattgtcaaaaattgagagtctaatagcattaaagaggttcaatttggccaaactggacattattaagtttatcctatatgctggaggctgtgctaaattctacagataaaagataaatgaggctaggcgaggtggctcacacctgtaatcccagaaatttgggaggccgagtcaggcggatcacctgagttaggagttcgagaccagcctggccaacatggtgaaaccccgtctctactaaaaatacaaacattagctaggtgtggcggtgggtgcctgtaatcccagctactcaggaagctgaagcaggagaatcacttgaacctgggaggcagaggttgcagtgagctgagatcgcgtcactgcactccggcctggtgacagagtgagacttcatctcaaaaaaaaaaaaaaaaaaaaaaagataaatgatatgactcttacccttgctcagatgtccatcctgtttcctcagctttgcctcctcaaccatgagggttctaatcttcatagttgcttctgtttgataagttctatttatttaggaagccatacacaggaacacaggcagaagagaaccagaagactgcatccattggaaaatttaatatacataaaaattaagtgcaccatttcttatcacttgctgaaacttaggtaacttaacatcatgccttacaaacaacagtcagtgctcgttgataatgatgacagtggtagtggcagtggtgatgattacgatgatgaaggcaagagaaacaactgccactaccttttcacaaactttggactttttattatctacactaggtctttcgtgatgagtggtagttatacccagctcaaacttcaggtacactatgactctgtgaagagaaagatacatttttctcagtgtctctcatgcctgtagccacgggaaacttatcaaacactgacgtcagctactttcccatgagaagttcagaaatttcataagaccgcaaacgactttctctttcctatttgcttcagacaagtacagaacttttcatgaagcttaaaaataaacatctgaccttcatggatacattctcattgcttctccaatcagaaatcatcttgcctgtgaaaatccaccctcattcttctattaacaattgaaacatcttggatgatgcaaatagcatcgcagattactcttcattcaatgattgtccaagagaaaggagaaaaggctgcaatgattaggcaccattttaagataccaaagcccatcttttgtactatcatagaacaggataagatctgtttttttttttcataattttaccatattggcttctctgagaacatacatgtaagctatatcctttgcactccataaaattttaagaagaactcagcaaaatttccctgggtagcttgctagtcttgggacctgatggcttagaaataaactaagaattgagccattctactttctagatgcagaataacaaagaaggcagagaaagaagctgataatattaaacgagggtcaatggcatgctaagttcaatactaggtactttatatgttatctcaatcatcactcaacaacagacttttttctttcgttctcctttttttttttttcctgagatggaatcttgcactgtcgcccaagctggagtgcaatggcatgatctcggctcactgcaacctccatctcctgggttcatgcgattctcctgcctcagcctcctgagtagctggcatcacaggcgcacaccaccacactggctaatttttttaatttttatttttagtagagatgaggtttcactgtgctggccagactggtctcaaattcccgaccttgtgatctgcctgcctcggcctcccaaagtgctgggattacaggcgtgagccaatgcacccggccaacaacagacttttatgaagcatatgatatatgccagagaacatgctaaatgcttggtatggagtgattgataagaccatgcccttaccattgggaagcccatactcatgcaatgctaccatagaggcattaaccaagtacaatggaagaagaaaaaaacccttcagcgtagtaattactatcctcattttaaaattgaagtagctgatacctgttagttatctttgttaaagagcttctcttaggttattaagtgtagagttctatgtgacccatagtcagtcttacaattccatgctgttttaatgggaaagatctatgttcaatccaactgaatgatttaaagctttgtctgctatccaataaatctgtttgctacagaatgccacaaaaattctgactttcactgaataattgactttttctttaattataagaaaaatttccttaatttcccactttagcctgtttggtagctaaattcctaacatattatcatattaatacatcttgtccctcttatctactcatttatacaaatatctgtatacatttccatatgcataataattccttaataacacagaaaacatatcccataaaaatcaagagattctcatacagacataaacctatacactaaactacaagcatactatagatgaatttgttcaagatacatagggaaaatctgaaatggaaacatacaattttaaaaaataaagaggaaacattgttcaaggacttgatgcacaaaagagctacaagaaataatttggggaaggtgggtggttaaaagtgaggacaagaaacagtggatactaagcaaagggctggatggatggtgaaattgcatggcattcttaagatgataagtagtccctgtatttggattgccttggtatggaccacttgcaaaaacattcaatatttcacttctaagatatggtaagccaaaatacatatatggaaagttcactaagtcattggcaaataatccagtgttgacttttaatttagaaataactggccaaattgatcccagccttcccaactacaattctccccctgcagagtacattgatttgtattatcttattgttttctctcactgtttgtctttctttttattattttattttcctactggtacaatgtatgacaagagatagtgaactttcctgattttatatattttgagctcataaattccctggagttgtcatctttccagactaaagtttcatctttttctattcacatgttctaaaaataatctttttaatgatgtgtaacatatagagaagtgcacaatttataattgtacagagtgatggactttcacagaatgaacgcaactgagtagtcagcatccagatcacaaaacagaatactacttgcattcagaagcaccctaaatgtcccttcagagtcatgccttcccccacccagccactgcctcatgataaccattattctgatttctaacatgaagtattaattttgtctgggcttcggtttttatattaatgaaatcatatagtaatttttgttgtgttgtttacattatgattctgagattgattgcctgagcaaaacttagatcattctaattgctatatagggtttcattgtttgcctcccacaatttatccattttgctgttgatagacattgaggttatttccttttcatggctattattaatagtactgctatgaacattcaagttcatgtcttctggtgaatatatgcatggacttttgttgtatatatgcctgtaagtaagatttctgggtcacagggtatacaaatattcagctttagcacatgctgccaaatctttttcccaagtgattttgccaatttatattcccatagcagtgcatgagcatttcagttgctcaccaccattttgatttatgtcttttaaattttagctattctagtggtatgtagttttagttcatcataagtttcaatttgaatttttctaatgattaatgagattgagcactttttcatacacttgttgatctttttgtctttttgtttttgttttgagacaaggtctctctctgtccccaggctggagtgcagtgtcacgatcatggcttactgtggccttgacttccctggctcaagagatcctcccaccttagccccccatgtagctgagactacaggcatgcaccaccacacctggctgatttattttttagttgttggcaattttaaatatcctcttttgtgaaatgcctgttgaaatcattactcatttctctattagatcatccatctttttctttttgatgtgtggaaatttttatatattctggatacaagttctttgtcatccatattgctaatattttctcaatctatggctagcatctccactctttttatggtttttagttttaatgcaacacaagtttttttatttttatgtcccatttacaaaatctttgcctatcccaaaatcatggagattttctttttcctgaaagcgcaaatgtgtaagttttcacatttagatccacaatcaatctgaaagaatttgggggaatgatgctaaatagaggtcaagttttgattttcctttttccatatagatattcatttaggtgcgggatgatgttacttttctacagacaggggttgtcttaccttctggttgttttgatagagttgggaaagttctcttcagttaaatggggctgagctgatctacaactcatcttccattttgcaagactccttcaacctctggtttgctccttctccgtggctgaactctccaagtgtcctaatgcctccaaattaattttggttttgtggaatattatccagagtttctagttattctcaatgaaagcactggactgccacaagctattccatttaggcagatacctacgtcagtctagctacattccacaaactcatcaacaatctcctccaaaacatttaaagaaaaatgttgtgtagaactcaaaaaggtaaaagaaaatgtcagtgttggcagctatggctgctccatgtatcctgtcatggaaggagctttggaataaaacaaacctgggttttaattctaacttgtcatttattaactgtgtgacaatgaatcttacttccaagtggggataataaaaaacaactagtttcacagttttcttgtgaagattaaatgaaagaacagatatcaaatacctcgcaaatagtaggtattcaataaataatagatattattatgtaatatattataatttctcttagagttataaaatgcactcatctcttagaaataatagagaaggagtcgggataggtggacttgaaaagcaacactcttctctgagcaccctgttagatgctgaaaagggggaacttggttgaacttgttttattcaaaatgatatcaaggtcattcacatacacaatacatttttttcgtggaaagatggtagaaataaatcatctgaattgagtactgtggcaaatctattccaaatgcttcattttatagatgaagaaattgagtggttaaatgactcgtacaaggtcaattcacttgttagtatttatttaaatgacccaaattccctaagatcatatatttcttttcttctaacatactcctagctcccatgtttaactataaatgtaaagcagagacaattaataatgtgttattattactagctcattctaactaaaacccatcgatctatttttaaatattttattttaatttccatccccacaaattatgtgacttcctgccaactatgattgaaataggtacttgccattcctttcccattttaaggattatgtcctgtagcttttcatttttctgtctgttattaagaaatgatctgccttatcctctaatgtatgaaaggagctcgtgcaagcctgtagaacacagctctcttgaagtctacctagcaaaaaagggagtggggaacctccatccctctgggcactggatacaaaggtgatcatgtgcttctttggcactttcatctctgggcagggacagatcctcatgctttccagcaaaggcagccctgtggggatcgttttttggtaagaccctgtgtccagcacatctttcagcattgtgtactctacgaacagacatatgagcctgaatcccacatggactgagtaacttggaagtttcatgatcccagagcacacagccatctcataaaagcctcacaccaggcttctcaagggctctgcctggaacatgcttccttcagatctttacatgggggggcttcttcctagaaatgtgtttttagcctagatgtctccttttcagagagactatccctcaccatccaacctccagggaccctcagtggacctctttacatcctgctgttttttatttgctcactcactatcagaaatgtatggtgtctgaactccagcagagtataagctccatggaagcagagcccttgtacatcaccttgtgctgtgtcctgaagcagaggactcactcagtgaacaagcaagtgggctcctgtatccaccaaatacacccagcatggtgggtcaggccctggctttgaatactggcctcaccactagctgggtgaattcaggcaaatgacttcagccaagaaacttctcagtgcttatcctaagataagaatatgtattttacaaggttgttacagtcatcaaatgaaataatgtgtgcaatgtgcttagcacagggcctaccactgaaaaatacttaacaaacaatagttattattattatttccataatgaaagcaaatcatattatgaaaaagtcacagaggaattgttttataaaaatggtaatgttgaaatcagagaccctaattcaaccatgtaagataaaattttaaattaatgaaaatctgggtcttcttgttagttatttacaattatttatttttgtaaaggatccctaatttaacctttgcaatgattctctgttgaaataagttatcatctcaccctctgctcttagtatccatttggaaaatgccatctttctgagaatacttgcagtagaaattttaaattaggatattaaccatctcctgtaaatatatgctagcaatgtttttctatttgtttaatctagaaaggtgctagttacagtttttcatgctactgaatgactttagctagaggtttcctgggggttctaagaaaatcactattcttaggggactagaaatctgatcaagagggaagaaattacttctttctttttattacaccttggttctcctatagtaaatgttttcatataaaactcatttctccccatgcccgaggagatggttaaatcaaaggagcaataactagtgcctggctgtttgccactggctgcaatggggactcggggaggaagacaggctcatttgcctaacagggcccagctcccttcccgtcttccttcatcttgggccttttccttccttactacctccggtctagactcagctttccctgcagagacctttggcaactgcttctgagccagggcagccagcatctgtgtgtcgggcactgcattaaaagctatggcttaaagggctcaagggaggaatggttcacccgggcgtctatttgaagttgcgaggtaactgatgggagagaaagatcttaaacagggagtaagagctttagcaactctctggcccttagaccctaaatctgaaaatagaaaggaaagagattatctgaagacaaactccactgttagtgactctgccattcattttatgttttctcttgaaagcctttctgtctttgtctcactaacaaggtagttcatggacatacatagacactacagaccaaaaaagttttccacttataacattttcttccttcagtttccctttattcattctcaaattttgaaataaaattactgaggggattgggagcagtgaaaaagaaacttggcaattagatactatccctgggtttgtcttaactatacctccttctccagaataatttattcagaataaatggatggactttgcgataactgtattttccttaaaatgcaaatgcacaatagctatttctacccctgccttacttctccctttagattctaactaacaacagtacttgaggaagaaatgatatttgaaaatatatagtctgtattagctaaaattcattcaactgaattatgtttccatcctccttttattccaggtatcattggaacatttcaagatcatcaaatcaaattccacagggattggtgaccaaccagaaggctcagacatctgattgctgacctgtgagtaaagtttatgttttattaatactttgggctctgctcttaggaattacacagcctctgtgcctgatattctaaattcttacatctgaagatgcactgtgagaaaccagtttttctgctgtggccctcctactttacttgccagttaattaatcagttagaatctatcaagttttgaaggatctatcaagtcttttatcctgttttgtaatctgatttttttttttgctttatttttaaatgtttcctgcaatgtaatatctttcacaaaacagtcctggatcaatcatgaagtcttcacttcctgtgaaaaatgctagtgacttgaatcaataaagacaacatgagtcagccttccaaggtgaataagctcacctttgtgcaaacactggtgatctcaggagtgctaagtacccctcactttcaacaaatctctctcacctgggaggaaaacttctaccagaacaaggaccacctagggaggtgaaagaggggatttccactttagaggatggagaaaccaaagggcatttcactcattcacagttttgctgagcttggctccagtaggtagaaaagttcttcaggagttcagcacaccactcaggcaattgttgtttcaaaattctatctgttgcccccatgcaagttttctcaggctaccatagtgaaaatccacagactgggtggcttaaacaacagagatttcttttctcaccattctggagggtagaagtctgagatcaaagtgttggcatggtggatttctcgaggccctccttgcagatggccaccttctccctgtgtcttcacgtggtcctctctccgggcacacacctgtctggtgtctttctctctgtgcccaaatttcctcttcttgtaaaaacaccagtcatattggattaggcccaccctaaagacctcattttaacttaatcactctttgaagaactcatctccaaatgcggttacattctgagatcctgaaagttaggatttcaacgtatgaatttgggggaaataccattcagcccataatgctgccaccatcattttccctctctaatatgctgactttttgtttattgcacgtgggcttccctctgtttctcccctcctgaactcttttagcgattacattactctcagagcatctgcagttcttagagtgtattataatcatttgggtacagctctcatttccctatgacattctataaattctgaaatcagagagtgtgccttttacatctctcatagcactagaggaggttttgtatacagtagacattttgtaatatttattaaatgaatgaatgaatgaatggaaagaggattagatgcagcctctgaacctgcaatttatttgctttaagactgtctccaaatgatgagtattaaagatgctttctcctcacttcctgccccccaagacaggtagaaataagttaaggctgaggagaaaaattgaaagaaaggtgtgattgactaatagcaggagagttacctttctcccagaggtaggaaatagtaaatagcacaagcatgccccagttaaggtggcctttccacaagaaaactgttcggggatccaagagggacttactgagtttgaagcctgtgggacatgcaagggcatgtgtctagaaaacaatgcatatgcaggtctgaaggtcaggtgagaaccagagatgttcacagtcaccacctacaggcaggaagcagcagtgtgtcaatgaatgaggccaccaaggaagactgtgtagagggagaggagcagtggcttaaagattccatcagaaattgtgtatggaaatttttcctgctagataacaggagaaggacccgtccaagaggaagaacactgcacgatacttctaatgaagctgtgtgagaacatgtagatgagctaatgtgtgtgtctattttttctcccctagtgtttttggacctattttgttccttctctgtcctgtcttttgggggctatgccccaaaccattcctgtgagccttctcctacccacctttgctcccttctagctaactccacctatggtcattgtccaactcccctgctgcctgctcagggaatcttagacaaacttcctttgggcccattttcttcatcagccaatcagagctgatcagaatggacaggaggggaggccaggatgagaatccttaatgaccaaagagacagaggcaggtcgttttcagggtcaggtggctgtgacgctatggtcacagagcatcatcttgtttagtcagtaaaggccccagataggggtggagggctgtgcctcttttgccctgaactccctcctttgtccattgtcccctgctgattgtcccactccacctgttccccagaataagctttggcagtattttagggtttccctgccagaccagagagtggaggggccaggccatggcccctgacagtcattaccagcctcccctctctaggcctcaccatcaaatgtcatttctcacggagccatatttacccctgggctgaatttccctaatttgccctgctagcatgatgcaaataaaaggggtaaaggtatttattcatctctcttttattttccaaagtgttatttcttttcctttaagttctctccttgctttatgtttcttctctctcccttagttctccttccttagtagaaacccttgagcttcagggtgattttctgattatgagcagaagaggctatcagagatctggaagccacctcctgcatttctttattccccctcctcacccaattgttttaaatgtacattgagataccagctttcttcaagaacccacttccacactttcctctttgtgttcttggagtagccaggaaaaagatgcccattttctcgaaggtacccaaaatgtcagtgacacttgggtcagtgattttatgcaaattactaattatatcaaatgagaaatgttgaaagcaagaggaaaccctttgcaatccatgaatggtctagttggggtgttccaatgaatgatggccagtggccaacataggtgcctcccgactgtgtttcattaatttcagtcagctcgtgggcttggagagaaagatcattttcctatgagcacgtaaaagaagtgctttgagttgtaagcacttcgaaggctttgcccttgttttcgaatgggagattttataaccactgtgggccagtatttttgaagtcagtcgaagctccagatggagtggaaagagaagcttgggtttttattttcttcttcttttcttgagttttgcagaatgagcctccctggaaaccttgacaaagtccttagtctcctttggttcaggtgggcccaagctttttatagtaggatctgaagggatctttcttaaactaagattccttcctgtgggtttttagtagtggctgtagaactaggcttatatgggagaaggtctggaatccactcccttccctgggagtctcctctcaaggagaccactctcagggtccttgtcatgagatatgagaagaaaagtccacaatgagcctgggcatagtccagatttggttaaggattgaggggacacgaggtcacaggtcccatgggactcccagcgttctggaaacctccatagtaaagagggtagaggacattccaacaccaccacgtgcagctttagtaaccttgcccaaataaacgtgtttccccggccagggaattgcacctggtcttaagaggcacctccatgaaaacacacctttctgcctggcatgaccattgacagagaaagactgtgctgagaagggggatacagcagggagaaaaacacacaacggtgccaggagctcttgtctagaactcctttccaggctttttttccccataagcgcaagtgagtacacaagtaaagagaaaagaatgattgtgctatttagctttgaaccaaaaactatcaagcctttcctaaggttccaactggaatagcatttgtacagttacaggacacagactcaattgcttctgaactctgctttaggatgcctaacaggattaagttgtgaacatctcataccacgccgtgcaacagtactcaaataggacttaagcagaacaaacagtctggggaaaaaaaaaaagccctaagacattttccttcctactattctctgtatcccaggctcaacttaatgccaaattaaatctggatttttttttaatagacgtttcctagaggaaaaggcagagctgcattccctgaaacatattttagcccaaacttataacttggattttttctttcctcctccctttcgctaattcaaaacaaaatgtccatcacgcactctaacaccagcctctaagagctagagacaaatgaagtctgaatattcacgccaatgtggtacaaatgagctgtgatttcaggatgctggctgttttactgacaggggaaaagggcagttgactagtttaatatatttggctgaaaacactttgctaaagagcagtgaagaaggccaatgttaataatgaatcctgttctttaatgaccaaatatgatatatcatggaatggggcatcctgagtttgggggaaagcatttcaccatatccacaggatgcagacgagaatgaatgcaaacatactgcattcatgttgggccctaatgaagaagctcttctaggagtattttctccaagttcctcaaagaattcctcccataagtatatgataccatgattttgaatctgatttcacacagaattacaaaattataaatataaagacatttgttattatgagagactccgggaatctagctaactgtctcccattattggctaatggtttataaattttaaaatgcaattataagttggggttgatgagggaagcctgtgaccaccattagcaccttccttaaatatgcatattcagtcagtcgttaattcattcattctacagatatcactggattggaccttctccatctcacgtgccatattagttctgtgttacatttgcaattctagtattccttaccataaaatgggcttttttttaattaaatgcaatggaaaattttgtgaatccaatgacgtgttcagtgacgtaaattgtgatttctaatactgtatttatttttcattggcttcgtcttggcaaagggtcataatattttaaatttctctgccctctcatccacctatcacactttattatgcggtttataggcaaaacacaggcatgcactggctatatctgtaaatctacttttctgcaaatcacttgaagggtaatgcataattgccccctacattattgtttcctagattctaacttttgtatagaatgttgttaaaagcagattataatgtagttccaagtatgctgcttcctctgtatccataggggattggtttcaggactcccgaggataccaaaatatactgatgctcagttccctgatatacaatggcacagtatttgcacataatctatgcatatcctatcgtatactttaaatcatctctacctctaacacctaataaaatgtaaatgctatgtaaatcactgttatactgtatttcctattatattttttattgttgtatggtttttttaattgcgttggttttttttaaaaaaatatttttctatccctggttgattgaatctatggatgcagaacccatggatatggagagctgatagtaattgaatttaaaagcaaaataagggtgctgtgatatttttatgaaatgctcatgagaatcaaagatgagagaccagaagccaatttaccgtgaagtcagtagagtttaagccgcagggcctctcatggggagaggtccctgcctcaacacccccatgcctaactttttacatttactattgtattctggttttccaagaaggcctctcaaataatcttcaggtcccacaaaacctggatctgccctgaaactgacacagatatactgagatgatttagcatcgtgtctaaagctaattaagtaagcaaagcaaagaaatggtcaaagtgtgaaatgtgatcatttatttttttaaggctttaagacaaattcagcttattttctaaagtgaaccccacttaagtgaaataataaatcagtttgccaaggcacaagtgaacataaacagaagattcatttttacttcattaataaacatcaaatatgaacggaacctaacatcaagcaggccaaggcctcctgctgacaggaaacagctcctagtaagagcatttgtagaagaacataaatccttccaggcaatcacgtgatcatttcatcattgaggtccttgctacagtctactatgtattatccatttacaggtcttgtgagatgtaacagagtgttgtgattaaaagcacacaatctggggctgagttgcctggatgtagaccccagctctaccacttactagctatgtgaccttgggccaatgactcaccttctctgggcctctgtcttttcatctgtaaaatggaaataataaggattgtcacaaggatttaaactgatattatcacagttcttagaactgtgcttggtacatagtaagtgctacataactgttgtcgaaagaaatcaacttatccatctagaatgaaagctatatgggattgcttgtgggttcactcttgcaactcctcacagtgcctaacatggcacatggtcagccatcaatgaaagacagcaacccagggcccatgctgccctgcaaatgtgcttcccttgtccacccttgatgtggtttggctttgtgtacccactcaaatctcaccttgagttgtaatattcctcatgtgtcatgggagggaccaggtgggaagtaattgaatcttgggagtgggtttttccctgtgttgttctcatgatagtgaataagtctcacaagatctgatggttttataaaggggatttcccccacacatgctctctcttgcctgctgccatgtaagacgtccctttgctcctcattcaccttccaccatgattgtgaggcctccccagccacgtggaactgtgattcaattaaacatctttcctttataaattacccagtctcaggtatgtctttactagcagtgtgagaatagactaatacaagcatttttttcaaattttgagtctgaatgctcatagggatgcagggatgcatatgttctccattttcccataagctaccactccccaaatagttacctctttggtcctttaagctatttgagtttgtcatgcctgatataaatgaatgatcccataatacacgaacactgcaacagttagtggcagttttatggctcactggagtaaagagatgggcccataaggaagtgaaatatgagtcacttccactccctgatgctctacctgcaaacagtgttccggttaacctacctatccctgtttctaaactagaggtctcagaagggaaataggaaatcaggaatctgagcaagcacttgcttagaaacagagacgagtacaacctaatgtcagagctggccaagactctatcagtcatgacaagctaggttatgctggtgtcagaaacagccaaaatctcagcaacgtcaaaatgaacgtgtgtttatcactcatgctttgtcactaaccctggataggcaagggtttctagtccacatcactgtcatccatgcttagccacccctactgacaatgactgtctggaaatcttaccaaccatgatggagagaaaagagctctttggagggtctcctattggcaagtctaccccagaagtgacatgatacttctgctcaaaactcattggccagaattagccacttggccccagatgaccacaaggggcaagcacaatactataatgtgcccagaagaagtaaaacaagaatatggggcaaacagcacaaaggatcatagctgcgacattatttggaacttggagtctcaggccagaattcttaagcttttcaatgagttcaactcagcaaatatttccattcataaataactgcacagcaaagtactcagcactgtgaggggatgtcagaggagatgtaggccttgacactgagcagcttcagacttggtcaagagaaagtgatggtacaaaacatttgaacagcaaggccatatagtattgatcaccaagaacaaggccaataattgctgtagaagctgaaagggagggtggttctgggataaagataggacttgagctggactctagaaaaatataggggatttgcaggagtggagggcacttcaggttatgggcagcaagaagccagagacaaaggcccagaggcagaaatgagggtgaaattattgcaggattcaggagtttggcttggctgtaagttgtgtttgcatgggagggtagggtggggagaggaatcatgtgatggatagagtggagccatttcacagtgagtttctgggttctgcagagaaacaagatggtggtatgtgggaggaagatcatttttcctgaataactccattcaaaaccaaggaatttgcacctcccaatcaccagcctttcccagcacatttattccccaaaacaagagtcctgaatacccaacagcttcccagaccttctaggcagtcattgaatggagacagtagtaaaccctgggctgctcctgcctccagtttaaagcatctttgatcacttctgctgacaaagaatatccaagttcaagtgaaatagcctcttattgctggggtcagtgtagcctttttgctatgtaacatctgtttttaagattcggctgagagctgagaccttgacttaaatctgtttaacttaaaaagcagcaagagaacatcttgttttcatgaatgtccaggggctgtgtgtcaacaaataaaaggtctgcttgtggtactcaaagtggaaaagctggttgtgagatgttctgccactgggataaatttattatggactgtttgtctcttggaatcatgcaccagcatttgaaaataaatcagcatatttctgcttgatggcgtgttagaaccatgcttttattgtcggaagttcacagagctggatgggtctagaaagatgccctctttcatgcctcccaccttagctgcatgaagttaatgtcttaacgtggattccccgggtctgcatgaattctggcaacagtttctgatggatcattatttttatgtgacttatgtaggacctgaagtgggaaagaagtgggtgagactagttcaccatccctcaaatctgactagttgcttttctcctcacccacctatttaggagagagaagtggaaaggaattttatttatctgcacctaggggagcaaatgtctggcatgtactcgatgtcaatttaatttgttgaatgaatacaaactccagtcttataaatttatgttccctgtatgaattcatgtctctatatatattaatgtcattccttttggaaaaggtgattaccacccagatcttattctaacacataggaaaccattagatcgttcctgtagttctctctcatagtagcttctttttttcttctttttaggtttcttcctaacattaacctaatttgtattttatttgttgattgcccatctccaccatcagactacaagcaacttgaaggcagaatagctgcattcacatcttatatgctacactaagcaaggtagctagtacatgaatatttcataaacatttattgaattttttatttatttatttttattatactttaagttctggggtacatgtgcagaacgtgcagcttgttacataggtatacacatgccatggtggtttgctgcacccatcaacccatcacctacattaggtatttctcctaatgccatccctcccgtagccccccacccccaccccgacaggtcccagtgtgtgatgttcccctccctgtgcccatgtgttctcattgttcaacttccaattatgagtgagaacatgcggtgtttggttttctgttcttgtgttagtttgctgagaatgatggtttccagcttcatcaatgtccctgcagaggacatgaactcatcctttttatggttgcatagtattccatggtttatatgtgctacattttttttaatccagtctatcattgatggacatttgggttggttccaagtctttgctattgtgaatagtgctgcaataaacatacgtgtgcatgtgtctttatagtagaatgatttataatcctttgggtatatacccagtaatgggattgctgggtcaaatggtatttctagttctagatccttgaggaattgccacactgtcttccacaatggttgaactaacttacactcccaccaacagtgtaaaagcattcctgtttctccacatcctcaccagcatctgttgtttcctgactttttaatgatctgcattgaatatttttattaaagttctcattgggatgatggttgtagagtctcagccactcttgattgtatctgaatttaaatataatgcagaagacgacaggacttataatgcagctgaatatgtaggggccttttgtttaatgacacactcacattcatttggccatacacgctactgaaggtcacggcgggatgggctaaactaaccatctctattttctcaatttaaggtggtcagctacatctgtcatatagctggcccggattaatgtcatagcacagggccatagcttaggatttttttcccctcaaatgagtaactcattcctggtgggataaatctgtgactttagccttattagcaagaaattctggcccacgaagctatctggtaaaggcagtgtgatatggtttggatttgtgtccctgccaaatctcatgtcgaattgtgatccccattgttggaggaggggcctggtgggaggtgattggatcatggggaaggatttcccccttgctgttctcgtgatactgagtgagttctcacaagttatggctgtttaaaagtgtgcagcacctcccccactctttcttcctcctactcccgccatgtcaggcatgcctgcttcctgtttgccttccactatgattgaaagtctcctgaggcctccccagccatgttactcatacagcctgcagaatcatgatccaattaaagtcttttctttataaattacacagtctcagatggttctttatagcagtgcaagagcagactaatgcacagtgcaaggatctagggtcagaaaggtgttttggtgctcaacagacctatggcttaatgtccacgttcacttgtccagtggtcaatgcagatctttctggtgatcaagcacaatatgaatactctcacttgaggggtacgaaggtggattcatttgctccatttttctttggcttcctgtgtagatggaattgaaatgggaatgatatgtgcattccaaaggatctcaagagaaatgctcattcgtttacaagaggtgcaatcccacaatagtttcttgctttgtatacttgaaaacattcccaaagaaacaaagttggatgcagaaaagatattgggagaaaagaaaaataatactccaaattctgaacaattctactttaacatgttgatctgtctgccagctggccacagggttgactacttgtaatatatacttttggtaggccgcatgtagttcttggaactgtttatattcggctgcagaaacttaattattctaaaattggcagagtgatctttggttacttaatacaaaattgcttagtcatctttaaacatagtgtggacagcttttgtttaagtgtgaaaaattaggaattgcaaatgtactccaaagagattttaggtcagggagaaaaacaagaaagtatcattctttcaagatatttagcccggtggttgccacatgttttaatttgacaagctaggtaactgtcgagttgaagtccttgattacaagtatttttccattttctttgtagatattgtcagaagtagaaagctgttgctgctgcttcttagatggtattctaatcctacactctgcaaagtataggtttttcagcaagagtgtgaggaactctaacatcagctgctggaacagctttcttgttctacgaagcgaacaaggatgccatttcaagctggttgtcacaaagatcctccttttgcctcttttggtttgaatcctcgaactgttgccttccacgtatagtacagagctatagtgctttagcgaggaaacaggcaggcagagtgagcttctgcattttttaaagtctaaagtggcaccggaagtttctagtttttccaggaatgcccatggcaacctcacacttttcctgtgatctgggctggggctcctaagagagatggtgagaaaagataaaagtcctgtagccaatgggtagccacgcgaggcctgggaagggtaggttcccaagcaaacctccagaacggtgccttatgtttctaattactgagcatggttagagagcaaaatcaggcaacagtttttttagactgatggaaacatttaattggctctgaatgtcagtgttttctaattatgatagaggggtagcaagaagtttccaaaggctgcggaaatttgaagtgtatcagctgaattctgattctcttcttttcttattcatcctgtcttctttttctttcaacatccaagaacaaacctattccctcagttaaatgcctaatactcctcttcctgaaatcgaaatgtctctctaagaccaagttcttttccactagagaaaaacaaccacaactacaaatcagaatataaaatagagttccatagtaaaccaccaccattcccaaggttactaagagctcagccagagaaacagccttttgataacgtcttagccaagttcatttgtttaacaactaagttcaacaaataaacactgccctggcatctgttccaactcaacaagtgtgagcctaatgcggagtataagaaaaacagtcagttaagaactttgagggatcacgaaagacagtaatcatttctaagagataacaaccttttacagaagacaaatatgtacttggtaattaaaatacaagctatagactaagtgctccaatagaaatacaacatgggtatcagtacaaactcaggctattgagtcagttgttcaaagatcctatggttttgcgctattctttttttttttttttttttttttttttggagacagagtctcgctctgtcacccaggctggagtgcagtggcgcgatctcggctcactgcaagctccgcctcccgggttcacgccattctcctgcctcagcctctccgagtagctgggactacagatgcccgccaccacgcccggctaattttttgtatttttagtagagacggggtttcaccgtggtcttgatctcccggcctcgtgatccgcccgcctcggcctcccaaagtgctgggattacaagcgtgagccaccgcgcccggccagttttgtgctattcttaagcaggccccaactgtgagccattccctacctgaggaaaagtccaggtatccccaaactaataaatgagtgaaactgctatctaaatgactcattactatctaaattactatctaaatataaagaaagaggaagcaatctaagtacttttcaacttattatttatctgtaaatatatatgcttaaattatatgtctgttacatccaagggacatagcagataacatcctttagttgggtttcaaacctttccaccttggattataaacttctagaaggtagtttttaacctgctttgcagttccagaatacagtaaacacacttgatgatcatgatgaatagaagtcaaataattcactagagaataattagtccctgatcagtaacagcttgtccttcacatacaaaaatactgctattaacaaagcacctctagaacacacctttgaattgttttcagcactataaatggatttgcatcctgccatctaagctatcctactttatattagcaagatagctggccaaggctctgtatcactaaactggaagtgttagttgaacaaaccagtcacaaaaagcaggcacatgagttgctgacttttttttttttttagctgagtagttcagcaagtccagaaggccatgcacaagttaaactacttttatgtaaaatatggtgatctctgcagcatgtttacaactgggaaaggcccatggcttctgaactttcattccatgtgaaccactcttgggccttgttacttaacttgaagtgtgatctttcttcagccagtgtctcagcttcttttgtatttgccaagcatttcactttctcagttgcaagtgcccagtcacagctagattgcccccatccaaaaagcctccataggaaaatggagagagtaccaatgagggaattatgagagcacagccatgctttgagatgctgacccatacaacaccccacaacttaccacatcttttctatgagattgtaaggtctttgaagacagaaaccatatctaacataccttcatgtctctgaagtgcatagcattacttcactcagtacaatcatttcatattaggagttgaaagatctcttttttttttgagacagtcttgttatgtcaccaggctggagtgcggtggcatgatctcggctcactgcaacctccacctcccaggttcaagcgattctcctgcctcagccccttgagtagctgggactacaggtgtgcgccaccacacccagctaatttttgtaattttagtagagacagggtttcaccatgttggccaggatggtctcaatcccctgaccttgtgatccacctgcctcggcctcccaaagtgctgggatcacaggtgtgagccaccacgcccagccaggagttggaagatcttatagtagagctgtccagtagaactttctgcagtgatgaaaacattctctgcaccgtcttatatgggggccactaaacacataatggctactgagctcttgaaatgggactggtgaagctgaggaactgaattttaaattttatttattttcaatttaaatgacctcgtggctggtggctaccatattggacagcatagccttagaatcttaaaaaatatattttcgccataaccctaaatagatggccacttcttctccctggctttttcagagataggggtctaccctttccatgcacccccatttttgggtagttgcgctggagccagccctccctgtatctgaattatgtgtgataatattgtgaatgcctctgttagtcaggcatacatttagaaagcatctttacatatttgttgcaagtctacgcattttttctcacatggacacaaggtagtggagaatttccaccttgccttagggtttacgcttgtgtcatttgttcttctctagtggccaatagagcagcatgcctattctgatttagcattaaactctgtctttcagcctaattctccttgagttcatcaaggaaaagtatttaaatgcttgaaaagaaaacagaagaagtcgtgtcccaaattttcacttctcttcattcttctaagaaactttcaagttggtttagaaattagtctaaatgccaatcctggttttccactgatttgtagtggttaaggagctaatgtcaaagctttatatgtctcagtctcctttcttcaaatggggttgaattgattcttcttacttgggaggatcaaataatgataaccataaagttttgaaaaatataaagtgctccaaattaaggtggtgatatttgtgataacacttgaagatgcaacctaaagtccctaaacatggtgtcttcctaagtgttgaagttagtatatacaaaaaccatcatttcacaaatctaaactactcaaactgtctgctactcagaaggtgaaagaaagggcataaagacattggctttaataatgttaaatctgccaggtcttctgtttgctagtggagaagtacaaatagagaaatggtaatgctaagagattgtgcggggaaggcaagggaaaaacaggtcataacctgttaacctgcccttagtatgttggattccattgattagagaaaagaaacaccttgagaagacaaagtgcctcaggttgattgtattcactcttatttctatgctgctgttcttgacagacctgccttggtaaatgcatgtatttttttaaagtagcacagatttttggaacaagatggtgaaggttgagctaaagttaagtgcaaactgtacattataatccatttgtttatttggtttttcaatcccaaatgaaccattgagctcagaaaagagcaaagtgggttgacaaattgatttttttggaaaaggacaaaagttcatttggtacagtcggaaagaaagtgctgccagatttactgtgtaactactgcaaatgtgggtttatataatttttgagattcatacatagtcaattaccaaggtctttgattcactttgtaaacactgatcagtcaataaagtacagagagatgaattggcttgagttacattttccatactcagaatggtaaaatctagaatagaaatccagtggctcaaattggctacaatttctgagtgcctactctgtctcaattgtggaaaaatttttttaaagactatatcttttcataagtggccttaagaacaaaagcatatggaaagtaaaatactaatacaaatatttaaagactagctaaagagaacaattgatgagctgtagctgacagtgtgttattgattatcaacatgaattatagatattcaaggagggaattgtcgcttttaagctagggttctcaggaaagggtatcatgagggaagtaaaatttgagcatgaaattcatgattgaataaaaatatggatagtgaagatgtagattaaaaagaatgagtaaaaatgtagaggtagaaagttgtaagacatatttgagaggtgataaaatatttttatgtaggatgctgtggtatgatcagcttgaaaggaaggttaatggtttctagatcaaaaaattaaatgagaacagacttagatactcaacacatttatgtctgggaaggaggaagaagcatggatatgtcatgtgtgatacctccagctttgctggctcaagcaggtatacagccatagtattattatgtggcgtaagatgaaactttgaatattatctctccaaccagctcactttatagagaaacaaagctcatagagcttcagtctcagtctcctaggtctcattccaggtcactatttgccaagggtttgtgaaggaaaacagttaaagggtcaaggtaagcgatgatcattgcagatcagaggtaggaaatctgctggagtatgttgtacccagaaatcacccaatacctgtaggatgaagagaaacatcactgagttgcagcgatggcccaactgaaatgaatgcaaatctttaggatatacacgacatgctccctttctcccacaaagcactgaatctcaagaacacaaaacagaaagcaggtgataggtgtgattcaaggttgaagatgggtgtgacaagcctggtggaactttaaagaagcaagaaagtctaaactatcaattccaggaaggcaaagaccttttctgtcttgttcactgttataccccagtgtcgagaacagtacctggcacatagtagctgtgcggtaaatatttattgtatattgattgtataaatgtttttgtgaggcctcactgaagtagctgaatcatgaaatttacagtgggtgcaaaatgatggctagtcagagaggacctgtctaataatggttttgagtgttccaagactagagttccttgcgagagcagagaaatgatgatgttgtgaatgaggatacagtgggttagaggaggaagatgtgtaatgaagaaggtacaatataagagaagaaactaagatattgaagaaaagtatgcaatgatgctgtcgaggatacagccatcctgagttacgaattttacaaagcactaacaataaattaacagagatgaaataagcatttggaaggctaattcaaatgagatcttttgtgacttgataattctatgatttaaaccaaacaggttgtaaaccgaaggcataggtaatttttaggattatttcttacctaaggttatatgatccaatgaatcaatgtggcaatcactgataatagtcctctcagaacttctttggggcactcttgtttgttccctgaaatgggaaacaaatcctagagagaaatagtggattagtcctattatagtggttaagtgtatgcactttgaaattccataaaatggggattatactagctacctcacagatctgttacccagataaagtaaaattacttatattttaatggcccagcagagctatcagccatgaaaagacttgaaggaaacttaaatgtgtgttgttaagtggaataagccaatcagaaaaggctacagacatactgtatgattccaactatatgatattctggaaaactcaaagctgtagagacataaaaacatcagtgattgccagggttttggagtaaggagagggaagggataaatgagtggagcaggtggggtttttagggcagtgaagctattctgtatgatgctactatggtgaatacatgacattcggtatttggtgaaacctatgaaactgtgcaacaaagagtgaaccttaatgtaaactatgaactttagttaatcataatgcatgaatactggtttgtcaattggaacaaatgtaccacactactgcaagatgttcctaagtttcctagggctgccataacaaagtaccacacactagttggtctataataacagtaatttcttgtcccactgttacggagagttgaagtttgaaatggaggtgtcagcatggccaggctccctctgaaggcactggggaagggtttgtcccatttctctttctcagctttctggtggccttaggtcttccttgtctccattttctcatggcatctcaccatgtcttcacattatctcccctctgtgtttgtctgtctctgtgccaaatttccccttttcataaggacaccatcatattggataagggaccaccctaatcacctcatcttgactacatctgcaaagactctatctccaaatgcaggagaaaatgtgggcaggagttggggaggggggaatatatggaaactctgtactctctattcgctttttttctgctctaagaaataagtctattcattaaaaatgttaaaggcttaaaaaacagcctgccacatagtacatattcaataaatgttagttccttttggatgctgcattaacttattcagtgcccctgacacaacagattttattcttcttgcattccaagatcaatactggcactgcccaaaaagtagataagacttagcttcttccacatggccttgtccctaagtgttgagtgctgggttagccacctgctcacaaacatctcctgccttgactgcatttacacacgtgctcatgcacaggtgacacaggtgagcatacccacacacacctaaaatggcttatctgccaccaacactgacccaaacaaaagcagaaacttactagttccccttataaaggcatcacaggaaatatctatagtgagggctacatgcccatagagggaaaaagaaaaacagcaaaaaagaatataaaacataatacatttcttggttgaaagatgcacatcagctattgaactaaatttttaaaggaaacgagccataaattgattttaataaatataaatatactttcatttccgacacagggtgggagacagagaagaaaaaaaagtcacaaagaaagagaaaattttttttaatgtcagaagaaataccactcaatattctgcctttgaaaagaggcagagaaaaaaaagcaaggaggaaggaaaggaaagagaggaaagtcccggaagccctggcgtggtggtaagatgcaggacacgcctctcgtcacatcatgccaatcccctgggccgcaggctcgtggctttgttcaaaaagaagggcaggctgggtgcggtggctcatgcctgtaatcccagcactttgggaggccgaggggaggatcacctgaggtcaggagttagagaccagcctggccaacacggtgaaaccccgtctctactaaaaataaaaattagccgggtgtggcggtatacacctgtaatcccaggtactcaggaggctgaagcaggagaatttctcgaacctgggaggcaaaggctgcagtgagccgagatcgcgccattgcactccagcctgggtgacaagagtgaaactccatctcaaaaaaaaaaaaaaggaagggcagtgtgtttggtgatttgaaatcttttttctttccttttttttttttgagatggagtctcgctctgtcgctcagactggagtgaagcggctcaatctcagctcactgcaacctccacctcacgagttcaagtgattctcctgcctcagcctcctgagtagctaggattataggcacctgccatcacacccagctaattttttgtgtgtttagtaaagatggggtttcaccgtgttggccaggctggtctcgaactcctgacctcaagtgatccacccaccttggcctcccaaagtgctgggattacaggcatgagccactgcatctggcctgaaacctttaacactgacttatttcttaatcatggcagtttaggcatgccctgttttaaaagaaaatcctatctatgagaatccatattgaaaacacagacatatccataggtaatgacatctgcctctgttaaggtttttgtttttcccctctttacaaaagaagtcacctcagtaaatttttcaatagcatgaccacagtccctcctccagcacaaaaatttagattttcataaaactctccgagaacgcatcatctgtcactaacatcaatacttagctctttcacactactctatttgtgacacccagagcctcacgactgatggaatcaccctgtcttgacttttcatcccttcattggttgagagtttgtttcctaaccaatgttgctgaaaagaattcagcactgagtaggggtagggcaggaaatgagggattactgcctggggactggggacgtagaagagaaaaagaaaatcacttaccattctacctagacatgtctcctcttacaaaggaaagatgctagagaagggctgaaaagctctgtgatataagggtgcagggatgaaggaggatctccagccccatcctgggttgataccgagagccattttcataaacacatacaccttctctcccccacacaagacacacacaccaccgagagtcataccacatggtacacagatgtggttttgtgctttcctctaagctacacccactcgtgtgcacaaagcctcacctagaaaagcactggtctgtaggaaatggcacacactctctctctccctctgggtgcccccacatgtatactcagcagcattcaaatggcaggtagtttttctatggctgggaaagaaaaagtgctcaagtaagcaagagaaggtgaggagtgggagaagagaatgggtaggagaaaaagaatttgcgtgggttaagagccagtgaggatggtcagccaaactgacctcacgatgttagtttcacttcccttttaagtattccaagacactgcccggctctgcagaccatgtgcatctccagcctgcttggagatattcatttcactgctcattagcacctctaccagaggtataggctgagaaccactgttgctgacaaacagccagaatgactacttaaatttgatgaggtaggagcaaaaaccagacagaggcttagaggatgctcttcaagctacttggataaattttaaaaggtaaaattgtttgcttatagacggacctctttttcccatgtctgtttgctattgctatagttattcaagaggcactttatatgcaacaaaagaccacatggaaggaagagaagagtctaccctcccactgcacctggcattcgagtccaggagtttagaccctactgcccacagggctgtcctcacacactcctgccctgtggtcagaacaggagcctaccccagggagaagggccctgggatgccctcttagggaactctcaaatcactttttctttttccattcagataattacagactagattggaaagtgtagaaaaatttctttatggtcgatgaaataataagaaggaaaatgggttgtttccttcataactagcaaagcctagggaagtactcttggtaagagtaagatagataaacatcaaaaatttaaaaccccaaataaacaccaagatttgaatttctaaagatttataagcagcattaataataccctagaggataaaaaaggggaaaaattcaaacattgtatagttttgcttttgttggctgaacttttatttttgtttttgtggggtttttttagaggggaaaaaacctttgaaaataaaataattggacaatttatttaagaaggtttctgaacttggcttcaaaatctaagttttgttttttgctccttcaaacaaagatgccttcaggtgtgatggctttaggttttgtacagctccttattttttcacacagggcaaatggctcgtctcatgtgcacataaagggctggaaaatatttctgtgattcgagcgcagcagagagtctaggattccagaggaagtggaggcctcccattccgcacaggaaacaatcttcaagcaggccttaaatgccagattccaggctgagtttaactaaccactgacagctctgtaaacaaagcaaggacaaaaagagcccgcttccccctttctggtagtcattttgggtttgggggctgcaggggaattctggaatacttgactccatggcacagaaacgcaggggaaacgggctcctcatttaaagagctggaaggggaaggtctttccggaattaaaaccatcacagaggaggtaggaaagggtaaaatggttgggttacatctgtagaaaagcagtgattttagagcttggaaaacagcttgatcaccacttaactgcttttaaaaatgttgcttcatgatgtttattcatgatgttactgctgcagtctttattaaaatcctgatgcttctttgagaatatgcacattatatgcctagacactgtattattttatttctcgctttcacttttctcctagttcctacaaatacctcttcttgccacttttcttttctgtttgtcattcctgttttcctcctcctttgttcactttttcataactttggtctggggttcagaaagttacaaagagcaaaatcattcattagaatttcaagtgattctaccaatatttcaagtcttcaaaacctctctgtctccggaggtcttttttaaagaataaataatcttgggatcttacttatttgtctctaggagattcatgaatgagactgaatttaactcggctcaggagtcagaaattgatcactggctaccttatcagctttctaagagtaaagaaaaatcaggagaatgacaaatgggaaagagggcccatagtaactcaggagaagtaacacactgagttatcaatgatattgactctacctcctctctttcaggtccagacatcatctggtctccctgaacctgaaatcacaccatggatgattttgagcgtcgcagagaacttagaaggcaaaagagggaggagatgcgactcgaagcagaaaggtaaggatctagggtgaaaaatacttgtattcccttattaacaaccttggtttcaggcctcaaagaccatccttttgagaggccaaatgtggtcatatcgcacaccaaactgttcgcaaaagtagttatggaaaatttttctgctaagactctaaattaagcatttaaaaaaggaaaacaaacaagaatcaagaaaaagagagatttgagaggaatcaattgataactgcatattgataattgcatttaatcaatacctttcacattggaatgttttaaatgacaaaagtaatgtgtgaatgaaggtttaaaaagcttatataataagaaatgacaaaaaaatgtcaagtattgaatattggaaccacttaggacatgagagtcttcaatctaaaaaatataaaggcaaaaagccctggatgaatcttgtgaaaaattttcattcttattagaaaagtatccaactctagggatctgcatagtacaggttaataacgggctatgttaccgaggagattctgggtgtaactggaagctgttaatgtcgtgtgaggcctctacagtggtggctatgaggtcaaattggggagataaagcattggcatataaaacctggggcataaatacatattttaacattttaggcctcagaacaaaggacagtgtggtatttgatgcgacttaaatcagatgttcttttgagaaagcaggttaggcattcacagagagaaaaatgttaaacaatgaccttaaaatcaaatcgatttttttcccagtaactccaatgctcagatgaaaaatgacactttaacgataccacagcacaaaactggaaacttacacctataatgaaaagtattgttcttatgttctacttatttgcatggagaatgcaaaagcaaaagataaaataactgcctatgatgaactgggccagagtcagctggcattcatgaactgactaaacatgtccacaaggcactatggatggtacctgcattctgttggttcaaatcctagctctgccatttgcaagctgtgtggccctgagcaaatgatttctctttaagccatagttgccttatatataaaacaggcataatatctacatagcctgtgtgattgttgggaagattattgagcttcataaatagcctagtcaggtacctagcacatagtagtttttcataaatgatagtttttcataaatgatagctattattattattaaccattatcactagccaaacaagaaatagcatagcagcatagccagagctaaacaatcatgccaagagaaggaaaggtagtcattatcctgcaatggaactagtcagagaaagtttcttggtggaggtgagccatggaggaggtaatgatggcaatgaagagggaaacggagcctgtctaggtgaaggaatgacaccggcaaaagtgcagaagtggaaataagaatcctggtgcaagaaacctgttgagtgtttaagggaaaatggattggactggtatatcttggctgttcctatttgccatacaaggaatagacagagacttaacaagggagttatgtgcgatgacactatgctggagaaacttatctacagtggactagaatatggggataccagcactggaagagatagtatggtaatgagggcctgaatcaggtcagtgagtatggaaatgaagaaagatcaaatatgagagtctttacagagggagaattagcaaaccttttaggagagcaaagaacttatagacggttccaaagaatatacatctgaggagctggaaggaaagtctctgctttgtcctaaatggaggatttccttcttgaatcgtcagagaggagcagtgtttaatttcaggtagaaaccacatccaaaaggggatttcctgcaggcatgtggagataggaaatttcactctttgttcaaaaagggagagaaattattattagagtaataaatttgggcagacacagtatggtggtgctagtacaaaagctgaggggatattcccaaaaaagcaagtgtagaaaaagtgagcggtcatcaaggtataatggaagccatcaaagaagacaacgtaccagggagatgggggagaaccagggagagtatgaggcccaatgttgagtggacatggtggacatggaagtcttgcgggcagtggccgggctcagtgaaccacacctcttattccttccaatgctgtgttatttcacctcaggttctcatgatagtctacaaaatatcttcatccaacaactatttattaagcactaaccaggtttaagtgtgccaggatgggaaaaataatggtggtaaagaagtagacatggttcttgcctttatatacctcacagcatgctaggaaaccaaagtgtaacagaatcaggaagcagacaggccagggtgtaggggcagacctgatagagttgtggctagagaggctcaggactgaggatgtagacactgggcatcaggctagattgccattgtcagcttctttcctttccacgtgaacagggggtcagggaatcattgacagaggtgtgacagaactaaagtgctgtggttagagccatactgtcattagagtgaataaacccagtttcttcaggttcaggactttgcttaagaattgaccgcacggctacgtggttcgttcctttgacttttttgttttgtgtggaagaatttgtcttcttttaatgtcagatgtaaaaggaatgtacacagtaagtcttagttatgtaccctgaataacctaaaataaacttacacaaattaatcctaaccttgtttaatttatatttctgtctgtattacttcttttgggatattatattgttttcttttctgttttttatttcttctttccttccttttctttcttgcttccattcatttccttccttcctctctctctctctctctcgctctttctttcttcttaagagtagtacttacataattccttatacttgtactaagtttacctttccatgtttcaaggtgagccttctagttctgctattctgagatttggtaagcccatgaccacccttcaggattttgtaaaatctgatcatttatgggaatagtgaaagtcaggcttcatggttcagccagctctggtgggaaagtgcagggtgtgtgcaggaaacaggtggccagaagctgaaatcaaggccatctaaaatcatggttttgatctgaagacaaagagcacatgagaccctgagcaagtccctcttcctttagctccagaccttggcttcctcctctaaaataagactagccattttctctggggtattggtggtcactttaatttttttctcgcttttggtattattgatttttctttactacgatcatatgttactttatttaaagccaaataaaaatgaaggcaattttctgttttgaaaaaaaataattctatggccctatgcagtatacctgagcccagatgggagaagacttaacttctctttgaatttagggaactaaaagaaagatttcatccctgatctggagggcagttaccaactactggaaatagagtggctccaaggctcagagctgcagattcatttacttactctcaacacatttttactgggcatctattccactacaagctctattttgggtactgagaatagacccacagagtaacagtgttgggaagtgtgtgcttagtgctttacaacctatctaaaatgaaaaaaagatcaagaaattatacttttgtatcctcaaacataacatgtaccccgtatgggttcatacttattagagatgacccacagcctttgtacacctgacccctgcagacagtgtgggggatggggtatactacagagaagagaaagtccattgactttccttacccataaaagcttttcaaataaaaataccctgttatttttatttaattagtattgagtctgattgccagatgcagttttactttgaaatgataaataatttaaaacttgtacttttacccggtgttataaccacagattaaaataaagcgaatttttacacattttattcttcagaaacagaccttttcaaagactattttgcaagctaattgaaggctttgtgccatgctggcttgcatgtgcttaggactggcatttattcactgcatccgagctgtcctgagactctgtcgtccacatatctccttctaagggttttagcccagttcatttcaaataacctcgactgcaaacgtagtgcatcaaaaacgttcttccagctgggcgcagtggctcacgcctgtaatcccagcactctgggaggctgaggtgggtggtcaggagttcgagaccaccctggccaacatggagaaaccccgtctgtactaaaaatacaaaaagtagctaggcatggtggtgggtgcctgtaatcccagctactctggaggctgaggtaaggagaatcgcttgaacctgggaggcagagggtgcagtgagccgagattacgccactgcaccccagcctaagtgacggagtgagactcggtctcaaaaaaaaaaaaaaaaaaaaaaaaacttccttctttgtcttgccccttagcctgtgcaacttttatgccattacctcgtccttccttgtcttccatttggctttctcactctgagttcttgagataaggtctttagatttggcaaaaaggaaggaagtacttcattttgtcataaaaagaaatacagatgctgaatacctacaaaatgcaagatactataccgaaccataggaatcagtggtcaccagtagggacagtatcccagtagtcactaagctcctattctaagggtattagtaactttagagcaatcgtgaccaaaagagggagaaaaaaaattcagtaggcagaatggaatgagcagtaatcagtgaaaatccttaatgcattgtttctaagcaaaaggcactatttgctcacatctcaaattaaactgtattttaaaagcaattactcatttgaacaaacagataaaaatttagttttgctgtttattattctccaccaatctcaggggagtaaaaagttaaatagatacattctggccggatgcaatggctcactcccgtaatcccagcattttgggaggccaaggcaggcagatcacttgaggccaggagttcgaaaccagcctggccaacatggtgaaaccctgtctctactaaaaatacaaaaaaaaattcgctgggcatagtggctggtgcctgtaatcccagctactcgggaagctgaggcaggagaatcacttgaacctgggaggcagaggttgcagtgagccacgatcatgccactgcactacaagctgggcgacagagcaaaaacaaacaaacaaacaaacaaacaaaacaaaaaaaacccaaaaaacaaaaaaaaacactatattctgcttccctttctgtttcttttatttcaatccctctcctctgccttcatctctgttttccttggtgcaccttcatgtgcctcttccccggtccacgtgcatcttcatcaacacttgatttgtttgtttctgtgtctcttcccatctgcactcctaatctgtctgctctgaattatgtgtggatgtgctgttgcatcaccaggaaatacatacttctggccaggaaagagggagagagaaacccagttctcttcctgttcagcaagtataaaaaagtgctagacattttatgtgtgtctagtaaagacggaccgccgccggccccagaattagctatgtctgaatggaacatttttgctctatatgaatgaggcaaccccaagacacataatgatggcaggcagtacagttggcagttaagggcatgagctttagcactgggcagctatagtgtcaaatcccagctctgccacttactaactatgggatctaccaaattattcaatctttcaaatattttgtatcctcccttacaaaatgggggtagtaaaagtatccacctcactgggtttttgtggggatgtaaaaaggtaagacatgaaagtattaacacagtgttattcatctaataaacattcaataaactcattattaattattattatttaatttgattctctacaacatggaaataaaaaaataaaaatatgaaaggcttgtggattgttttgcacatcatagatggtacaagaaccataggcaagatgaaaggcaggaatgcgtgactgactgaagagctttgagtgactgtgatcggtaacagtttttgaggaaggactgtgttgtctcagctggaagaattagcaccagtttaagttatttttaaaaatttggccgaaagaatgttgagctgtggtgtattttctttttttctttttttctttttttttgttttcatttttgtttttttgagaaggagtctcactttgtcggccaggctggagtgcagtggtaccatctcggctcactgcaatctctgcctcccaggttcaagcgattctcctgcctcagcctctcgagtaggcacacgccaccacacccagctagtttttgtattaattagagaggaggtttcaccatgttggccaggctggtctcaaactcctggcctcaagtgctccaccggcctcagcctcccaaagtactgggattacaggcatgaggagctgtgatgtattttctgagaaaccagcagtgatgcttttatccatgagaaaatctccagcagacatacttggccgacaccgggcttggttccccaacaaatggctctctcactttccaagatgtgctcattacgttcacagcatctgctttctgcacccaacatgagttcctctcactgatcagaagaaaggcccctattgtagagttacgttatcagattcagaagcttacagacataaataaagggaatgaaaacacttgctgttgtcatcattcatacatttttatgggcttctgaaatggcttgatgattagacatttgaaagtaaatatttttactacactataaaaagaagcaattttttaaaatccatggggtctctaaagtcccctctcagaactgtatcactgagacttttttacatgatttaatagaaacagccaatgaatgattatacaacacacaacccctcacacacgcaaacccaacacttattcaaaatgcttagcatcaggaccttgacatttttaaataaaatcttttaaaatgaaattactgttattttatcatcagaacattattttccattaagaagttaaatacgatattcctttgaaactatctaaattatcaaagtagctagatttgctcaaaatttcccttcagttctctcagaaaactgatcactccaggggacaaaagaaagttagaatctgccatctagttttctacttttattttttattttttgtagagatgtggtctcgccatgttgcgcagtccagtctcaaactcctggactcaagcaatcctcccacctgggcctcccaaagttctgaggttataggcgtgagtcaccacatactttcaaattaaaagatctgtcactgggcgcggtggctcacgcctgtaatcccaacactttgcgaggctgagccaggtggatcacctgaggtcaggagttcgagaccagcctggccaacatggtgaaaccccatctctactaaaaattcaaaaaataagctgggcgtggcagtgggcgcctgcaatcccagctactcaggaagctgagacaggagaattgcttgaacccgggaggtggaggttgcagtgagccgagatcacgccattgcactccagcctgggcaacaagagcgaatgctttgctcaccccttaaaccatctgtgagcccagattttcgtcaccgtgggacagacaagaaccctgtctttagctgaactaaggaaagtcctgcaacagcaatagactaaacaaagactattgtgcctagttgaactattttttatgcttcttcaggtaaattgcttatatgtgtaggcaaagtcattgttttgtttgccctcagaaaatctcctgtgttattcccatttagcagaaaaatagaaacagagaagatcgagtttccctgcttaaggcaaagaaggctgttgatatgactattcttgacttttcactggacttttttcaacaagactgtacatcattaggacagggacttagtcacatcatcactcttaaaaacttaaggctgtctctgaccttatgaatcatcttccgcaggggaacattatgtattcagttttggaccacacactatttttgaggcactgatgaaagctctggaccctcctccaagaaaaatgcacatatgcacccaccaaacttggcacttacattcagtggcatcatgaacctccgtccgcagacctcctgggggccgatgccttctggccaagaatccctgatctaatgaattttaaaactgcctgttaaatattaagaaactcaagcctaggagacatatccccttaagatcacccagttaagctgtttgcatagtgtgggcccctggacaaacaaagccatcctgatcttgctatatgtaaaaaagtctatggctattgattaggaaaataaagcatattttggaaaagagtgtattctacaatgtactgcatgtagagtgctttctaaaacttaaaaaccgtttatggataatgtttctaaataaaggagattcggtcagattacagtgaataaagtgaaaaataaagaaagatgagtggataggcagaatgataccagttaatagtcaggaactgggaatcaaagtttggcgtctttgtcaacaaggacaaaaaaactttggtgatttactacaatcccattttctatcaattttggaagtcttttatttggtatatgttgtgttagcatgattccttcaaacaaagcttaattttgaaactaagttatgtaggatttctccattcttaccagtttttagaaaattcatcaaatgacttttctctctaaatatgaaaaagataagaactgatttgattcctaacagagaaacttatattttacatttatcactactatctttggggaggatgggacagatttggagtgggacaggtgcctttcagagagtaggatctagagtcatgaagacttagattcaaatcccagaatcccagctggattcaaaatggttgttctactccgcctctctcagcccatttcatcaagtggaaaatggccatcgaaacagttcttccttataaggtttaatgcagattataaagcacttagtagtccctaaaacatgactagtgctcattctgttacctcttgttgctgtttttctgctggctgaaggacatggtaagaaaggcgctctcagaaaagccctctctggggtcacctcagaaactcagccttttggcagctaccatctggggtatcactgaacaaggtacaactccatgtgtcagatggctcagtgtctaatcttttctctgtttcagatctgttttagcagctaccttgaaagtgatgggagaattatggatataaatgtctccctgtaaaaagaaaattacctttttattattaagagttcttttccattttccctacttgtttgaaatcaagacaaaagcatgcaatagtctggtacatatcaaggtctttgtcacaatgatatatacatatgtgtatgtatgtatataatttaattaatcatgtatggtcagctctccatacctgaggattcaaccaacccagatcaaaaatgtagttaggcctacaatggttgcatctgtgctaaacatgtacatacttttttccttgtcatcatttctgaacaatacagtataacaactatgtacatagcatttatattcccctgctgatactgagggatgactatatttaaaatactctttttgccttgtgaaattatcatttctcttttcatattgcataatctatggtttcattaccattaaagcatcaaccagaagcttctcaatgccaacattatatataaatattgtaataataacataaggaaaatcatatgcctaattgttacaaaatgattttgaaaaaatgtatcccaaattactaatttattcattttaattatgaaaaaactgatgcatacaaagtaatcctatgtaatatatatggaagttctaactcatcctaatgcgtatcctataaactcaccatacagcctaagacctagaacatttccaatgccccaggcccctctccaatcccttcccttcacctccccacccacagaggtaaccagtgtcctgaataattcatttattttaaaataaaatttgaaatgagatcatacgaatttaggtactagcttctccagggccctgggatccaggcattccaaagattctctccagactctcaggtaaaggtgtcagtgagagcccacttccctgagagggcaagaagtttgtctttctaaacacacaggacaggctgggcatggtggctcctgcgtgtaatgtcagcactttgggaggctgaggcgggcaaatcacttgaagtcaggagttttagactagcttggccaacatggtgaaacctcttctctactaaaaatacaaaaattagccgggcatagtagtgggcgcctgtaattccagctactggagaggctgaggcaggagaatcacttgaaaccaggaggcagaggttgcagtgagccgagatcgcaccactgcattccagcctgggtgatagagcgagaccctgcctcaagaaaaaataaaaataaacacacaagataaacgttcttatgctgtctaaagctgcaagaagtatacagtgtgaacaaagaattctcatcaaaataaaataaaaatacagaccaggtgcagtggctcactcctttgggatcccaacactttgggaggctgaggtgggagaatcacttgagcccagaagtttgagaccagcctgagcaacataggaagacctcatctctacaaataataataataaaaaaaatagctggatgtggtagtgtgtgcctgtagtaccagctactctggaggctgaggtgggaggattacttgagcctgggagttcaaggctgcagtcagctgtgagccatgattgcactactgcactccagcctggacaacagagggagaccttgtctcaaaaaaaaaaagatgtaatgaaagctatccaatacttatattgaacctctctcttttgccctatggttttctcattggccagcaggagtgacagatctgcatttgcagctgtcatttggtcaggtggaactggcagacagaaatgatgacttcagttgctttcaagtcttccaaggaagttcttgacctttattatcccaaaggtccctaaatggtgctgcaagaaagtaccacagggcatgaaacatgagcatgttggaccaatgtggtggctgtgtaagtgggctgtgtaagtggattctcattcatctgtgaatcaggttaaagaggaatcatgtgcatattttgtgaataaaatcagttctttccactagtttgctatctaatgagcactattcatcagcagtggaaaatcagtttttagcctatcctaaacctgcattaacgcagactgtttttgaatttttaatcatttattcaggaacattagtaaagtacaactttgaattatttataaataaagtctttggttaacatgttaaatatgtaagctacattccatggcttagtttttaagtactggagagtacaacttttttttaaaccttttaaataactttaaaaacattcactgacattgaacagcttaatttgttaattataaatcatttgtatgtattcaccatttgaataagcttctaatgttttgccagcatgatggaagttaccaggtaggtagacttaaacatttttcaaaattaaatttcttttaaggtattttataatttttactgggcttacttctagttgatctattttagtgagacctgacattgcatttgagatgtgtaccaatgactaggttagaatgtgagggcttattttccattttaataactccctacatcacatacagttcctttgttgggataaaaatctcagtaaagtacacatcggtcactataaatagcagctacaagcctgtacattcaggagagtctccagagtgtattttaaaccccacattgtttagaataggaaattcttccaatgttcatattttccattgtgggtgacatggactactatcccatgtcacatcttcactggcttctgttttcctgtaccatttaggaactcaactgacggtttccagcagattgttcaatatgtgctttttatttttctaagggtagcctgggtctttttgtccagtgggaattttgcatgcttcatggggctctccaaataaaagctagataactcagagccggcaccagcactaggtaatgaaagagtcctttatttctggagctagtagcactactgtgcccgcttagaataacagcagtcaacccattttttattcccacagaaaactttacactgttggaaggttttctggaggtggggggagactcaagagactaatatgaaaaataactgagcaagaagtgagcaaataaacaagcaggatgagatgatgggttatcaggctgattcaaagacaagaagcatcatcaggtctaatcacactgcatctttcccaaggcacaattggcagctacagtacatgtatatctctgcccacttcttccttgaacaattcttctgtttctctcatcaaaactgttgtgtagatcttgatctttttttagtggagtttcatttgggggatctaacattccctcactatttgtcctttgatgaagaagatgagaaaggacctattattaaggggcctcgcgcaaaagttgtgatgtagaaagaactgatatctgacacctgtctttcctgctactaccttttaagatcctttaactcttcctatctaagcaggagagtgtattttccctgagccagcatcttcatagcatatcctggctacctagggattatcattgctacagatgctcagcggcttttgaactgaacagaatgaagttttttttaaactctaggttgaggctggagagaaattcccaaatcctttagtccctaagtgcctcatgtcatataaatgatgtctcattgtggcattgtcagagctatggtagagctgaaatcagagacatatgcgcttcagaaaggtgtcagttttccatgagaactctgcctgaagtgcagaattacttctagaagacagattctggtgtccagttgggttatgtcatcagaaattaacatacactctctttcctacgttctctgaaagggggttggaagcccaaatcattggacccaggcttgtagagcaacatgtccaagagcacacagtcagtggcagggtcaaatctggaaaccttgtcattttctccaactctggcactttttttctttgcatcgtgtgaggccccactctcaatttattatcacattagagctaaatgtcctctaactcctgctgaagagactggcttttaaatcaaggataaaagaaaagacactggataaaagttcagcagatcagggcttccttatctataagagagaactaacacttctcagggtggctgagaaaattaagcaagatacagaaaaaatgtcatcgaaagtataaagggtaatgcgcatgacgtacgtttatcatgttgaagtgcctgggtgattacactggattcacttctatattaactatatgtagagttgcaggtttcatgctggtcatgtgctgtgtttcaaaggaattttcacacttctaaccctgctgccttatgctagctgactggctgtcaggtattctagtctttcagaaatcagatgctgagaaaacacaatgaaataaaatgtcacctgtcaccctccctagagcccgtcacctctggagagggcttaggacctcaattgcagattagaagaaccaaagccattttattttcccttttcctctagttgtgaattgaggagaaaatgcagacgatttaaaatcctggctttatcccaatcagaaggaaactgtgctgtgcttacgaggagaaccctactcccaccttgggtcttacgtcgcactttttacatatgttaattattatcctctattttatgtttatttgttctcgtatctgttttctccaccaaattgaaagcaaccgtagatcagaaactacatcttactcacttttatttccccaagaccagcatacaatgttgaatgaacactaacacttgtgtatcaaggcacaactgtgacaaatgtgctaagctacttgtgagggaggcagaaatgttagtgacactcgttgtgtcttctaaacactgacaccatcaatgcctctcctggggtttcatcacttctctgctgagccttcaagccattgcaatttcaactccatatcttttctccagagaaatgaagagatttatctcatgtatttttttgattattaaggataattggacctttacaacatagaattttgaccacttatgcttatttagttgcattgtggaggcaaatgatattaatatggtaagagtccatttccttttgttggcctatttactccggtactcaagcccttggtatatttgcaattagtatctgcattataaatcagataatcatcaaattacagggtttatgccaaacgtacaggagtccaacagtgaacaaactgtataatcaaaaatttctctaatgaaggatcaagcttgtggtcaggaggagtaaagtatccagttaatcccagaagaatgggcagaagtaggataagggtagggccaatctctggcatgtatttatcaacattctttctgataatagaatgtttagcatacaatagaatggagtgtttaacatacaagttgagttcaaagtttagatttcaaatggtaaatggttttccaatattgggatgtaatgatggaccaaaaaagaaaaagaagaaagtaatacattagagcccaatactttttaatcaagatatgaggacttaattatttttttccagtaaagtcgagcatttttataaatggtttatgctccttgagtggtactatttggaagaaggaggaggagtatttataaatggattttcttcatcataaaatataccctttggttaatttgttaacataaaatttgtaattaaaataaagttagtgaactggaacactcaaagtacgtaaacccagaagcacaatcgaatagcctcagaactgtatttcttaggtaagaaattttaatttttgattcttagatctactgggaaagagtcagaaggaaaggtaatttgaagttatcctagaaagactctgaattctaaaatacttaggagaatctcagattacttcagccctctctactttgcaacatattttagaaagctggattcatatttcacatcattggctttcaaatttgaagtgactgtcggctattttttttaagtatcatctattttatcttttgttgttgttgtcttcataatgtgttaacattaaaaagctttccagatggcttctggcttttaaatgagaaaattggatatttttactaaatattttcccttaaaaacctgccaggctggttgttattctataaattagtgagattaaaaaaaaggccccatttgcttttcctgttttaatcttaataagagcttgatttcactactcaataatgtcaaagtaaaatagcatcttaaaatggaaaagctttcttctcctactctatttctaatctcctgccttaggctaccatcataaagatacctaagattctacagaagagcatttctgataaatacaattcataagggtcaaactgcattaggtctcccagatttgaacaagtggagtccaactgtaatccacgatattagtgagtgtaaagaaagaatggccagtagaagctggccgcggtggctcacgcctgtaatcccagcactttgggaggccgaggcgggtggatcacctgaggtcaggagtttgagaccagcctgaccaacacggtgaggtctctaataaaaatacaaaattagccgggcatggtggcacatgcctgtaatcccagctacctgggaggctgaggcaggagaattgcttgaacctaggaagcggaggttgcagtgagccaagatcacaccattgcactccagcctgggcaacaagagtgaaactctgtctcaaaaaagaaaaaaaaaaaggaatggccagtagaagaagcctgcatgtctgccaagttcaagacctggtttggccctggggatctaggaatatccaaatgagacagaccttgaatctcagggttggttgagtttcagggtggtgacatgagatttatggcttgaatctcacagagttgtgacatgaaaagtattctctccacttggagaagtgtttcctcatgtctcccactggcttgggtaaaatattacctgtgatgatttcaccccgctttgctctgacttcacactcatgaagaagtcgctattgactacgcagcttcctaacatcctggcttggggaatgggaggtgccctggttgggaatgagagttctccaggcactgaagatggagagcatttattctatcttaattggcactagagaaggcatcagtctcttgtgcatctgtgagttcatcaatcttcctgatacctgtcgattctggacctcccaagatccaatttctggtgcagaactgttatgaatactccaaaaaaaaaaaaaaggccaatctttagaaacctttggaaaaacaagccaactgaccttggtgcagcgtctctactccatcgttgtccctcttcactccagagaaaaaatgacaagtacttattggccatctgctatataactaacaccctcctaggctgtatcaggtgcaaaagtggtggtaggaaataccccttccagcaaaaatgttacactgtaacttatttggtaaaaacaagtatatacacaggaacaatgaacaaataagactgtgtatttgtatttatccatattttctttctttcttttatttatttatttttttgagacagagtctcattctgtcacccaggctagagtacactggtgtgatctcggctcactgcagcctccacctcccaggttcaagcgattctcatgcctcagcctctggaggggttacaggcgcacaccaccatgccaggctaacttttgtacttttaacagagacggggtttcactatgttggccagtctggtctgtaactcctgacctcaggtgatcctcctgcctctgcctcccaaagtgctgggattacaggtgtgagccccgacacccggcaccatacgtttatttctatctgtagatcataatcaagtgctgatcccagtcagaggttattacaaaatataacagaacctaataaagtgttattatataatgtaaataataagcacaacacctaaagtatctgaaacacataatggattatttctctagcaataggagcaatatgctttcatccaggtctgaccaccccccaaaaagaaggaaatcaatattttttaagactttatatggtatcactggaaaaaaatctggatttcattccagctataaaagccatgtgtaaatttaatatccagatgcaaaaggtggacacccacaaataaatttatgattgtggaaatatttagacactttgaacaagagtggtacacactgagaattctgtggcttaggaactaatatgcttcctttgaagatttgaccttttcttctgcactagaattatctcctgagtccttataataatttccttcacaacctgtacctatgaacaacaaatctacattctaaaatatatcactatggcctagattcagtttcttatgggtagaaatcacattcttcatgtacacacttctttcctagaattatataaagcaggtattattattatcgttttcaccgagaccagaaccagaattttgtagatgtgcaccagccaccattcattcaagaaattgttagagccctgctatttccaagcaccgtttattgttttaaagatatgtttcaagttggagggcagaaaggagttagaggcatgatccttttcagatagaaacttttcaggaaaagaaaatagtccagttgtttaaaaaaccctggattttaaaaagagcttagagagtcggcctaagtaattggtgcaagacagtttaaacagaaacagggagtctcacagcaagttggctggaggagctgactcatacattgcaacataattatttcccaaataacatgcaaacaagagtgggctcaagctttctggtctctctctccctaacaagataaattagaaagaaataaagtcaaatccaggaagacttcatagaggtaaggcctggaactggttcttaaagaaccactagaattcagagaagcaaaaggagtaagagtgggcataggacttacaaagcaattcatttggagaagaaaaaagaaaaagcaaaaaccctggatatagcacaaaactgaatgaatgatctctctaagagatgctattatcaatgtgaaaatgatgttaggatgtgttaacaggaacgtggcaggaagcactgggacttcagccaggccttggtcagcttttattatgtccaattttggtttcccgtttgaagagttgttatagtcaggctgatattaaaaggatggaaaataggcattggcgtctagcctagaaaagacgagactaaaggatgacttaatacctgtggccctcctagagataagtaggtttctatttcagcaacaggaaatctagttcgataacaggataaattgagcgtgagagtgattaaacactgggaccttgatcacaggatgtcacctactgaagtatagttctttagctctactgctttcagagtactgttcactttctgtcttataatagaatttttgtatacatgtcttatctccctttaggactgcccttcttatctttgcatcccccacagcacttagtgcaatgacttgcttgtagtaaacattccaatagtgctacgcgaagcaaagcaaaaaggaatgtgctgggacaaaataaaactacatgctcaccattataagggcaataagacagtgtcacaacccaagcccctattacaggcctagagacagatgaggcaaagaataattaagaaacgtgtatcagcacaggccatgaagacgctggtgaagaaccactggaagactaggatgaggagtaaactgtgatttttccacagcagctcctgcattcaagatcacaggacatgacagagcaatatagtttaagtgaacacattcaacgccatggcaggggcaggggatgggagatgccgtcgtctatgaggggaaaactatgagaggccaacagaaaggaggaaagagatgctgcctttgaatatgtaaactcctttacctacattcctgttcaccttggggtgggggaacagctgtctaggcaagattttttgcctagttctaagagtacagagcctatgaatttcttcataagaaaatttatctccaacagccttttcaaacgtcccctttgtactactcgaactgttgcctccctagtggtagatttcccttaggtttatgtgtttccatagtaagtgaatggctctgtgcatgttatgtgtgtgcatgtgtgcgtatgcatgcatgcgtgtatatgtgtgtgcctgtgtgtacatgcatgtctgtatgtgtgtgcatgtgtgcgtatgcatgcatgtgtgtgtatgtgtatgtgcatgtgtgcatatgcatgcatgcgtatatgtgtttgcctgtgtgtgcatgtgtgtctctatgtgcctgcgtgtgtatgtgtgtgcatgtgtatgtgtgcgcatgtgtatgtgtgtgcatgtgtgcatatgcatgcattcgtgtatgtgtgtgtgcctgtgtgtgcatgtgtgtctgtatgtgtgtgtatgtgtgtgcatgtgtgtcataagcgcattagggcgtatgcacagcacttcccacatacctctcttccctagggaattgtttcaaggtagaagctgttcttaaacaactgctgcagactctaaagtctggaacagatcttgtggtccggtctcccacctccatgaagtaaagttatttttaaaaaatcatattttcttaataaaggaccaccctgtggtgggagctgttcctttctattacagtctgacctccctcaaaccttcccagcccagaatctctttgatgaaaaattaaacaataaagtgtccagaaacaaaggatactatgagtaatctcagaatggcccagactttcatttttcctagtaagagtcctgaagcatcatcaaattcatgatacctattatcttgctgaaggatgactggcccacttgttcatggtgccaatgaatagtcattagttcacttctcagagacaccagttctggcagctggacactgggtaccattctctgctatgcagtgaaagcacacaggcctgtaggtctctgcaggaccagaacactgtgcacaaataacctttagattgttatttctcaatcctcttaccttgcctctccagccccaggcaccaggtctcagaggactcttggaagcacttgcctagcccagccctgctctcagctcatgattcacttgttatctctatgcgtcttcccgcgttgcctgtctttcattggcctttgtgttcttcctcttcccagagagtgtctgaaccaggtccaagactcacttctctcttcactcttcccatgtcagtaccctaccaggtagcatgagctataacaccactgggttttactatcacaaactgaagacagacagctgcttcccaaatgcatgcccctaataacaaaggagggtgcgcgctgtttccctttccctcttttggcaattagggaaatagcctggtggacatcctgtgtacagctggcaattagcacactttctgtacatggattctgcacatgagtggaagactactaaattcttgctctcctccatggagaatactggccagaaagaaccacaatttttttttctaggtttttccattttatgaacctattctgaatatgccaaaaccatacctgtcacctcagaattggcgtggggggctggggaggagggaatcaggaggtgatagctttctcgcatggctgcgacaaataactagaaacttggtggctttaaacgacacaacttattctgtacagttctataggttagatgtctggcacaggtctcactgggctaacatcaaggtgtcagcagggctgtattccttcctggaggctccaggggagaatccatttccttgccttttccagcttctagaggaagtcacattcccaggctcttggaccccctctccatcttcaaagccatcaccagtctgtctgcccaccctgacagataagctcctctaaccacagctggaaaggggtctctgattttaaagagccatgtgattcattccagcacacctggataatccaggatgctctccccatctctatgcctttaatttcatcatatcgacaaggtcccttttgccacgcaaattaacatgttctcaggttctggagatttgcgggaaacgttattccacctaccatagaaaaccaccgacttttgtaagtaattgaagggaaaaaattaattgggcaaaattcggtagaaagagaagcagcagaatgcctcgatacatgtttctgtctcagttctagagcgagaaactcaggacaagtcagtgtatatttaagtcctcttgtgtgaaggcagatgtatctctacttttatgggtgtcttatgtgctactttcatcaatatatgttcggtgatcatatgtgtaatcagagatatttaaatgcatatatacataatgatatatagagataattaactttaagtttattaaactgtatttactctataaactatgacttcattttttgttttgttttgttttttgttttttgagatggagtctcactctgtcgctcaggttggagtgcagtggcgccatctcagctcactgcaacctccgcctcctgggttcaagcaattctcctgccgcagcctcccaagtagctgggactacaggcacctgccaccaagcccgggtaatttttgtatttttagtagagacggggtttcaccatgttggccaggctggtctcaaactcctgaccttgatccacctgcctcagcctccccgagtgctgggattacaggcatgagccacctcgcctggcctataaactacgactctgatgaccgcatagtatttaagcaagaaaacaaccaaaatgttctagctaaagtggagaccacttaacctaacccaattaaactttaagttgaacacaagagtagtagatgcagttcagctccatgacattgggtgagttgtctaaatgctctgtgctttggtgtccttgtctgcgtgtgacatgaagccgcagatctcaaagatctctttcattccgtgaaagcgctctcaatgtgtgaagttgactgcttctcctgctgtttaccaagagaataatcttaaccctacattgtggagatcggatttgttctcacttgacagaaagccagtcccacgagcagcttggtacccaaataccagtctgtttagtgctcattagagatgaagaaccatattcataagtcaagctgagacggagtgtcatctccagacagaatcaacaccaccccctcctcaggaactgggatttggctgctttccaagccgctgctgaccaggttccattgcccagcttggctgatgagatcactggcagagtaccatgggtgcagacggggcctgctgtttcaacatgttctcaggagggctcttgcccacatttcttggagaggtgtgagcaccaaacatgctgaaccatccagcccatcactgagcagggccatctctcttcatcccttttcatttggtttgcatttttatgtcatgctccttccctggataaaagggataagaggagtttctcagatttgatttctcagtgggaactgtttgctttggaagccacctacaccaatgctaattgagaacagagctcagaatgggagcctgagaactgcacccggatgaactttttggtgggctgatttctgttgatcttgtcagaattaggttgtatatgcatgtaataccatgatcaactattttccaaaaggctgagcaaatgcatcagtgtctttttcctttgaccagttacttaccttggaaaaattatttgtagttaagcatataaagtcttcatcaggaaaactactggagatcctggccctgactacccagcaataacatttctggaactcccgaagcaatcagtgctctctgatcgctaaacatgatgggcttctattagagagattacagtaaaaaataacaatcagctctctgatgatcctgtgaggagggaacgggttgggaggagtagatttggctgaggacaagcccagactttcgtcacagggacagaccaacgtgttaacacaaagggagaacacgggagcatcctgcaccgtgcatttcagccacagatcacatggcccctccgcgggcccagcccacgccctgaccgcccggcctggccaggtctccgtatctctctgccccgccgccccttcccaactgcggacatgctgggtggatccggatcgcatggaagacgcagcctggccgcgctctcccagtgagtcctcatttcgcctctttggttttttcctttcttttttttttttataaaaaacaaacgaattgttgtaaaaaaaaaaaaaaaaaaaaaaatgtgggagtgggaggggagaggaggagacaccaggcaggaaaggaatgcagtgagtgtgtgagtttcagacctgtctgaaactttctggtttccacttcatggttgctctgattcgctggcttttctcgtttccattttaatggtggtttgtggaccatttgccaggagtttatacctaggcacgggtttctccgtttcaaataccaatccataaagcattgtgtttctaaaggtctgctgttaatttagaccttagccctccgttcagaatgatccatttgcagggctcagagattttggctaaagcacacattgcccaatccttagagtaaacagccaaagccctcaatatactgaccatctgactaagacagaacaagacccagagcatatgctattgatcagggaattgttcagataacggactccaagggtttaggatcatgaaatcctggaatgttaaagccagaagggaggcctttagactctttggtgcaatgctgtctttcaataggcagggaaacagaaaccagaggggcaactcaacttaccccaaagcagacaacagtcggtagcaaagccatgtctttgtactctcatgcaaagggccgttttcacactggtgtttatgaggtttgaaaaacttactgggtcttgggaaaaggtaccgcacaagaattagaacaccaaatggcctttcagtaaatcttttccatttttgagagttttggcaccgattcagcatgacaattgttgttccagttgttccagcgtttgtgcaacagttaatcaaataaacagagaaactcatcagggtcctaaaaacaagacccatgtccattacattagcagatctcttggagagctagtttccgtaagtgtggttggttattcacgtgggagagctcaaagggactttagacgttatctgtatagtccagtgcttatcaaactttttaaaaaatcaaatttaatcttaaggggaacgctattgtataaaggagatgttctggttaaagaaaaggtttgggatctagagctcctcatcctcgctctactctgcagtcatagcccactgcacaattctacccctctcctcatccctcttctaccccacctccccaccctcttcatcaaaacttccttggaatcctaggtctccatggaatagttcagaaaccactgatctcattgaaagccttcatttcagatgaggaaactgaggcacaggaagggcttgcccagggtcacacagctgatcagcaatagagcgtgggatgctaggaaaagagcccagtctggctggctgtctctctctcaactcatggtcctgaggcttgtttccactccttcatgcctatgattctatcagtctcctttctctgtgtctctcttctctgtttactctgccatttcctggatttcaacagctattacctctcaccgggatggttgtcattgcctgccatctggtcctcggcctctgtctctctcccctttctgatccagccccctacagcccccacctatgaagataaagtccattctccttactacagcattcaaatttctccacaacatgccttcactatttcttcccattctgacttccgccagggagaatgttaaaaacattgtggggaaataaataaatgatgggcataattttaccagattctgcagaaatgacaaaagaaatgcacacagggatgtcgagatttgtaaaaactataggagtacctgatccggtgaaataagatcactcacagctccccaaactcagcatatacaagccaccactgtttcttgactcattctattccctacacagggaataccctcaccctcctgtttctgacctcctttctgttctgcaaggccctgatcaaatgctcccttcctctgtaaaccttcctcattcctcacttctctcactctaataacctttgcccatccttctattactagctttgtaccgtcaatcgaggaaaatgacgaggcaagtctcaatcattttaggaggtttacttgccaaagttaaggatgtgcctgggagataggtctatgcctttatctgaagatgattttgagggctccagatttaaaggggaaagggtggggatattgagaagtacacaattttcatctaagtgaatctgtgttttgtacataagatcacataaacaaagggggcagaggaaaaatgcggggaatctgcattttacgtatgataacagacaaaatggggtagggcgacactcagatatgcatttgtgtctggtgggccagggtgactgcacctataaagataagctgtccatttgcattgccatggtgaagttttaacagctctctaggaatgtccttgtggacaaaatatgggggaggcttgtgtagcttttcaccttgtagccatcttatttaggaactaaaaggggaaggctttgagtgacccagttcccggcttgacttttccgtttgtctaaatgcgttcggggtaccaaaatttaatttcctttcaataaagttattgttgaacatagctatcttccctcccaataaatggcaattcacttgagggcaggaatgattttgaatctttgaagcttcagcatccagaacagtgctgatgctccagaaatattctttaagtttcctattattgagtaaatcaaactcaattccccttagtttacctttttcatttgaaccgtttgaacacacaaagccttcactccttttgctttgctagacgtactaggttaaatgctaaaacaggtgctcaacaaaatgaattctaagttcctttgcatttccatcagataatttatctctgtttcatcacctgtagagcaagattggctgtgattttttaatgagacatgttaaaattcctgaatgccaagacctacacaagggccatgttattttcaggagcagtcgtgaatggttgttcagttatttagatttcaaggcatgtttaatttgttcctaccaagatcactgagagattctgtcacttgcggtttaatattttcactggtacttttatcattttcccaaagcctaaggaagtttacttgcaacaagatttggggtttcctgtaaatatttgttttagtccataaagggttatttttcttatagagaagtgtgcttttatatatcttgcagctgaaagttaaaagttttttgtgtgtgttacattttgtaacaaacatggaagggtatgtaaattgtaaaatcatggagtcaaggaaacgtaggaaattatttagttcatcccactgttttctgagggaactgaatccaaaacagtgctgggaaataaataaataaataaataaataaataaataaataaataaataattggcacaatttttaaagattctgcagaaatgacaaaggaaataaacataagaatattgagatttgtcaaaagtttaggaatgcctggcttattcaatgttatcaggaaatgtagcattataattatccaggatgctaaatttggttttatatatgtatgtgtgtgtgtgtgtgtgtgtgtgtgtgtgtgtgtgtgtgtgtatgtatttagtggaaactctttgccttcattaaagcagatattacaacacatttaaaacattttcaaattgctaggagctgtccttatgaacatagttttttaatcatgctgtaaaacagtgatacctcaggggataagactcccatccaaaaatgggtccagttattatgtgatgtcttccatcacataatattgatgcttttaaatctcttctaatacctattaatgcatctgcctgtcatggtcccgctccctgttctgctgtagccaagagtaacaggacacccatttgttagaattacgttcaaagtaaaaatcaacaatctggtgagagaggccttctctcctacaaagtaatgggcacttacattttgtgactattggtttgtaggccaaagtgttaaatatagtgaacttccagtttctcttcaaagaatcagtatgtcagtatgttcagctttcttattttttaattcttgatttcaaagtttaacttcctggttctctctgcccacttgcttctagtttcagtaaacaactttcccaccagtcctattcagtaggttcacatctgttcccctggtcacctgctctgtcctgtctcatcctggtcacgtgctttgacctgaatcacccctggtcacctgctctgacctaagtcacctttggttacctgtttctaaccatccttcccgccaaactactcaccctgccactctggctcatatccctgccctctttaaaatagccagtcggaactggcttagactgtgcggtccaaccctagccaatagggaacaacacagcagtaggggccgcctgcatcaggaataagaactcctgcccctcccctgtccaggtgtgctctcgccattgttccatcttcgaggtgcaccctttctgcagaaagtaaattttgcctttctgagaaaattgcatttatgttccagtgctatttctttgtggcactgggaaacaagcattttgcatttctaacactgaccaattttgtctactttttggttcaaagaaaggtttcaaatgatctggaccctttatctggttatggataaaattgctactgctgtttatagattaaaaataaaaaagaatggcagagaaataggtcactgtgctttgcatgtattgggtactcttctatacaagatattgcagcactgcacgagcagtggtgattatggaggtggtcttgaccttctgtatatgtgtcttctctacaaatggccagcccacccacactcacactggttcaatacctggtggccacaagcctttcaaacctattgaacagcaatttgcattgctgtctgcgtttttccctctccttacctttgatctattgatccttgaaatgagccctgcctatgctgcttctcacattcctctcagcccatcaaaatcactttatagagacaggcctaacagtggcaagaggaatgagaaatggggaagaggtcctctgtcctctggaggcgaacttacccctggcatttttaatcagactagtgaggatccgtttccctatagaaacacagcttcgtttctccataccagcttcagacacaccttgggtttaaaaaggtggttgtaggctggtctgagagcccgactaccatgtgtcatgctgttgaaagtttcaaaagccaatttacaatgaaggtcttggaaacaacctcttcataaatgtagtgctgcctggatctatttccaagcctaattgaatttttaagaggagtccttagaaaatctgtaaacctcattcatttccagtcattcattcagcaaatactcattgagggtttcgcattctagtgaatactgctgtactgactgagcattaagaacatcaaaaaggacaaagctcaggctctggcctcaagggttctgttgtcttctgacctcccacccagcttagcattatctacatcagtgttctcagttttcattttttttttcctgtgaccttctgaaataaatgcattttattttgtaaccccagtacctatatacaatatatatatataaatatatatatatatatttgaagcaaatatttcacaaaacggtgctcacacttgctgtgtacaaagtcatctgatattttctatacgattctatttcattttaaaacgctggtcatccactaaatagatttcagaagctgcagatgggtcacaaaccgaagtttgaaaaccactgaacatatcacatgaccttggtatctctggtccctgccttcagggcagcttaggaagctatgttggctggtgacaacccaggctgccagctacaagggtcagcatggaggttttttgttttgttttgttttttgttttttttaatctaactaattttgttttttcaagggaaggtctctggtcactcagtctggagtgcagtggcacaaccttggctcactgcagcctcaacctcctgggcttaagcgatcctcctgcctcagcctcccaagtagctggggctacagatgtgtgccaccatgccctgataagtttttgtatttttttgtagagatggggtctcgctgtattgcccatgctggtctcaaactcctgggctcaagcagtcctcccacctcggcctcccaaaagtgataagcctccactatctcggctcactgcaacctctgcctcccaggttcaagcaattattctgcctcatcctcccgagaagctgggattacaggcgcccgccaccatgcctggctagcctgggggtttaagaaaagtttttttggatgggagtcagagggtctggattctggtctaactccttcagtaatcagtactgtgatctgcagcaagtcgcttcaacttgctgcgacacagctatgaagtggagatgctgatgcctgttctgtgtaattcacagggtgagcaagaacatccagtataataatgtgcattaatgtgtgcagaaaaatattaagtacagagcaaatccaagttattattaaacagtcttacttttacaattaaaatttaatatcagaggaacaacttggagggaccatttgttctttgtagatctgggaaaggattcttgaacaaggctataatatgatgcaacttcataaatggaaatctcagggtaactttttttgtgatattttaagtagatttgaattgaagaaactcagccaagttatcctggtccctcttcccttaaatacttttttttttggttttattttttatttttatttttttgagatggagcctcactctattgcccaggctggagtgcagtggcatggtctcggctcactgcaacctccacctcctgggttcaagcacttctccagcctcagcctcccgagtagctgggattgcaggcgtgatttttgtatttttgtagagatggagttttgccatgttggccaggctggtctcgaactcctgaactcaggtgatccgccaacctcagcctcccaaagtgccggcattataggcgtgagccactgcgcctggccatttttctggttttaaaatcaaggaagcaactaggtggttgttgggtttttaagtcatgaacctatttgtaaaggagcgtgctttgcctgatattatctactctaacccagtagatttataaacactaatttctactgttttaagaccactttttattaaaagcaactaacagtaaataaaaccaaccactaaaagagataattttatcaagaagggtttaaaacaataaacttttagatcaaatatagtactttcctcatttatctttcacttttccttttgtaactatcctagacctcatttcacacatctcacacagacattggttagaacaaatgcttctttctttttcttttttttttttttttgagatagagtttcactcttgttgaggctggagtgcaatggcacgatctcggctcactacaacctctgcctctcaggttcaagcgattctcctgcctcagcctcctgagtagctgggattacaggcgcccaccaccacacctggctaattttccatttttagtagagacggggtttcaccatgttggccacgctggtgttgaactcctgacctcaggtgatccgcccgcctggccctcacagagtgctgggatttcaggtatgagtcaccgcgcccagccagaatgcttcattcaaggcctgctgaattcctattcggagcctaacccaccctagagctgtgccttacaggctagctctgcctgctgcattagctccctgtgtctttccatgtctgtttattgatctttcttttttgtttttgtttttgttttgagacagggtcttgctctgtctcccaggctagagtgcagtggcactatctcagctcactgcagcctcaacctcctgggctcaagcaatcttcccacctcagcttcctgagtagctaggactacagatgcttgccaccactcctagttaatttaaaaatttttttttgtagagacgaggtctcactatgctgcccaggctgctctcaaactcctggactcaagagatcctcctgcctcgggatcccaaagtgtagagattacagacatgagtcaccacacccagtctgtttgctgatctgttttaaaggaatgtctacattcaccttttctaggagtcagttctccaaatcactctacctttcactttgtaagtaacggtggggaagaataaaataacaataaaataaaataaaaacaaaactatattcactccaaagagaagaaaataattcccttttgtcctttaaagagtgaaaatattcattacacaaatcagcaatgtccaccaaaggccactgctcatcagcacttagtgtagtttccagagaaaacatctaaaatgcataaaagttaagcagtttttgtatacctagcttttagctgatttcatgactgctgtatagcttctttgtagatagtttctgcagctgtttcatgaatgttatggtatgcctgcgaattgaattgaaaaagactgagttcacacggcttttgaatcagtaagctgaagcccagaggggttaggtacattggactggaagcagaagggatggttttaaagagcagctggttgttcatcttcactaactggcaggcagcctttctggggtgtagctgcgctgcaggttgcacaaaagagtctcaacgcccctcctgctacccaggcctagccctcgcagcactaaatgggtacattcttgacaaataagaaactggggcccgatatgctgattcccacatctgtatttagatcccactcatgacacagtgtatgaccacaagcaggtcacttaatttcactggcctaagtttctccatctgttaaagacatctgttgtctgtcttataggtgaaaatgaaaggaactagctatgcaaagtatataaaccacagtgggtgcctgatcagtgtgacatttccatcttttccctttccctctgaacattcccctccccaaagacccccgaagagaaatggcatgatatcttctgccaacaaactgatagacgccagggtgaaatcagcggaattcaacttgtgattggcatgcatttattaaaacatccttctgctttcaggaaaatcagagctctttatttcagatggagttatctcgttggcttactatttaaaataagaatttgtaccactatacgttggctaactctgatgttaaaggaaacttgctgaaaactgatttttgttttggcaaaatatagaattactacttttcctggtgggcctaagccagattcagtgccaagagggaggtagggagaagtagggttttttttttttttgccagcagatgccatcaatcttgaagtattctggacaagtgaggagagcataaattaagactattgacgtcaaaatccagataaacttgaatccaaatcctagtctcatcattttatcaactatgtgcccttgagcgaattactgaatctctctgagtttctcagctgattgatctacaaaaagaggaatatacatgtaaagtggctagcacagtgcctggtgcttactcagtgctcaaggggtgggaatgggggaacgtaggtgtttcacaataattattgccatgaactgggtatgtaggagatgaatctgggggagcttctgggtaatcacaaaagcatgagtgactgtgatgagttgtattagcttctgagggctgctttgcttgtaaagtacaaagtactatgagccgggtgtcttagaacaacagacacttattgtctcacagttgtggaggctagaagtctagaatcagggtgtcagcagggccatgctccctctgaaacctgtaggggaggatccttccttgcctcctgtagcttctggtagccccagatattccttggcttaggccatcgtaactccagtgcttccataatttcatacggcattctccctatgtctcttcacagaggcttccctctgtgtgtgtctgtgtttgtgtccaaagggcaccagccacactggattagggctcatcctaatgacctcatcttgattacatctgcaaatattctgtttccaaatcaggtcacatcctgaggtactgggggttaagactttaacatatatttggaggtggagtatacaatttgacccatcatctgagtatacatacttctagattaaatgcaacgagcctgggcattacctccacattctaaaattgggcacaatctccacacattgggcacatttcttgcaacctagagaggcctattgtgaaaaatgatattgtgatattggttagctttctaagtgaatattttctcgtcacaaaagagcaaaagttccctagactcaagcgtaggcagggactttctttttaaccccactgagtgaaaggcaaccaggaagtgtgtgcatgtccattcaccccaaaggaaacagccttgcatcatagacagagccatcccaggtctacataagttcataccatggagaatatttttcctacttgctttccctttcctgtatatatgttcaaatgtctgacattaatgaaacattcagtgtgatccagggaagtatcatgagtctgtttttcctgaatctgaaggttttggggctgggagggagatcatgtaaaccaccccctactcccaggaaatggagtggctctgtgatccagctacccctgggagcctaggaaggcttaggtttcatgagcccacctcggagctacagggaaatctccatccaagatccccagataccagaggacaaaaggaacacagcaaagggaaaaactgaacatccaagagaataaatttacaacctacaacagaaggcatctgaaaaagtcaggtggactgccgcttcagtgtaatgaaccactcacctgaataaacagtacaaggtgctggaaattgtggaaacatgattattaacaaagtagaatccttcaatccttaaactgactactgtattactttcctagggctaccttaacaaagtatcatgtactctgtggcttaaaataacaggttgtccttcaataggtgaatggataaatgacttcagtggatgagtggataaataaactgtggtgcacccagacaatagaatattactcagaaccaaaaacaaatgagctcttaagccatgaaaagacatgcaggaaacgtaagtgcatattactaagtgaaagaagccagtctgaaaaggctgcatactgtaggattccaactatgtgacattctgaaataggcaacactatggagacagtaaaaagatgagtggtttctaggcactagggcaagaagagagggatgaataggcagagcacaggggatttttagggcagtgaaaatagttggtatgacactacatttgtccaagcccattgaatgtacaatggcaagagtgaaccctaatgtaaactatggactttgggtgatactgatgtgtcactgcaggttcatcagttgtaacaaatgtactacacttgtgagggatgtttataatgggagaggttatgtgtgtgtgagacggaatatatgggacatttctgtatcttcctctcaattttgccatgaatgtaaaactcctctacaaaaataaaatctttaaaaataaataaatcacaagcagggttggttccttctgagaaccgtgaggaagaatctgttccatgcctctgtcctcacttctggtggtttggcagcaagctttggcatttcttggcttgtagatgcgtcactccaatctctgccttcacatggccaagattgtctccctgtgtctcttcttagcgtctgccctctgtgcaggtctgtctgtgtctgaagccaaatgtccccttttgataaggacatcagtcatattggattagaacccaccctgataacttcatcttcactcagttagctcggtcaagtccctgtttccaaataaggccacattctagggtactgggagttaggtcgtccacatatcattttttggaggacacaactgaacacatgacaaatactgaaagatttaaaaattgtaatgtgcagtttcataatttaatccataagcaataagtgggataggctaggcatggggcctcacacctgtaatcctagcactttgggagtctgaggcaggcggatcacctgagatcaggagtttgagaccagcctggtcaacatggcgaaaccccgtctctactaaaaatacaaaaattaaccagatgtggtggtgcatgcctgtaatcccagctactcgggaggctgaggcaagagaatcactttaacccaggaggcagaggttgcagtgagccaagatcatgtcatcgcactccagcctggggtacagagcaagacaccgtctcaaaataagtaaataaataaataaataaataaaagcaataagtgggataattattgaatacatttaaaatgccagctggccatgcatggtggctcacacctgtaatcccaacactttgagaggtcgaggtgggaggattgcttgatcccaggagtttgagactagcctgggcaacatggtgaaatctcgtctctacgaaaactaaaaaaattagctgggcatggtggcacacacctgcagtcccagctactcaagaggctgcggtgggaggattgcttgagctgggaggtcgttgttctcaccactgcactctggcctgggtgacacagtgagatggtgtcttaaaataaaaataataaaaatcaataaatgaaatgccagctggctgaagtttgttggggcagggaggacagctgggtccttccctcacaggtaaaaaacctgtataaaaccattgggtctagggagcttttgcctctttgtgatcaggaagtattcgcttcttagaaagctaactaatctccctgcatcgagctctgatccatcaattctccgtgaagtctgggtattaaaccagccccaaagaagaacagaaaaggggattatcctcttccactaggacacatgccttttctggcatgggaagataaagctctctgatgataaatttccaagtacattttaatgagaaatgacatggattaagaaagagatagagaaaataagagatgaaaggcattctatttgttggacatttttagccacagttctccttgtacacccctcaaaaaagaaagagaaaagtaatcaacagggaggaacaagggaacacaaagaggagataagaattttcttctacatgtattctgcgtttctcagccttctgtggtgttactatcatcaatgaaaaggcatttaagatccttaagttagaaaaatcttttctgcccaattccccacttcttgtttggaaacaagaacatgctctgcaagacctgtaagcacagatttaatttccatcatgatgatgatgataaaattttaaaaatggtgaacattcatatagtactaactatatgccaagcactgttctaagtaccgtgcaactattagttcatttaatccttacaactccactatgacttccgtggttagctaataatgtgttacctccatttgcagatgaggaaaatgaggccagaggggttcactcacttgcccacttcctccctgcttggacgtgtgtaagactggtgcctggtttttggctccaggctggctcctggtggctcccctgctctctccagcttagcatttatgaaagttattccctgtgttttcagagttctaaccgctagtctttgagtgggtgaatctggcagcagctgtgttattacatcagatcctgcttgatgagcaaacttctcctcctggaggagcagggctggagggctggagaggaaggatctagcaagagactttgagttctataactctttcccttaaatatctagcccaggggtctaaatactgctttacaggccctaaaaagaagtcatgagtgtacctctttccccagcaggagacatggacttccgtataactagccaatcctctaactccattgttattaatctcacatgactttgtatgccaattcaaggaaaagaaactcggcataattttggacctctctatatcttttttttttttttttttttttgagacagagttttgctcttgtctcccattctggagtgcagtggtgcgatcttggctcactgcaacctccttttcctgggttcaagtgattctcctgcctcaacctcccaagtagctgggattacaggcacccaccaccatgcctggctaatttttgtattgttagtagagacagggtttcacaatgttggccaggctggtctctaactcctgacctcaggtgatccacccacctgagactcccaaagtgctgggattacaggcatgagccaccatgcctggccggacttctctatatcttaagttctaacccctgtcctgtcaaagccagagaactgagacctggaaagaaatgaatgggctttgctgtcgtgtaaagagcccccactttggggttggctgggtgatggctaaaatgctgtgtgtataatcctgggcaagtgatttgacttctctgtgccaggtttgcacatctagattgtaaaatagagcaatcatgtctattcaatgttgttctaaggatgagatgagatgcatctgcctggcaccttgtaagtcctgcacaaatgcaaattatcactgttaagtaagcttcaccatcctgtaaaacaatctgtttgactcacttattccaagtaagattggctggacctgtacattcttctttatttaaaactatcaatgttactgttcatttttaaatagacagtggctatgatttttagtttttttagccttacaaatgagaaacctagaacttcaacaagcagtaaaattgagcaggttaggtattcctcactagcagcataaacccagcagggtgaggtgattcctagggcctcctatagtctcctagcagccctgataccctttgtttacgggtccctgggggaagttgaggacttaaagtctctctagtaggcttcagagctccttatttgagcagaactgtgacatcttggagaaagaagagaacaccaccagtcagaaaagcccacaattgtagtggtgtcccggttctgaatacaagttacctaacgcctctgagccaatttcctcaactatgaaatagaaataatagtgcccgtctcacagatactataactacgaagatcaaattagatcgcatatacatgatgaaagtgttctgtaaaaagttgccatctgtctttgcttggatggacctgagttcctgagttggctctgaaaacagcttaccacgaaacaggataggattagtgggacagccttgctgacacagatcataacagggagatgtctcattttgacttggaagttgcactgatatcatagaaaataaaaaaaccaggtttaactgttggttggtaccttgtgagaagaggaagaaggtgataagaactaagatcagagcatagtagagaaagtagccctgtaaacagaggagaagcagaaagagagaagggaggacagagcttttattttgctccaggttaaaaagaaaaaaaaaaagcacattacaactctatgttcaggtgtctgtcccaggtcctagaactggaatagaccaaccaagcccaacccttcttaaaagtaagactaggtgcttcctgattatatattcaactgcctggaagcatgcaagtaaaatttccttgatggcatttctaagtttcaaacatattcttcctaaaaatgcatttacaaaaaatattaggattgtgtttttttggtttggactttaaaaaaaaattgttttcaaaaccataattgtggcctaccccaaatggattctcctccctacagtgaggatttcatttttccagtcccccaccgccttttcatttttgatgaactgcacatgttgtgggagccactggtgggccctcagacacgagcaatccttctggccactgccagtgtcctaataagggaatgaacaagcgcctattggtgagggaaggggagtcaggcggtggatgatatttttgctgattaaagaggataaggtgtggtttggcaggtatctcattggtttggctggctccagacctaggttttttctcttttttcagtttgaattctgtagaacagactgctaagaattgttttttcacagatctctaactgagctttaggaatatcatgctgacacagtttatctatgttgaaaaaagataggaatttggggttacatgatgttttcattaaaagaggttgaggatataggttaaaatcttctcggtcaccaggcgatgaaggtgatactggacttgatcaaatttagtcatggagagaacaagggatataccattggatatatttaacacatgtttaaaaagttttaaacatttatctatgcaacaatattaagtaacacctacttttgcttgtaaatatttatattctccaattttaaaataataaaagaaacaaaaagagcctggcacttaggatcatagtgatgagttgctcatctatttcctgtctgatcactaaatacctgccagtgactcctctctccactctattttctgaatgactcgacactgccttttaacttaactgcatctggtccacagtgttcttaagtcactcattatacgtcagtgtttctcacatgagctgcaggctggaatcatttggggagctttcaaaagttctaatgtctagatcagacctcgagcaggattctggtttaattgatttggggcatggcctgggcatcaggattcttaggcacttctccaggcaattctaatgtgcagctgaggttgaggacctcgagaagcaactgctactctgaaatgcatcctctattggatcatctggcccggtaaagggccaggcagtttttcttcctgacattttgaaacctctcaagaaaatactatatatatatatatatgaaacaagttagacaggtttcctcccaagttggtagattcagttcggttgtttaaaactcaacagtagagaattgtgctttcaaccaaaatcaacttctagacacatgggtattgtttaaactttattttccatgcatataaggagtgaagtactctgccaggtagttgaaaacagtatccatttcaaagtcataagtaatgagatgagattttttatattttctctgtgtccctgcaagttattcatcccttgatatttaatttagttaatacatgcctcttattttactttttcttataatattaagccaacttcacatcctggaattgtgaaattgctgtagcaaggataggatgatatgatcgagaagtttaaaaaaaattttcagattatcaatttttaaaagtaagaggatatggaagtgcagtgcctgcatggagagaagttttgaattttgaaagaattttggattaatcaggtgtctagaattactcattactctcagcttccttactggatatttcattaccaaggaagaaggccatttagaaattcaggagtgcaaaggctgggcgtggtggctcacgcctgtaatcctagcattttgggaggccaaggtggatggatcacctgaggtcaggagttcgagaccagcctggccaacacagtgaaaccctgtctctactaaaaatacaaaaattagctgggcatggtggcaggcacctgtaatcccacctacttgggaggctgaggcaggagaattgcctgaaccggtgaggtggaaattgcagtgagccaagatcacgccattgcactccagcctgggagcctgggtgacaagagcaaaacgcagtctcaaaaaaaaaggaacttcgtttggaagtgcagactgagctgggaatataaattagagaatcctcaccttaaaactgacagacaagttataaacatagatgatattatccaaggagcatatgttggataggagaagaaaggagttgaggaagaaacccaataaaaggtacaaaagaaactacaaaataaatttaaaaacagagaatctcaaaaagggagatgtggtcaacagtgtcagagctctctgtgggatcaagtaagattgagagcacaaagggacattggacaatttgtctcaaaggacagcttagaaagcacaagcccataacacaatgtcattttggagttagggctactaatacctggatcaaaaatattgaatatagtcaatatagtgttccgatatatttaataatgaaactgaactgttcttttgatattttgatcaactggtcaagtgattaagatgtctggaactaaaaatcactagccccgtagagatccatctcaagatgattttaggtcaactaccaagtaggttaaactaactgataaacctaactccaaaattgaatgtaaactgacaagacagcccgtgatagggtggatttaactattttgggctattaatgacttatccattgaatttcagaaccagttttggctacagcacatgaaaatatttccaaaggactgctaaatcaaacatgctcagtttacctagttgtactgagttctttttgcttcccacagacattgcaaaaggccaaaactaacactaggcttgatagtgaaaagagaaagaatataagaaatttgcaagggaagatggtgcaggaggagttatggaggtaaaaaggcatgtgctggagttgcaggaaaatatagaactgctctattcatgagccaagccaaggccaatcacatgacaataaaaaagactgatggcacatgcacacacgtacacacacacacacacacgctcttgaagcaggccaaagtccacagtctcactggaaaacaccagttgactccgtttgactttagcacctgatcattgactaggttcaaaagtcaaatacttttcctgtccataatcacttggtcttcttagtaagtaaaatatccattttccagctctgaactcaaggggattttctgcatatagttgcaacataatgccatctccagagaaagtaacatgggaatgagaagcaaagaaatgcattaaaacatttgcattctggaccaatgagcaaaatgcaccaagaacctacctaagcaaacactggcaagaaagtttgtggctagtaattgcttctgactattggcaggaaggaattgaaagaagtgcaaagtgttgggggttccatctcctgtatttttttctaaaaattcttctgtctccaagcctagcttttagtaggctgccgccgccactcctcggttggtttaatatggttttgtcatgatgatgaaactgaaacctgagaggtcatttcctttttcttttttttttttttttttttggtgaatgatcaggcttcaccttctggaactgatggtcagaaagcgagccctgcagcccatagcaacatggcagcaggtgtagccaggtattcctggttcatatccatgagccagtatgaagtgtctgcttttaaagccactcacaaaacttccaacagagtgtatgtgtgctctgtgtgtgtgcacatgctttggttttggggatgaccttctcccgcctctgttactgagagaagataaagctgtaataactttaaacaccatttttgcagtaaatactcataagcctagcatagaattgtcagcctttccctacacatggactggagtcatatttcattgatctgccttttaaggaagcactgttgttctgtatatgacactaaaacttttaagtcttggagtatttggcctttccatgttctgatttagatgaatccacatgagcttaggcagttcacctcttattcaggtataggttagcctcatgatggctattgctttgtgttttaatgccatatgcctttcttgactgcagttaactaaaaatacttattaaatccctgctttatgcaaggcactttgagaagggtgctaaaaatgtataaaacttgacttgctttcaagaaacacatgccataatatgagagataatacacaaataacagcaatagagcaatatgtgataaataactggaacaaccacagagatttcagaggcattaaagagctccttctagttgacttccatgatggaagaatgtagcatttgagctgacattgatggacagataagcggggtctcggtaaaaatggagagaaggaaagaaccacttaagtgtaatcaaagagagcaagagagtataaaatgaagttgaaagaaaaagaaagaaagctttactgatgttcgttatgctttctggcacgagcacctcccctcaatttccgaccccatgtgactggtcctgagagcatcacacaaaaatagtgccctggaaaaatggaacatgagtcccctgcacccccagaggggagaacagtggggccttcgcttggccctgtcttttcagcattctgtgactcaaggcagtttacttgactgggtaaatggatttaccagtggtaaaccttatctagtttaaacttcatgaaatagacctgtactgagaaggatttctgcagaagcttcaagcagaggtaacactaataatgcaaacccaaggcaacgctgacacttacacacggagaggacactaatgcttgtgaacgcagaccagtgcgtcctcagctcacactttacctgttcctttcagcaaggtgagtttacagcagagagggggaatctcactgcttttcagaagtaactcatgagagaacagatcttttggaaaatggcagcatttttttgtgattttgctggtgaaaaagatgtaaacatgtaacctatcaagactatcatatcttcatactccaccttggaaacattttctaatgtatttaaaaatctccccagtgaagaatttcagtaggttttgaaactatttatttaaaatgtaaaattgaaacaccttgggattactttgaactggaacaactgattgacatcaggacagacaatttttgatacaattttctaggcaaattgtatcaaaaaattgtgcatggttagtggggcagatttaagatattagtactgtgcttccacctgtcaagccaattatgtgtttctttgtatatctttggggattaaaaaaattaagcggggctgagcgtggtggctcacatctgtaatcccagcactttgggaggctgaggcgggtggatcacctgaggttgggagttcaagaccagcctgaccaacatggagaaaccccgtctctactaaaaaaatacaaaattagctgggtgtggtggcacatgcctgtaatcccagctacttgggaggctaaggcaggagaattgcttgaaccagggacgtggaggttgcagtgagccgagattatgccattgcactccagcctaggcaacaagagtgaatctccatctcaaaaaagaaaaaaaaaattaggctatgactgtcatttaaaactaaatgcctaaataaactgaacttagaaccagaccttcacattatcgattacaatgcattcagccaagatgtttcaaaaataattaaagttttatgaacattaatagattaaatttaacattactttaaatgtatctttgttttattgtcattctgtccttttaaatttctgttcattgtgttttgtaatgtctacaaacatttaaataacactacatgtaatttataaatgactatacatatacgtataaatgtatatgcatacataaatgtatatatcagtgttattggtgcatgcttaatttttaaaattgattgtagtatagtatgaaaagtcatttagaaaccattggcttagatcatggatcaccaaacttttttgtaaatggtcagatagtatatattttcaaatttgtgagccatacagtttctgtcataataattgagctctggcactgaagtgcaaaacagccatagatgatagaggtgtggttgtattcctataaaactttatttgcaaaaacagagtgggctggctttggcctgcaggtcatagtttgccaatccctggctcagatgactgaagctctttgttagtctccagggcaccctaagaaagcttcctattgtagaaagaaaacaggtataggaacttgaagacctgggtcaatcctgattttgtaattacttttatgagtcatttcacctcttagatcccaggttaccaagtataaaatataaagcttgaattcgaaataatgtcaaaattccttctagtttcattaatctatcatcttagatgctcactaccttgccacaagcagtggatttcagctgggctctgaatggaagcagaataagtgaaaatccaatttaatacgaggtgggcaaagtgagttcaaaacagtggagaaggtgacaagaataaaaaaggacagaaattccattctgaaaaatgtaaagtcacagcttatggctcttgaggggtcctccatggtgctgctgttctaaatgattgtaggacttgctcaactgaagtctcctcttgcagctaagatggatgggatccttgatatggggtagctggccctaatttcttttatttcttggggaaagctgcagagtgaaatgaaacacctggagtggagattgaaactagaaaatgtgtgctgcccttccgggactcccttccacagggccatagcctttggaaagagccttatacttcgttaaatgattggtctgctcttctcagttcttcgaagccatctttctgtatgtaccaagcacgattggcgcctcactaatgcccttcatgccttccaagccctagccagatggaattgtgtgcttttccataaccatatttcccgattctgcaaccttgctatttgagctttctgtacatggaaaggtcctctttcattcccccagctcccaatgctagccatcccaaaagagccagcttgaataccactttctttatgaagcctcctctgatcccttagctggaattgccttcttcctcctctaaactttaaatcactttaagtcttctgtaatatttaccacattctacctattatcacatccttaacaggtcttaacttccctacagattatgaactcctttcaggggttgaatttatcttggtttctgccctcactggcttgaatggagtaaatgttcaataaatatctgttgaatggatgtgctaattccagccacctgtgtgtccatttccaggttatagcagcaagcattacctaccagcatcccacaaccgcaagttcagactccaccttggtatctggcagatggttctgaacaatggtttgccacctcctcctcagaacctaggcccccatgcctcctcctcggaacctaggccttcatgcagcccccttgctgcccagagctcaccactctgatgacagttctgaattgaactgtccttgcctccaagtctaggttccacgtggatcagtcagggagaggaatgtataccagattagcaacccataagtcagtgccagtgctgtcactttgtaattcagaaatatgaactttttttttaagtcaagtcagtgatcttcaccactgaagcagttcctcctgtattaggtaacaagtttaaggaattaatgattacattggtgatctagtcagaagacagcataagccttattggttagtaaactaatctaaccaatgaattaggatggaattgccttgttgggatagaaatctgttccaggagagacaggaaccctcaagtcatttaagtgctgtagaatgtctctaatgctcatgctccctctctcagagtcctgattccctgagtcttaagctgttggtgattctaactcaatttgcacacacaaatgtgggtgcttagttatttaatattattctatctgttaaaacattcacatttttataggggtcttctattaactcaaagggagtctttaagcatagaagattctacttggtttggtttggtcaggctggctttttaccaaatcacaacaaatgggtgtttgcttttctccctccacattgagcaggccctgtgttaagcaaggtttccactgatttaggaagatgatctatcaagagcagagaagactccttgacttcttttctcaacagtagggagatgggacccatgagcagtggttgactgccaagtcccctgcaagaataaatattctcttcaatgggcaaagcatccatgatttggcccttcatttcccatttcctgtctccactcaaggtttgtctttttactttctgccacttgtacacaaagctctccaatgctagcacatggagtgggggtatgagccaactggatgttagataggtgtgtgcaggacctctggagtcaggcaggtagggttcaccccattcttgttagaatggcagtgacttcttccctagcagagctagcaacaatgccccagtgtcagatctatcatatattacagtttcctgtctgaagaagagatgaggggtacaagagggaggaacaagatgggaggcaatgccactcgagtggaaaggagccctgggaaggaggaaatgaatagtaaatctttttccaattaagaaaaatgagagtggaagcagaaaagctccagagggcacttttaggggagggaaagatcataaaaggcctgttatgaaaatctattacccataaatttccccacattaagcagagcctgtctagagaggatgctgagaattcactcagctgacacaagatatgtgacttgatttagtggcatccacatgctgtgtaccgtttccattggcatgtctgcaataccactttcccttgcagggatcccctttaattactcgcaggcttataatctccatttaaggacatcttgctttcattttccaatcgctttatgtcttttgtcagatgtttaccgatgtgatagtggtaccataatttgaagctcaaccacatgagattatggactttagtattgcatcacatgaacatttcagatttagggatgagtcgaacttctagatcactctaaatataagacttatctaaaaggagttcatattttttacatttgaagacgacagtggaaatttctctttctaggtgattgtcttcagatacgaaaataatgtgcttgtttatatacctgtggtcaaatgtcattgcatccaacttagccagtagaaatgtgagaatatccctacatcctgctctggagcaggtgtgattcagttgcatatccagatctagacctctatgcaagagaaagagctggaaaaatatagtgctgccagccatcgacacctgggtctgaactgtttcctaatgttttactttttttaaacgactaagcccaaggtttattgtccacatctacgatgcacattaaagcaaaattgtcctttaatagataatagcagtcaaagaacagctccaactcagattttacttttgattgacaacattttttaaaagcctaagttcactgaggatcatatttatttaaaaaaaatttttatttttttgagacggagttttgttcttgttgcccaggccggagtgcaatggcgtggtctcagcttactacaacctccatttcctgggttcaagagattctcctgcctcagccacttgagtacctgggattacaggtgcgcaccaccacgcccagctaactttttgtatttttagtagagaaggagtttcaccatgttggccaggctggtctcgaactcctgacctcagatgatccacccaccttggcatcccaaagtgctgggattacaggcatgagccagcacaccaggcctatttaaaattcttactcattatttaagactgttataaacaaagaattctaggttggggatgaagaaaaggtaaagttcatgaaaacccaggtagtaactgggcttatcttttttagccacatttataccagttgaatcttaaataatgatggaaagagaggaaggagtttggttattttattttaattatcttcctggccacttaagcattcataactccttttcattcatttcagctaaagtttaattcaagtaactaagtcaggagcaatagatatcttctccaccatcaaccctgtctttccttacatattctttgtaaacatttataaattaaaaagtgaatgtttgtatctgagcaagcttattgatttaatagggtggggtagatggggtggtgcaaattctgtccctgtttgtggcaagatgaatagattttagtttatcttaggaaactgtcatggacttatccttccaaaatccatatttactggggttggcagatgcactatttcttttaaaaataaatgtgagaaaaatagcaactcaataaacgataaatccagtttctattcattttatttgtactgaatatcacaaaccatttctggatgttttaaaagaaaatggcaccaattgaaaaagaagttaaacatctatcccatacaaattataatctcaagaaatgtttggaaaagcttgtgcctcatctgttgttataaactacagctattgatataaacatagatgaatctcaaaaacatcatgtcaaataaaagaatcacagaatgcatgcagtattgttatgcatagtttatttaaggcaacactgaaaaatatgctgtttagggatgcataccatgctggtaatactacaaagaaaagcaagagaataattcagagatcttaaaattcaggctggtgcttatttggaggcatataaaaagagatagggatgcgattgaagaggagcacataaggatccctaacaactggtgctgtttacattgggtagtaggcacatggttgtgtgtctgattgttctttaaagtagtcatgtacatggctaggcgtagtggctcacgcctgtaacccagaactttgggaggccaaggcaggcagattgcttgagctcaggagtttgagaccagcctgggcaacatggggagaccctgtctctgcaaaaaatacaaaaattagccagatgtggtggtgcacacctgtagtcccagctactcagggggctgaggtgggtggatcacatgaatgaacccaggaggtcgaggctgcagtgagccaagattgtatgagtgcacaccagctgggttacagaggagaacttgtctcaataagtaaataaattaataatagtaataaaacaaagtagtcatgtaccatacattcatttgtaggtacaatataagtcatgataaaagtctttttagcttgaaataataaacccaaacaattagaatccatcattttaaaatgtcctgtgaatatgtgcatggattcagaaatgagcctgtacgcttggggatccgcctgccctggagcaggatcattctaaaaactgtccttttataactcagagtcagaatcagaactctcagtactccctgggtgccttctaaccatacaggacccaccagacctgatctatttgttggacaggatgttccagtcataatgatgctaagaaccagactgctatggtatgtgtagacacaagaagaggattttatgtcaccatgtactctgttctgcagcatatttcccctgttagggtctgtaattatagaaactcatccaattatgggatgtcaccattgtataaagcaaatgttgggctggtggtgacaacttgtgagtacatacataagaacactaaagcttccaagtacacagtgttttattattgagagcccaagtatggttggtatgcaaactttagtgactctcaaatatgtctatgtatggggagatggggtgggagaatggggaataaatgaagtgggaaatgctttgcttccttagtaactttcttccaagtaatatatccccttgcatgctctcaccccaggaaaaggcacaacactgatacagcaatgaaccccacaatgaaataatacagcacttttccatgaaaattttttttcttctaaaccaagagggctttctttcactctatcctgtattaataacagaccaattcactacagactacttactaataaatgtctaaacatattctgatatgaaaaatatttttattttcttgattttttttcctccataatttttaatgcttgccttttaaggaatccaaggaaaaaaattcagagttggattttatgtgaattaaatgaaaccacaacattttgcagacaccacatataaacaaaatcatatttaagagcctggaatgtttctataaacttcttttaactttcaaacatacagtaaatctgcaaggcaaatatgactcatttcagtagctcaggattttccctcctgatcacagtatggtctgagattttgctaagaatgtttgagcaatttatagagctatttggatatgtttggagaatgtgcttgtatttcatgctatgaaataaaatccctgggggttttggtacatgaaaaagaataatgaaagtatgtgtgagtcattttgcctccaaatagttgataagcatgtttccaacctacatgaggtttttaactttttaagttggatcccaaattaagacccaggttcagacaatgccattagcagaaccaataatgatgggaatcaaataaaagtaattgactaagaagtcatccttttttgaggctgtgagccccaggcattcttctttggggtgtggccttcatggggagtgtattgctgcagaaagctggggacagaatagtgttctggattgagtatctcagttaccagcctgaaatctccatcgaccaacactgccttctctcaaatgacttcttatatgaaagtggacagacagtggaatgcagaaattttagagctgatcttggggaccggtcaactgtctactggccagtaagttactatgaattcaaaaatggtgaacttcaatagcattcattctgtcagatagtgagtttatttgatctgttggaattttaggtgcagagttctttttcaaaatataggaatgtgcagaaacaattaaggaaaacagacttggaaactttgatctgaatggagtcctctttaagtcttttataactgggcttcactacaataccttgagccttttgttttctctgaggctttttctcacttaacctgtgtgtctgcatctgtgtctgcatttgtgtgtgtgcttatcaagcacagggaatattgaagaacacaaaaaagtttgaaggtgacaattcaaagtctatccactggcaatcttgtaatctctttcaatacagcaattgttctctagcggtgaagattttgaaagagattcccaaattcatgtccacaccaagtattttctgtagtctgatgaacagttgtctcatgtatgaaagactgtttttcaaataagcttatatgcactggtttataatatacagattcctttttatgcactattgaatttatagatattttataaaacactttatcaacaaataacaaaagtataagcaattgtcatgagatcttaattttttcataatgttttaaaaggatcctcattcttaagatgttagaaaccattgcaatacaagatctagaagattacatcttttctctaatcttaccagttagcagtggctatcttagtgtgtgttgatccaacttggctatttgaaatgacaaagcatgggaatgtaaattaaaacaactgctgtggtccggcatggtggtttacgcctgtaatcccagcactttgggaggccgaggcgggcggatcacctgaggtcaggagttcgagaccagtctggccaacatggtgaaactctctctttactaaaaatacaaaaattaattgggcgtggtggcaggagcctgtaatcccagctactcgggaggctgagacacaagaattacttgaaccaggaggtggaggttgcagtgagccgagattgggccactgcactccagtgagattctgtctcaaaaaacaaaacaaaacaaaacaaaacaaaactgatcttttaaattttaaatttaagtgaacacatactatttcacttctcaatatctaccctaaagaaatacttgcatcgtgcaataggggaaaaaatgaaagaacccaaaatgtctttctatagaatggttaaactgtgctatcctattacataaatgatgaaaataaaggtatgccctagtgaactgattttggcaagtcctcaaacacattattaaattttttacatggcaaaataactatattatatatcccatgtatgtaaaaaatacagcattgcaagatgcaaatccaaacttgattaactatttggttatctaggtaattactcagagtaatactgtgattatcaacataaaataagtaaatatttgtactctctatagacttaaactgttctttttcattctctctgagtctttaatgctcctaaacatgtaataaaatcagcaccctccccataaaaatgtctattatttttccctgatttaatttttaaacatggcttcctcataagagatcttgtcttgttaataaaatactattgccacaattttacttgaacctttaaggatgatgtcctatagtctcaaaccagaagataccaaaatggagaaaagacaaaatgaagggaataagagcaacattctttaaactacggggaacacggagtaaaaaaatcaaacaagacgacctatactatagttgagatgaaaataagaattttgccagtgttgcagaagttttgagaaatatttgctagggaagctggggtcgggggacactggggcaagaggaaaactcgttccttgctccagtgtcttgctacggaagcttctgcaagttcttctggctctcgtctggcatatatttagaccctggcccttccaaatgtaataacatctcattggtctcctcatttgccatgtctgcaagactttaattcatttgaactttctatctgaaaggcacaaactaaaacatggttatcttgttacttaaatacactgaggcagcaaggcctggtgttaaagacctaaaatatcttcagtgtaaaagccacagcattagaagagagctttcccattgcatatatgtttttttcttatcttgtaacaccagggcccttaagcaatggttccaggaatggaagaaaagccaatcctctctactttttcatgctactcgtacaatcaaataacatcatgtggttattatggacttttaaaattcgttgcatttattcgtcagtgtgaacacacacacacaagattatttctctttctccaaaatatccaatgagccatgttgctgtcagctgacctttgctgcagaaaggtacctttctccaagtgtttgtgccaacagatgagctaaaagcagttaccaagtaacaaagtggaatactccacaataaaccctcttccaaccagcataggtgggaagttcatggattctggtcaaacaaacattttatttcatagagaagtactttatagatcatttgtggattgccagtttttttaaaaaatagatccacaataaaatgcatttgatttaaactctattaaacaaaattcaataattctcagatgattcagataaacttcaggatcccacactccttctgaatcatctgggaacatcacttggctttgttctgtagcatatggcaaacaggttaatactggcatctgctgaattttcacagaaggaacaaatggattattatgcttttattacaatccagtggttggttaggtatgatttttactagtcagcagcatttcaaatacatttaaatctggcgtgtggaaaatcagaaatgtcaacattttgtctttcactgaagcatgaagcagaccctgtgctatcgtttgatataataaggatcctgtgtacttgtctttttggacaaattctgctttgtggtgaaattagctttcatgcattactggtattaaattgacaatttgtcgatgattatcaaaagcctttaaaatgagcatactcttaaactcggaaattaaactcagaaattctaacttctgagaagttttcctaagtaaataattgaacaagtgattaaagtgagtctgtaataatgtccttagcagcattgtttataagaagatataaagttgaaaacaatcttaaatgtgcctcagtagaaaattggttagtcataatagatccatgtaatcattatgtatgtgtatacctaagtggtaatactgtgttgctattgaaattatatattgctaacatgttaaaaatagtcataaacaaggtaaattaaagaaatggtttgtgaaatgatatgtatgacataaccctattttattaaaaacaaaaatgtctgtgcatgcacaggaaaatggtagaatatatcacatactcatcatgttcaaatctgggtttgcatgattctcgggagtggcttttactttctcctttatatattttgaattgtttggttttaaaaaaaatttatgtgtgcgttgcttttaaaatccaaaagaatgaacaattcagggtacttttttttcaatttcggaagaaaaaataataaacctgtggtgttagtaggatgggaagctcaccatgagggagaggcctaaaagctaagaaatgactgtttgctttgcttgcctaacgctaatgtagggagcctcagagttgaagaattttcacccctatcaagtcatttggcatggacacaattttacctataaagtcaactgatatgttcttgaaccagcaactggacatgttatgattgaaaatgccatgaaaccatttttgctctttttttgttcttaactttgtaaataattttaatatgtttctttattagtagtcataaaaagatccatagatattttgccccgtgatatcgttaggctttgtgtccctacccaaatctcatcttgaattgtactccccgtaatctccatgtgtcaagggagagaccaggtggaggtaactgaatcatgggtgcagtttcccccgtgctattctcatgacagtgagttctcacgagatctgatggttttataagggggggctcttcctccttcacttggcgcttcttcctgccacctagtgaagaaggtgccttgcttccccttcaccttctgccataattgtaagtttcctgaggcctcaccagccatgctgaactgtgaatcaattaaacctctttcctttataagttacccagtctcgggcagttctttatagcagtgtgaaacggactaatacactctagtagctgtgtatcctagaaaatgggctcccaatggagaatgattgcctataaactttaagctgtaccaagcaagaagaggtagaagagatagtggagatgatcggttgttcaggttgctccactgagaaatcaaagatgaagagaggttacatgtgatgtggcctacgtggcaaatctagttcatgtcagagctaacagccagcaatatccagccatgaagcccagtgggtaggtgaaaagagaaagatggtaagttctgaaaatagtgggaaattaaggacttaaggttatattccattaaggggacggaggagttttgcttttaggataggtgtataagttcgttcttgcactgccgtaaagaactgcccaagatgggtaatttataaagaaaagaggtttaactgactcactcatagctggggaggcctcaggaaacttacaatcatggaggaaggggaagcaggcaccttctttacaaagcagcagaagagagaagagtgagcgaaggaggaacttgccaaacacttataaaaaccttgagagaattcactcactgtcacgagcacagcatgagggaaccacccccatgatccagtcagctcccaccacattccttcctcaacacctgacacgggggattacaatgcaagatgagatttgggtggggacacaaagcctaaccctatcaatagggatgtcccatacggagttttatgcctcttgcttgtcttggaagaagaaggccccaagtaacagtcatgacctcatggctgatccagagatgtagaaaagcaaattgagacttcctgtttgattagtttaggaagcagttattaaggattgattctccctgttgcggttaaagctgtctaccaagaaataagccaaaggaacattaggccaagaatctgaagggtgaagccaaaccactgggaagggctttctacttcaactacaatgtgattgaattagaaaggaacattcgaatcctgtcatgtcacctcaaattcaacaagtctaaaattgaactcatttttcctcacgaagcggctccttaactgaactttcctaataacaggaagacactgcagtgtagaatgctttgccacaacatatctatctattatttcatttgattgtcacacacaagaaaatttaactctaaaatttaactttaaatttaactttaaaaggttaatcaaagggctgcaaattagtaagagaccaattctaaaacccaagttttctgaatcctaatctagtcatccattatcaactatatcacattgcccccccatatttgtgaaataaaccagcccattttatagaattactaagtgacattttatttgtattggcttttgaggattgcacatgagcagattttagtaaatatgaagtcagattttctcaagtagcaaagaagaaaccaaccaaccttcggaatcattaatcctgttttttatgagatacctcagtgaaaaaacattcatagcattcttattattgaagtcaaaagatgacacagatgaaataaagtactgactctaagcctaaaaatgcctaacttacaactctaacatgagcaaaccatcatcagttatattaggttaatatatggtataagtagtatggttctactgttttgttttaatttgcaaattattttggctttgcaatgatataagaattataagcctgttctagagaagtaccatgcaacattgtacctatagttaacaatatggttaacaattttaacaatttaaagtgtattgtacactttaaaatatgccaacagggtggatttcatgttaagtgttcttaccacagttttaaaaagaattattagcatgaaatgtttacatatctgggtttctattttgtagatatgtaagtaacattgtaataaaaacactgtaactctccaatacaaaaagcagcttcctacacaatgcagccccatacccatacccaacccattgacccatcaagccagcacccatcctttcttggcactctgtatctcagtacacattctaccttcaaaaacagctaagtcaaacgtgtcaaaatagctatttcctcttgagtttgagcatctgcagttgcccagccccaattctttatttggaaataagtattaggagaaacatatctagcatagtgatattgatttgtaatttcctcaaatagacattcactttagatgactacaaaagctaaatagagctcaggagctcgagaccatcctgggcaacataatgaaacaccatctcttaaaaaaaaaaatacaaaagttagctgggtgtggtggtgtgcacccatagtcccagctactcaggaggctgaggtgggacaattgcttgagcctgggaggtcaaggctgcagtgagctgtgatcacaccactgcattctggcctgggtgacagagttagactgtgtctcaaaaaaaaaaaaaaaaaaaaaaaaagctaaataatatatacacatgtgaagtcctctgtgtctcttctgccttcttcagctcatagacatctatctaaatacacacctgtgggccattgtgatgtgcccagcatgtgggtggtatgatactaaggcacattttagagcaaaagaggggggccttaaagggagctgccaccccttcaaaatgcactgactctgaagcatcctaccaattgtcagtaacaccttctctcgccagggaaaaggaactggagggaaaaacaaaatccaagcaaagaagatatcctactcccaattttaataatatttattatttaatataatatttaattttaataatatgtattatttaataatatttattataatataatatttattataattattaaataattttaataattttggcttattagcaccaaagtcccggtttggtagtgtaacttgattcttttctgatcttcgtgacagtgtctacacaaataactcatgcaacatgctgtatcttttgaagtaagcattttgtttatttttggttcaatactttgggtcccttcttctaaatcttacaaggccaggcccggtggctcacgcctgtaatcccagcactttgggaggccgaggcgggcggatcatgaggtcaggagttggagaccagcctggccagcttggcaaaaccccatctctactaaaatacaaaaattagctgggcatggtggcatgtgcctgtaatcccagctgctcgggaggctgaggtaggagaatcacttgatcccaggaggtggaagtggcagtgagccgagattgtgctgctgcactccagcccgggtgacagtgcaagactgggtctcaaaaaaaaaaaaaaaaaaaaaaaaaaaactaacccacagtttccaaaggcaacttgcttttgtgcagaatgttttagtttaagttgttatttggtcattgtaaattatcttctgtagctattggattcatgtttttcaaatagttaaaagtttgaaagctagctgactaggtcgctaaacttaaggaactgaaccatccttttagacgtatgtggttcattaagcagtgaagttcagaaaagggctcagggctgttcctgccaagaggttggtgaagacacgtggcaagtggcacgctcaagaggttgtctttgtaatgttgcagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacaggtactgtcctctttgggacggggagtttctaacttgcgtcttagcctgtccgttgaatggaatttgttgagcagagcattcctttctcagcccaactcaaccctttttcaatctaactggtttaattattttgcagtcattttaggcaactaatctgattagacaggcaatctgatttagacactaggacacactattctatttctctccaccccgttcccatctcataaacataccccagttgaaggcttttatttcatttcacaatctagcatttgtttaatttaataagtatggtgtgctatatcttaaaaataagtatggtctattttttctgtttaattctttctttaaatttcaatagttttgggggaacaggtggggttttggttacacagataagttctttaatggtgatttctgatattttggtgcactcgtcacccgagcagtacacaccacgcccaatgcgcagtattttccccctcacaccctcctacctttctccccgagtccccagtgtccattatatcacttttctacctttgcatcctcatagcttagctcccacttgtaagtgagaacatttgatatttggttttccattcctgagttacttcacttcaaataatggtctccaactccatccaggttgcggtgaattccattattgtgttcctttttatggctgaatagtattccatggtgtgtgtatatatacacatacatatgtgtgtgtgtgtgtgtatatatatatatatatatatatacaccacattttctttacccactgcttggttgatgggcatttaagctgcttccatatttttgcaattgcaaattgtgcttctataaacatgcgtgtaccagtatattttgcatataatgacttcttttcccctgggtagatacccagtagtgggactgctggatcaaatgttagttctacttttagttctttaaggaatctatactgttttctggtaggttatatctttaaataaggaaaagtatttacatttattctgtagggtgttgctatctgttttgaactgaagatatgttagtttagtagagtcctccatggctaccattaataggtaacacgtgaatttttaaagtgggcatgaattgcagatgtcttcttttttctaatatacagcctgaatcaatagtctctgatcattataatattcaacaagatacagaattccgcttaatttaatgtgattattcaaacacacttaatgagtttgctattacgtattttctcactcgggccctggttgaaatcagggaacttgagaatgcctaataggttcaacttcttcaaagagggcttttgcagcagaaataaggtcacatggttcattatgctaatggttagtatatgtcatttatattgtcatttatgtgccccaaggtctaaaaaagatgaggatatttgaggaggaaaatggagaaaataattttaatttaaaaccatggactgattataatggttacactatataagatctcacatgtggttttggttttagtttgttttgtttaattcagtctatttagaaaattctaaagggaatgggtcctggcctccttaacccaagtttgagaggctgtattagaaggtttcagaaagcagtcttgaaaatgttggccggtagcacaatattgtttaccctttccctcaataagtagcttctaattggggagtaggtatagcaaaggggaaataggtataatttctagggttcactaattgactttgactcccaatttgacctttcactaactgtatttcttcagttaaatggaaataaaaattatacctttctccaaaaaatgctgctaaacttaaactatgtaacaatacatgtaaaatgcagtgtcttacacatagtaagcactcaataaattttcactgttaccagattcttaacacgggagggcaacgtagtcattcactgccttttccattttcaagctgagagagaaataatagaaagagttttaaaaatggcattttgatgcctttcctgaatcttgttattaatgagtggtcaacaggagctttaaaaattactggtgatctgtagttttcttgcttttaaaatcttgcttttccttgtgcttctcttcggatatttggctgttattcattatttcatgctattaattgaaatcaaattctttttttttttagaaaatcatattgaggtctgagaatgtgtgatttatctctgacatattagttagccacaagaagaataagtcttcttggggctaaacaactctaactggcatttgatatctactgataattgtggtcatgatttataaataggcaaagaaatgttcaatacagtttgttggtttcttagcataagagtactttaatctggctagcactttggaattttggtgccttttaaaaattattagaattcaattgatccaaatggcccctctatagacttccccttaaattataaattttttgcatttgtagggacatttaatccttatatgtctaatttcatggaggcaatatcctgaagcaaaagtaaaggccaagaaagttttaaagctagtttttactctgccattttcattgttaaatatgaaatgtgttttttccaaaattaagtgaatttgaacgttgaaagggccaagtttggtctgaactatgaaatttgatggagtttctaaacattgcaagacaaattcttccaactctggtcacagttctggtatcacatgactggttgtttcctgcaaatagaaaccaacaccctggcttggacagtgtccagcatcctgcagtagtgagggaggtgatggacaacagtttaacttttggagattttctgtcctttttaaaataaatgtcaaatttaactgccctttttccactgtagaaaagatggacaagaaaccctttattcatggaaatcttgacaaagaaggtagattgtgtatacattagttagggtaacgctggctgctataacgattagtgcccccaaattttaagtttagtgcagtaacacttaccattatgcatatttctgtctagttggtagaaccagccacctgtcttcttttctcttgtgactctcaatccctagggcttggtgctccctgatctaccaacagacagagatagagaagacagggagtgcacctctgtttgttcattgccttggttggacacttctgtttacatttcattggcagttattggtcacatggcccgcctaggtgcaaagaagggagagggtgcaaatttaatccttgagtggtgatcactccccccaactatggaaggaggagcaggaattgtaagggacacttagatgtctcttccattggggtcactggcgtgagtgtggaatctcaacactgtaatgtacattttcttcctctcaaagtaccttgggagcctccaatccagatcaggaattctagatgacttgatgacatgggagaatactacatgacatggaaggaattcacttattatttcagtttgatccttaagtttgaattccccaagaagcaagtccagaaacaacgatttgactgcaagtcgtttatttgtaaggtgatgctaggaaacactggtggaggtgtgggaaggtaagacagaaaagggaaggccaccaaataaacgttgcatgaccaagcacatcaccactgtgggtatctggagcttcactccactgggaaactctgagatccagtgtggaatacacacctcggagttatcccactcaaaaagtgaggggtgctgaggtatctaaacactcaggctatcaatttttgtttgaaaactgctcccaggggacattaataccgaaagcacttctggcatgttgagtagactccagtccccagagaaaggcttgcaaatgctgtcagctgaaagccaggcaggcgtgtactaaaatggtaacgtactggggatatgggcaagcttggcactactggcatctgctgtagtcctgggtagcacaggctgtatgaatgctgctgactgatgaatgagcaagctgtctttggtgttgttctttctgttgtacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcaggtagaggtgatggtggaagagaaaacaactgaaagccaggaggaaacagtggtaatgtcattaaaaaatgggcagatcagttcagaagagcctaaacaagaggaggagagggaacaaggttcagatgagatttcccatcatgaaaagatggaagaggaagacaaggaaagagctgaggcagagagggcaaggttggaagcagaagaaagagaaagaattaaagccgagcaagacaaaaagatagcagatgaacgagcaagaattgaagcagaagaaaaagcagctgcccaagaaagagaaaggagagaggcagaagagagggaaaggatgagggaggaagagaaaagggcagcagaggagaggcagaggataaaggaggaagagaaaagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacgtgccatgcaagagacaaagataaaaggggaaaaggtagaacagaaaatagaagggaaatgggtaaatgaaaagaaagcacaagaagataaacttcagacagctgtcctaaagaaacaggtacagtaaacattttgcaccaaatgtgtgatgcctgtgacttgtgagaaatgtaatgcacatctgatttgggactgaggccacatgcatatagctcacatgcttgatcatttggcaagctgttcattttttcaggccatagcgatacacaagcatgcagcaattgattgatggctgaatattcaatcaaccaaatttactgggacagccagtaaatttggctgtccagaagacagagagaaattaattgctctgtgcttgattgttatgaatacccaaaaaaagaattaatccaaagatgataaatgtggtggtggtgtgttggcttctgattctgcgcttgcatctaaactcgttcttttaattatctttcctctatccataggtctgcatgaggcaagaggcccataactccttacctcactcatgggtttgacgttgaattaaaaaaatgataaaagctggggtgggaaagagacatgaagaataatggtcagacatttcatcttaagaaggcaaaaacaggctgggtacagtggctcacacctgtaatcccagcactttgggaggctgaggtgggtggatcacaaggtcaggagatcgagaccatcctggccaacatggtgaaaccccatctctactaaaaatacaaaattagctgggtgtaccggcacatgtctgtaatcccagctactcaggaggctgaggcaggagaatcacttgaacctgggaggcagaggttgcaatgagctgagattgtgccactgcactccactgggcaacagggagagactccatctcaacaacaaaaacaacaacaacaacaaaaaggcaaaaacaaacccctggaaattaactggtaataaagagggggaaaggaactggttggaaactttccttaaaaaaaaaagtcaaaaccctgatttgccaacatgtagacctcagcttaatgtagacttgcagaaagccattaatttagggtagtattgatttatatttgactggtaattaagagcatacatgctgcttctttattatctgggtgacacaaattcatgtggcctgaggaagggtggaaatagtaggggggaaatgtttgtaagctttgagaaagattttttttctgtctgcaagactgcattgaaagcactgtacctaatcaccaccacaccaccaccaccactcctaaaaaaagaaaaaaagagatgctttcacattcacctttccagagcaaattctctgtcactaagcctgcattgcactgaaggtatctttaactcctgcttctgtacaagaggctcatgaacacagctaaaattgagaccatgagcaaagtgcaccaaaccacacacgaggtttgtaaacacacgaggagtgccacatcatgctagatttcagtgagcgcaatggcaggcacacgagaagatgttggggtgggaagaaaatatcccaccttgctgtttagaaccactgtgctgtgagcgctgagacggcagaagagaagccatcccacgcagcacttgcaaggcgatccgagcaccctgtcactcttgtaaactagaaagggcttcttttacttgtgtgaccttaccattcttgaaaataaaaagggagaagagaagggaactaaagtgcaagctaaaagagaaaagctccaagaagacaagcctaccttcaaaaaagaagaggtaaatatgattgaaaagtaatgatcgtaaagcaacagaaaaagcagtcagtgttccaagatatctcaggtctgatgatctcaaaattgtaacctcatatccagtgtatttcaagccatgactcacagtccactgaatagtgagatcagcttagagtgtctcaaaattaattaaatgtatcagtcagcattttttaaaaaatgaaatggatagaagccatcagagggcattgtaggtagtaagtattgcattgtcaggtaaattgtctttttttctgtgggacgtcatcaaaaaggcttgaaaaacactgctggaatcaatttatcctgttttctattcttctgaatgctaattttttttccttgagccattctactttcatttcaatcatgaaatatttccaactggccttgattaatgctttaacttttcaaaggaaaaacacccacacacatctcagtagaaaatatggtgaactgaagatgatatttggttttcaaaagaaaagtttggccaaatgttctgcattgcatttctgaggcacacacaggagcgggtgccagggtatttgactgtaggtaagtgaacaaggagctatacagatagaatggcacggggtttgacagtaatcagaacaccacatcagaacacttgattgcacttcaactctcatgctgtgtttgccccaaataatcttaaaaattgtgactatatcgaataagttcacaatacttattaggatgtggtgaaactgaattatttgaagtaggaagacccgaagttcttcgcctatgagactggtgaagtgatttgtagccaacatgctccaacccatctattaagaaaactatggcatctattaagaaaattcaaaatcttaaacagagaaatccatatttagaaaacatggccagattaaatagggggtgggttattttcttaaatacgttttgtcaatttcacgtgaaaaatgaaaacccctagttcatgttacatattacatttctgttaagatgtatgttcctctgtttctaatagaagttgtggtggtttggaagtgaaaattgaatgtgagcacaggccatgtaaaggaaggagaaagtgtaaatgttaataacaggaaaactgaatttagctctcatgaggcagtcaaggaaatcattcattgaacatgttgggaaatacttttcatttggtgaccaaatacctacaaattcatttacaaaaaagaaaaatgaaagttacctcagaactaaactcagaaatatgtcccacatgggttcttgtaatgtttcttggtgaatgtctttatagaaagaagtgggcatgaaatgatgactcagtaattaaacacatgggggaagggaggctgtagaaaacactggattctatatttaaaatttcattcagttcactaatttgtttttactgaccaaagctttctatacctatgtagagtgtctgagaactagaagggcccatcagttgccactcggatgatccttttgtctcttttcagataaggccccagttcaacagcgtcctctgtgtcaatcagatactcccaggaatgagtgagccctgccgttttcccaagttgcccctcagcacattccagccagttccaaaacttttggcttgtttttgacacaaggccagataagctactcaaactggtttttttaaaaaaagaaaacaaccccaatctatattccttttttaatactgtgtacataacctgctgctcgaaagactaggttttcccctttccagctagttgtgttgtttctttatgtagacagctttaaatcatgtttacatgattcagccattttaaacaacctcttcctatttttttttcctttttgtacaaaaaaaaaaagaagaagaagaaagaaagcaactaactaaaacctttcctttcaaggatttatgcagcataggatagggcaaccacaagtaaacacaaacatcacgtgagccttcttaaagaaaacatttccagaaatcactccaatgtcttaaaaaacacacaaaataaaacctttctccactgcagtttaactgtggcaatgagttgcagacgatcaccaacactgaaacttaatttagcttttttctctcctctccaatcataaaaagtctctttttggttcttcatgcaggagctattttctttcttttctggcctctaacaggaaaacagagtttctagccgagctgctcctgaggtattaaaagtgatgttcgtgtcatgcggatcaatcctgcccaaacattagtgtgcatgcaaatcacctggcagtcttattaaatgcagaatctgattccatgaggtccatgttgtccgtggaccaaacttgcagtagtagcgaggagtctagaagacgtccatgttatagaaattgaacccaggaaaggatttggggcttatgaagctaacaaaagcacgtaaaacccagcctgagaaacagtagctacacccagctcttgttgctattctggaaccaaataatgcaaaatatgctcgagacacatctcagttcttgcttgcttgactttctgagtgtctctctggcacaagggcctgtcatttgaattcccatcccccacctcatccccatgtattattccactggatatcccaaatatctagagtttcaaaacccaaatgatcccatttggccagagccttttttatgagtatgctaatgttatctgtgtatgaagcacacaaactttttcaggatacccggctatctattaatccttcagcacggacgttctccatggtaacagtctgacctataagatctaatgcctttcccagggggctcagaatcccatgagtttgggttaaatctgccataacatctaaaaaaaaatgtaaaggctctacggaattactttatttattcatttcccagaaagagaaaataattttcagttgaactcaaatcgtcattattacattgacaaggtttctaaggttttccaaaaagaatataagcctgccatccactatagcctttgccaataaaggcagagcttgaaaaaaggggggattttttttctgttagacatgtatcatcttacaaatctattttaaacacttttgggaccagtaaatcagatataatacatttggggagaatggaaatttttctgactgcaacataggataaatgagttaaagggaatgtctccatgcgtagtgctccacagaccgtgagctcctactcggaatttatttcatggttatccctaaaatgggtttccctcacatttggagccacagatgcttcttaactagaacataaactccagtccatggtttctggggctaagtctaacaacaataggccaaaatgagaatatattttgtttcctccttcctgtccagtgaatactgatatattcttgggcaaggacagccatcagggagccacagtgaagctgtcattcaggctatgagcttgctccttttttctgtagcctctcatgacccatgaggacccaagagggaaatgacaggatgaaaaattcggaaggaatcatctggtccaaccgcattttttcacgtacttgggaccagcatcccagagcagtcaagtgatttgtccaagtaacacaactagtttgttgtcagcactggagccaaaagtcaggtttcctgatttacagacaaagctcttgcagagaatggcaaagtacagcccccattttcagtgtgtccgagggacatcctaggtatataccccatggtgaaagattgaagtcttaactaattagggcagcatagaagtgaatccctagtaattaatcagataatacccaaagaagacaatcaaatgacttaaaacttatcaataaagagcaaaaaactgtgctctgctttgtaaaacatgcactttaggccaggtgcagtggctcacacctgtaatcccagcactttgggaggccgaggtgggcagatcacttgaggtcaggagtttgagaccagcctggccaacaaggtgaaacccattctctactaaaaaatacaaaaattatctgggtgtggtgttgcatgcctgtaatcccagctactcaggatgctaaggcgggagaatcccttgaacccgggaggtggaagctgcagtgagctgagatcgcaccactgcactccagcctgggcaacagagcaagactctgtctcttaaaaaaaaaaatgcactttaggagtaaatcttcacagagtatctgaagaataggtgagaagaggtgagtgatcaggtcaggatagaacctcctaggccacaacacctaaagtcctgagttcttatggcctacctttcctctggatttctttagaatgctcatggtttgtaactgtcttgaaaagaaccatcgtgaatgcacctcacctgttttcacactcatcttttaagaatggatgagatgatataagtgaagtgatttgaattcctttaccccctcccccacaaaaagctatgtaaattcagtatacttttaaataatctgtctcacttactgaaagaaacacaaaacgcacaaaatatgaaagctaacacctgccctccatatatcatcttcctatgtctcccaccacaaccacaaaactacttccagagaactaaatttttattgacaatggaaatcaaggtaaaccctggaatttttcctattccattctaactttaatggtttagatgactacagacatgttctcacagaccccacatatctttggatcctcctactaaaggtagggttagtaaatgtcccatccttgggacataatttactcagttgattaaaatactggtcttcgccagagttggtttggcagatctagctaaactgataggtttccttttctttctttcccatttgtgtctctctcacagattctctcaccatccaggaagaaacctgtctaagcaacgtggtcattcttccatcaaagccatcctaataattgctcttcccagtgggaactgcaaacagctacttttacatgaagttcccagaacttagtggtttccaaacaatagtactaccactgctcttgaaaataaaaacctcagtgagatcagggatgatcttaccttcttaaaattgtggtaaaggtgtttgttcacaggctaaaggaccatagctcattctctaagaatttcacctgattccaactctaccacatctgagtggtttctttctgagttttctgccttcctaacaattttgggtcttacttgatgataccaaccaaaacctaataagatttttcttgttctgtttcttcctgatatgtactgttggttagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcaggtaagaagtagcaactagttaatagaaactgtgttcacatgcaaagaaaaaaaaaaaaaagtcagtcttcccatcctgtgcttccagacagaaacgtgctaagcaggcagcatgcttttgttgtgaggtcattagccattgtcttagagatactcagtcagcaggtccagttcttatatcactaacagaagaccagcagtcatcgctcagacagggcttagtctgcttttcccattattttgaaaggcagatcatgcttggcatccatgtttttgttcactgaccttttgtgagattagtgtattagaaaacattataactgggattcatgtcattcaatgattctctatatggtctgaccaccttcctaagagacctttctcagtaccattttcaagaatgcattttctaaaggttgtaaataaatattgcataagactaagattgttttgtggcgaaatacttgggaaacactggattaagctaaattcctcagatttctttaccacatgactttgagagcccttcatgttcattttcattggaagtctctaagagggagtgagaggtatggacctactgctctattttatacagtttggaaaaactctcttgtatagcttgagctttcccctcaacataatcccttaccccatcaaactgaaaatctgggcaactgattatcagacagacgagaccagtatattcaggtaaatcctcatttctaaatacagtcgaatcctgagagctctctaccaattttgtagaagaacttgaggtgcagacactgggctggctacgtgattcctgtgctccttccccacaaaacactctctccaaccactggggccaaattccaacctctgttttgtcactggttgctgtgccagatgtgccggagaggagtcttgggtccctgcaatgtggatttccccgggcttgttccttggctgcaggcttgcctagtgaccctgtttttctgaacacttcaaataagaaagtcatcaagcaggtttgagggagaaatctgacatgctcctcacaccaaagcctttgtaatattcaaaagcaggcggagctactagggatggatatttcagtctcatccaagaggctaagatggataaatacggttgccccaaaacaatttttttgtacgtaaatttaagcagaaacctattcatatttatccaaaggagaacctaaagctcacagaagaaaaggtgtacataaaagatctaaataaaatgatgaaggtgtaagaaaggtagaatctatagatattacttgggattgccaagagaatagatgtgaaaattaagtttattgaacattcatagaaaatctacaaagcgagttgattcaggttggtaagttgagtctaaaacttgctgaagtgtctgtagtttaatgttttaaagccctagaatagtgttaggttcatgaaaagtgttcaatgaatattacctaatattactattttttaatagtttaaaagatgtcttgtaaacataaggttcttttaaggtataagttttttgttaagagaaataacgtttaagaaaatctgtcagtagaaaaaagtctgtttaacaattagcaaacttgccaacaagcttcaaagctcaaattaataattaacatgcctattgtgtagaaatccaaaaagctgggtaattcgaagaaaggaatagtcacaagagatggtgacaagttaagtgctaagaacacttacgtgtgactctggccttaatttttctattttgggcaggaaaaaaaaatacaggaacaagctgctaccatattatttatttttgtttagccaccaacgtatgtgagttttagtttcaattagaagttcacgctgattgaagtagagaagtatagttttgctccatatacatataaaatgaggagagaggaagagagtatccgcctagcctctatttaggtaagtttagtacctaccagcttcactgaaaacaagctgtgttcttaatggtcaaaggcctgatactcatcttgacttacacctaaggaagccaaggacgggggtagggtggtgggggtggggtgcggggagaaagaactttatggaacgatttccacattaagtggcaccctaatgctgaggtcatgcacataggcagaggtggtgtgaacaaaacttttgctcctgttttgagcatagctgcttatgtgtgatttaattactgttccctttgatatctgcattttcttgtaactcgttttctctaaaacatgacataaaaatctcaattcaatgagcaagatatagcgatgcaaattataccaagggttttatagaaagtgcaaaatggttttttgattttttatttttgaaggtagaaattaaaagattttttccgattatagaaaaaaatactcattataaaaacgctcagaaaatagaagaataaaaataagcacccaccacccaaagataactagcagtaacactttttccagatatttatctatgtatataatattcaagataaatgcacacacgtgtgtatatttatatgtagtatatacgtgtgtgagtatacttataattttacattgattcttgcactgtgcataagaatgtgtcatagcttgctttctatgccaataaatataagcctataattaatgatattagattctactggatggatgtattaggacttatttagccagtccctaatgacggacattttgattgtccaaaatgaagactgagtgacacctagtggaatccatagatgtttctataggcatgtgttttgccggtccagttcctgtacagtaatatgatgaacacaaagagagagcaaactcatttttggaaggaaagaccctaaattgactgagagaggagtcacaggcctgtgaacctagaagaccctgaaagagcctttgacagcaaggttttgagggaccctttaaccttgtttgagttcaaaataaaagtttacctgtaactggcatgagcctagaccaatagttctaaattttttaacctaagcccttagtaagaaataaattttacataatgacccagtacacacctgtatatatttttataactgaaacaagtgtgtcaagaaatggtactttgttttgctctatgcagtgcactctgatattttctgttttttttttttttaaatgttgattacaatctactaaattgattttctggtctgcagcttgaaaattattgttctggaggacacaggatattcagaactacttcagtgtttaaaaagcatgatatataatatacatatatatattataaaatcaatattgcacagtgtatttcttgagcccatttcttgttttattcttcctcttgtttcacagctagaaacactgtaccattctttacatgtagtaaatgatgttagggtgtgataattcctttgttccttagacaaaagtgtcaggaataggatatctacgttgacatctagttaagaatgaccttactacttgctaataagtatttaaatggcaaagctgtatctctgtctcttaaagactacttataacaagggcttcaagcctaaattaagccactaaattctgcttagtgaagtcccaggcaaatccaacttaggtgaactctgtgttagtgaaaactctgcattctactgaagttctactttgagtatcgacatgttttaaaattatcagtgttctaactgtatcatacagtaaatttattaaagaaactcaggggtcacagtaggtgctaatgatatgtcttcatctttttatagttgtgtaaaatactaaaaataccagttccaaaataaaattttaccataaggactcttgggatagcattctgtctgaagtcttaatatgttcccaattctgcaatgaaatccctgtgtatcctccttaatcacaaaagaaaattcaacataatttcaattttagttcttacttacataaaaacgtacccatttcttcctgttttataagctgttctacctgatgaagcttctgcttcatctcaggcacggaaggtagctagacctagactgtagaaactctagagacagaggtaggaaacgcttctctcagactctatcctgaaggtttgaggtaagaggtggagagatggaataacatgttctatttcagtttattcattgtttcataacaaaacgtatttaatttcaggtataattatagttacaagaagagtacaactaatagataagcattagaatctgatcatggctcgactgctttctagcttccaaaagtttgagtatattattctctgtcttacctgtggtttccttgtttgtaagatggggataataaacctaacctgacatcttcccagttattgtgactgttaaatgaagtagtggatatgaaaagggtttagagagcataaagaatgacatgtaagtaataaccttaaccacatcataccaagctaatttcataattttaagtctgtataaggagtattccagttgtattggggtcaaagagcatagaaaattcacaaattgaagccataggttaatgcagtcattaaggactttcctggagcagctctgtaagaatagacataaatcactgtgtttagctcttaatcaagaggcaatgggtaatttcatctgccagagatcagctgctagagtcaagctcaaggcacagttgtggacagatggatttacttcaatgcctacccttagttacagccactttttcccattcccagcgcctgaacctttctgtcttccctcctgatccattactccaggcagacccaagttaaccagtaacttacgggaaaggactagtaaggccactacaagacttttgaactcattcacaagtaaccttttggactacatgcctccctttctaataacaactaatatttatactgtagatgatatagaaattatagtatatcagtatgatatcagtatgatatcatactgatataatacataagcccatgcaacccactgaggtaaatagaataaatagtatttacccatttttccatgttgtagcatgtatcttcttaaaaattgtggtaaaaacaaacatcacctaaaatttaccatcttaagcatttttaaaagtacagttaagtagtgtgaggcatattcatattgttgtgcaacagatctccaaaactcttttcatcttgcaagactgaaagactacacccattaaacagcaactctttatttcctgctaccgcccaccctctgcctctggtaactacagttctatttctgtctctatgaatttgactactttagatccctcatataagtggaatcacacaatatttgtatgatttccgtgattggcttatttcacttagcatagtatcttcaaggtttatccatgttgtaacaggtaacaagatctccttccttttttttttttttctctttttttcttacagacagagtctcgctttgttgcccaggctggagtgcagtggcacaatctcggctcactgcaacccctgcctcctgggctcaagcaattctcctgcctcagcctccagagtagctgggaccacaggcacacgccgccacgcccggctaatttttttttttttgtattttagtagagacagggtttcactgtgttgcccaggctgtcttaaactcctgagctcaggcaatccgcccgcctcggcctcccaaagtgctaggattacaggcgtgagccactgcacccggcctctccttcctttttaaggctgaataatattccatggtatggctagaccaccttttatttatccattcctgctatgatggacacttgggttgcgtccatctcttggtccttgtaaataatgctgctatgaacacgggtatacaaatgtctcttcaagaccttgctttccattcttttagaagtgtatcagaagtgggattgctggatcacgtggtagttctcttgttgattttttgaggaacctccatactgtttccatagcagctgcacaactttacaatcccattttacagtgcatatttgtcccattttacagctgaggaaacgaagcacaagtggaagagcagaggctcctggactctgtgattccgggcagaccccttccccagcctaccccctgggctaatgagaggcagtgggtatttagtcggggatgcagaagccgcagaccgacctccccttcctccagggagactacaggcaaaagcatgtaaacccctttccattgccccccaaccacagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggtaaggcgggcgctagcccactgagaacgttgcccgggaaaattccctagtgccgtgcggctgttcttttgagcatgggctctcaaaaatatttttttaagaataataaacttaccatgtgctaggtactgttttataacttgtagatgtattaatttgtccactgcttctaagaactcgctgacctaggtactaatccccattttacagatgagaaaactgaggcacagagaggttttgtttttgtttttgtttttgtttgtaactttcccaaggtctcccttgagtctgcctgacatgcaggaggagccccatcattaaaaccctttactgcctctcaaaaaggaaaagttagaaagctgaaaaggatgaaaggtctgcaaattagttaccagaatgaagttatggttttctaatagttggagagtttttatagagaagatttttttaaatctttttttttttttaatgagcaagtaagtacattagaatataaagaggcagggacagtatctgcgttgttcattactgtatacccaggaccccataccgtgcctgacatgcaggaagagccccatcattataaacagatggatttgtttcatcttttaagacagagctaaaaacagcagatagagttacaaggaggaacattttggctcagcatatgaaataatgtttaaccaactacaacttacagtactacagtttacaaagtgcattctttcatttcatcctgaggtacatcgttctcattttatgggcaaagaaaccaggaatcaaatagtttgagtgacttatttgaagattcttgactaataaatggtagaatcagtaaggagaccccgcttttccaactcagagcccagagcttttgagatagcgatctcccatcattcaaaatatgaagaaaaaaaaagactttcaatggcattttgacaaggatcctatgcaaaattttcctgaactgtatggaaaatttggatacattattttgaggtctcttttaactccaactttcaatgagccaatgacctttggttgggaagtatgggaagtaatcaggatgatagagtttgggggttaaacacaccccaggcttttttttttttattgtttttttagacatagtcttgctctgtcacccaggctggagtgcaggaatgcagtggtgcaatctcggaacacacccagtcttctatcctaactctgtcactaacaagctggggccttgggaaaactggactactctgtgtcttcttttccttatctgtgaaataatatctactttgcaggattcttccaataatttaatagatcattgtgctcccagtgcctggcacattctaggcactcaaaaattagtaggtatcattattgccatcattgttattatgattattattcagaggaggagagtatcaggaaaggctgaagagaaatcacgaagtcttagaactggattggacctaggagattatttgggctaaactaccaaacacaggatccttctgtgacatcctctgacagatgaacatctagtctctgcttgagaacatgcagtgataatgatctcacagcttaagaactaccaaagactgcattaaatctctcagaaaatcaagttgtgcaacttgatcagagccctgatagagaagacagagtattctagactaggaatgaagacacagaggggttaatgagacagtctgtaaacatttgcaattgcactaccatggttcaacgtctagagcatttcaggtttgtcaaaccatctaaaattatatattcacttgaagcggggagcaaccataaaatcacctcttgtaccatctggcaaatatagtaccacagatttagatagcttttcacataagttattcatttgtcttcacaactctcctaggatgtaggtagaaggaatattcatatcccttttacatatacagaagtgtgaggtcattgttaatgacccacaggatggtggtgattatgtatcatcctatgggaaatcatcataatgagtgttagtctaagccaggggtgtccaatcttttggcttccctgggtcacattggaagaagaattgccttgggccacacataaaatacactaacactaatgatcgctgatgagccaaaaaaaaaaaaatcacaaaaaggtctcataatgttttaagaaagtttacgaatttgtgttaggctacattcaaagccatcctgggcatgatgtggcccctgggccatgggttggacaagtttggtgtaagcattttacatgtgctatctcactgagccctcacgaaagccctaaaaaatgagtactattgttatccctgttttacagatgaagaaactgagccacagagcagataaataacatggccaaggtcaggcagttggaaagtagcagcaccagaatgcaaatgcaggcagctcgactccagctctcaggctaaacctctggtgaccacctagaaggggagtgtccagcctgcggcctgagtctgctgcctctccaactgtgctctctctcctacagcactcttccctttggctgtgaagctggtactgatgcctcgttatttgttctttctctcttaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaaggtatttttttccccagaaaacttctattagaatatgatagagactggattttagccccttgtttagttattgattatacagggcctttgttcatttatctttttgctatccttccaagttaatctgttcaggctgctataacaaaatactttagactggggccaggcacggtggctcatgcctgtaatcccagcactttgggaggcagatgtgggcagatcacctgaggtcaggagttcgagaccagcctggccaccgtggtgaaaccccatctctaccaaaaattcaaaaactagccggacgtggtggcacacacctgtaataatctcagctacttgggaggcttaggcaggagaatcacttgaacccaggaggcagaggttgcagtgagctaagataatgccactgcactctagcctgggcaacagagcaagattccatctcaaaatttatcactcacagttttggaggctggaaagtcaaagatcaaggtgccagcagatgtggtgtctagtgagggcctattcctcataggtggcaccttctccctgtgtccttacatggtggaaggagaaagggagaaaacaggcttccttaggcctcttttataagggcactagtcccattcacaagggcctcaccctcatcacctagttaccacccaaaggtctcacctcttaataccaacacatcaaggactcagtttcaacatataaatgttggaccatagcacctcctttcagctgtttcacagcttctctttgtttacaacatatggaaaggagggacagtagtgaaatttttatctgttgtttattagatgctttggcatacattaaaatgacattcggtgattatctctcaattttactgatccacattctccatgtgcctcattcctttgagcaactgagaatagagacatctaaaatttataaaataggaaagtatattttaaaagtttaagctgcttttcatgctagctgttcattttttctttgtcatgattaaaagccagctggaaatggtacaggtgcaaattttaaagcaattattatgggaggaggtgaaatgtgacttggaaagggtccttttccaggatggctttggtcctatgacagccttcatggagcacagctcctatttgatgtaaaacagagtgctgccaagagaacagaaaaggagcaggaatcagctgagtcagggagatgatagaatagttgagatgtagggaaaacacagtggactcaagaaagtagcatccttgatttataatcagtccaccattattgccagtggcagtttctttgagaattaacatcattgagcatctagcacagtgccttacatcatattgaagatacttaataaaaatttgttaaatgatgaataaaggaatgaatcttcagagattgggacttttaacatttcattttccatcaacctagctaggttataaagcatcaacaatggacaaagccatgagagaattatacccaggtctggccgggcacagtggctctcacctgtgatcccagcattttgggaggccgaggtggatggatcacctgaggtcaggagttctagaccttcctggccaatctggtgaaaccccatccctactaaaaatacaaaaattagccaggtgtgatggcgcacacctgtaatcccaggtatttgggaggctgaggcaggagaaccacttgaacttgggaggcagaggttacagtgagccgagatcgtgccactgcactccagcctgtgtgacagaatgagaccctatcccaaaaaaaagaaaaaaagaatcatagcgaggtctggatggttaattatgtacatatgtgtacggttatatcaagtggcacaccaaaatgaccaaaaactgcttacattttacagttattacttgttccacatgaaaatcagaattttttaatccccaaataacttcccttactctttttttttttttttgagatagagtctcgctgtgttgcccaggctggagtgcagtggcaccatcttggctcactgcaacttccgcctcccaggttcaagcgattcttctgcctcagcctctcgagtagctgggactacaggtgcacgccaccatgcccagctaatttttgtatttttagtagagacagggtttcaccatattggccaggctggtctcgaactcctcacctcatgatccgcccaccttggtctcccaaagtgctgggattacacgcatgagccaccatgcccggctcacttagtctttatgatggtctgggtcccagtcatatttctgatacctcccaaataaattatttgtacttgaacccttgtctcaaggtctgcttcagggaaaatttaaactaagccacagagggattatacatttaatatctgattatttatgaaatacttaatgcatgctatgtcctatgagggaaagaacaaagcaaggtggctgccctgatggctctaatgactgcctcaaagaaacaattcaagaattacaaaagtgagcagagcaaaatgagtagagaaaggccttgtggagtaggcaagctttatttataaactctgaaatttgaattttatgtaattttattgtgcttttctaatgtcatgaaatattattcttcttttgatttttttttaaccgtttaacagtgtgaaaaccattctcaaggccaggtgcggtggctcacacctgtaatgccagcacgttgggaggctgaggcaggtgtatcacctgaggtcaggagtttgaaaccaacctggccaacatggtgaaacctcgtctctactaaaaatacaaaaattagccaggcaaagtggcaggtgcctgtaatccctactcaggagcctgagacaggagaatcacttgaacctgggaggcagaggttagctgggcgcagtggcgcatgcctgtaatcccagctacttgagaggctgaggcagaagaactgcttgaacctgggaggcagcaacaaaagcaaaactccgtctcaaaaaaaaaaaaagaaaagaaaaagaaaaccatgttctctctttctaccttctttaaaatcccacccaagccttccttgaacagtcttggtaacatgaagaaaatagtagtcatctagacttccaaattctactgtggtttttttttttttttttttttttcaggagaaactacaacctaccctaccctcctctaattatttcttctctaccaaatttctcaacgtacctatttctctggtctttccctcagccagatgctggcttcccatttcatctagtacccccaggaagccatttatctactccctctgatggagaggcatttgtctgcaattgattaaagtagatgtataaaaaaggtctaggttattttaaatttctatgtaagagagacacatattcaggggcagacagtctatgcttccctccatgtatgtgccttgaagaacttgctgtgactctgattttcaagctcaatttcatattctacaatgtaattgggatagctattgatacccttggccctgcaacttttataagtggtcacaagttagcattgtagaataccaatgggaggaaaaatatttgctatttgacatcaaaatactaccaactactgtatttttaaaaaatatctcatgatttctattccttgtttgggaaagtctgtacctagtttttcatcattaaattatgttagcagtgactgattttcatatgcaataaagaatagattttaagtaaattaaattcaaagattttttaatttctattgcctttattggttggggcagggtgtggagtaacgagagcaccaattttctaaaacgaatggtgtgcttttattccaagttttatcgagacaatactgccacctcttggtcttcagaagaaccaatttcccttgttaaattccttaaacagaacatttaatatacaaattcagtacaaattgtttagagccactaagttaggatattttctagcaggagtgcatcagtaaacggacagtgcatcctgacaaaatgtgcgaaatgcaatgatgaagtcaggctatgttagctatgatagaagcaaaaggaggagtaggaatctgagaatctcggtgatttgaataaatgccatggccaaggttagaaagatgatccctgagtcataaagatgctgcaggtgggacaaagaacagttctcacctccgctatccccttctgcagtgcctctatcctcccaccacactgaatttttctttatccccagtctcaccacgctgcgtgccttgtggctctccaaatctttgtacatgtgcttgctttgccagaaatgccctttcctggctaagccatgcacttccttcctcactttcataaactcatttctgaaaccatgtaaaccagaaactactaatctcagctcaaatatcaacactactgaaaagccttctccacctcccccagatagttacttcttatacacacagcatttttttctttaatattgtacctactgttaatttttaaatattttattttatatactttactagtcttccctactaaattctgtgttccttaaagaataagaccttgtcagtcaggcacagtggttcacacctgtaatcccagcactttgggagtccaaggtgggcgaatcatgaggtcaagagatcgaggccatcctggccaacatggtgaaatcccatctctactgaaaatacaaaaattagctgggcatggtggcgcgcatctgtagtcccagctactcgaggctgaggcagaagaatcacttgaacccgggaggtggagattgcagtgagccgagattccaccactgcactccatcctggcaacagagtgagactctgtctcaaaaaagaaaaagaaaaagaccttgtctatcttagcttgcttaggttgccataacaaaataccatagactggatggattaaacaatagaaatgtatttctcacagtcctggaggctggaagtccaaaatcaaggtgcaagcagattcagtttctggtgagagccctcttcatggcttgcagatggctgccttcttactgtgtcttcacatggaggaaagagagcaagtgagctctctagtgtgtcttcctgtagggataacaatcctgtaggatcagggttccaccgctctgatctcatttaaccttaattacttccttagaggccccatttccaagtacaatcacattgggggttagggcctcaacacatgcattttagggggacacagttcgatcaatagcactattttatttattagtattcaattttatatagaaggtactgagtatattatttattggctaattgtttggctgacaggctggcagggataaaaataggatagatggatggatagatggatggatggatggacggacggacggatgggtaatatttattaaaagtgccagtgcattgcatagttctaaactgtttcaccttactcacctgggaattttttctacagaaatatacttctaagtttataattaaaatcagaaaaataagagttactttacagatgttttatatatcccataaagtcagcactacttatagtacttttttgcataaagttttttaagtaagagtttgcttttgtctttgtaggaaatcatcagaaagaatgaaatgctcttactagtatctataaaactgttattcaactgatattagagaggaagcatgttttcaaaaaaaaaaaactctgtggtatttattaattgctcatgaatcccagaccagtctgggtcagaaagaacccctcacatcttggagaattgtgtgtatcccctcaaaattcatatgttgaaatcctaatctgcaatatgatggtattaggaggtgggatctttggaagacaattaggtcatgagggtggaggcccccttaatgggattagtgcccttgtaagaagagacacagaaccttatttgctccctctctattctgcactatatgaggacacagcaggaaggtggccatctgcaaaccgtgaagagaggtctcaccagaccccaaccatgctggcaacctaatcttagacttcccagtctccggaactgtgagaaatgtttgttgttttaaggcacccagtctatggtaatttctcacattaaccaagactcactgagacaaggggccactcaaacatactagcctagggcaactaaaatccagtagatttcttgactgtcctgaacagggaagaaaatggaacttttcagcgtgcatgtgctttggcacatgcagtcataagcaaagaaggtatttgctcatggtattgataggtgatgggtggtagaggatatttctagcctggagttgggtgtggcatggattcaacaaatatttgcttattgctaacatctaaatttaagtgttacagtttcagtaaaatataatgtttgatttagcagcttcagttgtagcaaaaaagttcctagctttaaaaaaaaaagaactcatcaaagactactaactgctgattttttctatgtccaaccctgtttctctgggctcatttcctcatttcacacttgggctaagaggggcttcatgggaagcctcagccattacagatgagctgtgccccatcctcattctacctgtatcccgccttttacgttccaaggctaattaagttcagcaataggcttgatcattgacccttgtcaagttaggaaatcaggttaagcaataagggactagttcacatttcctagttattcaatcctgttacataccaaatacatagttaaaacattatgggaaaattttgttactcgaatagcatggtatgtctctagtaaatacatcctaaagggtaacagtgtgtgtttttgaaaaaattatttgtttgttgttgttgcattttgtttgttttgagacagatgctcactctgtcacccaggctggagtgcagtggcacaatcttggctcactgcaatctctccctcccaggttcaagcaattctcccacctcagccttccaagtagctggggctacaggcgcgtgtcaccacacccagctactttttgtattttttagtagagatagggtttcaccatgttggccaggctggtcttgaactcctgacctcaagtgatttgcctgcctcggcctctcaaagtgctaggattataggtgtgagcctcagcgctcagccaattatgttagtcttaaactttaattattttgccactgatttatattgttttagaggcatttttattccatttctgtctggtctttattttgccttgaaaacttgatttttttttttttacacgttttctctatcctgtatcaatcctaccttcattcccccaaatctcactatcaaataccttatatgtagttttgctttctagcagagctacgcacagtaactcaaatacccttatatgctcttcggtgtgtttaacaggttcagggatgatattggcctgggctgagaaacactgtttataagcttgaaatattaattgggtttattttcttttgtaattcctagatagaagagcgagcagaatttttgaataagtctgtgcagaaaaggtaaatatgcttgatggttcaattgagctaatcagctagcatatgtatgagaagattctctctcatatttttatatgtatgtgtttacttttttagcagtggtgtcaaatcgacccatcaagcagcaatagtctccaagattgacagcagactggagcagtataccagtgcaattgaggtgagaattgtcctcagcgttatggtcctgctgaacagaaatagattctgactacatagaagagcataaaaacacttaggacaataatcaagtccaatagccccaggagtgttagaattttttttttttttttttttgagacggagtctcactctgttgcccaggctggagtgcaatggcaatctcagctcactgcaacgtctgcctcctggggtcaagcaattctgcctcaacctcccgagtagctgggattacaggggcccaccaccacacttggctaatttttgtatttttagtagagacggagtttcaccctgttggccaggcaggtctcgaattcctgacctcaagtgatccacccgccttggcctcccaaagccgaatgtgagccaccacacctggcccccaatagtgtcagaatattaatgatgctttattacactttgaaattctaagttctaagaaatacaataataaagataaattttaggagagttttaaataaattattttctactttcagcgtgaatattgtttaatgaaaaggtttttttgtaacgaatgggtttactggtatttaaatatatatatatatatatatatatatatatatatatatttaactatatatatatttaagtcttctttcaagtattctgtcaaatctgggtttaaatgtcacttcctcagagtagccttctttgcacccccaaactaagtactgccccccaattgtgtgccatgctttatggcacatcattatttttcatagcacttagcacaatgtgaaataaatacttgtataactagttactatctttcctttctattaaaatataagcccactgcagctgactgtcttgttttttgtttgtttttttgttttttatttttatttttatttttgagatggagtttcgctcttgttgcccaagctagagtgcaatggtgcaatctcggctcactgcaacctctgcattccaggttcaagcgattctcctgcctcagcctcccaaccgtcttgttttgagcacgactgtatccccagagcctagcaaagtgcccttcatacagtaggcatttaagaagtattgttgaggccaagtgtggtgactcatgcctgtcgtcacagcacttcaggaggccgaggcaggaggatcccttgagcccaggaatttgaaaccagcctgggcaacatagggactatgcctggctaattttttcatttttttctctacaaaatagagagaggcctatggttccagctactcgggaagctgaagtgggaggatcacttgagccctggaggtcgtggctgtagtgagccttgattgtgccactgcactccagcctgggtgacagagcaagaccctgtctcaaaaaaaaacaaaaaagtatctgttgaagaaacaaagtagaatatcaatttcacaacaaatggtgtcccaacaaaaagcatatttcatttttgaaagatcctctgatctagctgtgatggtttattttgagggacatatgtcatcagcatacagttttacaacagaaattatcactctcatttttggtggaggtgtttacacaatgaatttttaagatgataatgttgaggaagacaaactcactataattttatgagaacaaacttcccagcaccaatcctaaaaataactcacaaatttcagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggtgagcatctgatttttgtctcttaagtgtagaggggcatatttttttgcatgtcgattttgatttaggaatcacactagtaaataataaaagcagtgaagaaggtgcaatttgtactttgttttgcaatgaccacaaaagcaagctcagagagaatgtgtttgtgaggttgcatgaggtactaagcccgggccatcttactccaaataaagtgcctgggctgaaatgtccacccttggagttggagtggggtgagttaccagggaaagaaaaccagataacatattctgtaaatatcaagtgttaaggtttatggttatgtgaaatcatacttaatgatattttgaatttgctttgaaaattccttcccaggtaaagtttacttcattctttaatattttggatgattgcccctttgtaggaaactgctggcttgaaggtaggggtttctagccgcatcaatgaatggctaactaaaaccccagatggaaacaagtcacctgctcccaaaccttctgtaagtacctttaggtttttctgagtttctttgatctcccagcttctaccagcagaagaaaacaagcagttggtctgtttacctaggaatggcagtgcccctgttctttgctttccctgatgaatagcaaacaggaaagtgttcagatttacaacagttctaagaagctgcatctcagttactcagagggtaaaatggaaccaaataatcacctctacaccctaactgagaggaggaatcagctagaatactgaggcagttcaaatttagatcctttactcgtctatttgtttagcttctattctataaattctggatagaaatttgaaaatgaaaggtcacatcattttggctacttctttgtcaagagcacccctaaacttattcccaaaagaatatgtatgttgcctattgggaacccatatgttccaatttgcctcatttttataacttggcacaaaaatgcagttattgggtagctgttgaaataattggtctaattgtgttgtcaacacctcctgaggaaagtcataaaactggaaactagaaaaactggttatgaatgatgtttttgagaatctaaaattttcttaatttattaagtgcagctatcttactaaaaagtacatttcttttcacctttttgttgaatgtatacgacaattgcttgcatttgtcattataataagaaaacgtatcaagctccccactgtatattgctgagctttccctgttaagtttgcttttatagctttgttggtgcccaagggagctgagagtccactgtcataatcctacattctagaggaagaagaaaaagtttccaatcctaggcctctgtgcatttaattgcatccattggctccatgccatttaattgcatttgttggctccatatataatctccaaagtcattaaattttgtcactttccaatttaaaaaggaagaaatggaaatgttcacaaatccttcttgggcacaactccttgaaccgtttaattaatctacaccccgagattctttgcataaaggctcacaggaggtatacactaatgtcaacccaatttacaattggaaaatctttatacattgaaaaaagcaacttttcctccccctctcaataggtacaagaatgcgggtttataaaaggacacagttgaggcaagagaccggacccaaaagttatgtgctctttagtgcctcaagttttccaagcatctctggtaacataaggagtagaaattattttcaaaaacaaaataatcactggttccagaccagtgattattaaccctttttgaattatgaacccctttaaaacctaatgaaatttaaggaccctctcccccaaaatatacatataaaaaaacaaggcagtctatggacctactgagtaactctcaagatagtaagtaaggagagaaagatctatgtttccctctttgataagtatgaaatatttggaggagatgctaatttttgcacgtttatgatatttgcaatctttcatttttgtagcagattatactcaaaaatttgatccagaacttggcccctattcttttatcagcactttaacttgtaaactgaaaagtttaccatcatctgtatgacatcctaatgaggttaaaaagataaaatgcagttatgattatgataggtataactgtatccaggtttccacagcaaaaacaaaacaaaacatacaccatgttctggggttattgacagcctcctaaaaaaaaaaaaaaaaaaaaaaaggcattgcagagaaattacaaaatcattgcctgctttacctactaattagtatgtgacttgctagatcaccccctagagggtgaagaaaaggaaagaagaacatggcagttagtatagattttagtgagatccttcttcccattagattttgtagactagtgtggcttcctgaatgagaaccagatggaagaaagttctatgaaatcaatgttgtaaatacaccagattgctactgggatgtcccttgctatttgtgggtagaatttataggatttcagtgtaactttgtaactgcaattcaattctgagtatgtctgtttgagctggtttgtctattctttgtgtctaaactaatgttacacagaaattaaaaagctaatttgtctttctttttgtttaaaaaaaaacaaccaacaatgtctttctcagctgaccttctgttcctcactctttggtctctggttgattggaaacctgcttctcctgccttcatttctccctcttcttccggagtgggtctttctctaaaatgtagtctggtcaggtaattccatttatatttcccctttgatttaaaatgccaacttataactcagatgttcatattttcttaaaaggactctttaaactctttaagtgatcttgaaagattcatcggcaggatttatgggaagtgcaatccattttcttaggtagaagaacgtgcatgagaaggaaaaatatttgtctcatatgaatcaaataaacaaagcgataatagctgctttccagagcttccctcagcatgttcctaattatagtttccaaaattttaaaacagtcttccagacagtttggcagcttccacctacgctggcaaatgtagtggaattctacaaaaataatctgatttgttgcttaatggctccaagttaaataggtgtaactctctaatagaatatcaggaattcatgccacagaggaaatccagaaactcagtaaagtttaggcaaatctgaaatgcttcacaggtatcatttaactgtgcattttcagtgttacaatctcaatactatctatcagaaatatgtccatttagatcagtgtccacgggtaaatgcaattgctgttagctttgccttcctcctgagaaaagggtttgccaagataagcattactatttcagtaaaacacatttattttctacaaactaccttttgccaagtactaatataagcaaatgctggaagaaaagtaaattgaaacagaaatttggatccttatccaaatgaaattaattaggaggtagtaaataaagactctaagctgtataactgttatcgatcatattttagtgtttccatcccaagatttccacatgttcttacacatgtcatcaactgtcaacttctcgcatgggttcaatttgtgatgaatgtttatatttgctaggttctactgatccacttctgaattacccacttgcccctcgggagacacataatgattttagggtgaggaaaatgctgctagaaaagggactttgtggctgggcgcggtggctcacgcctgtaatcccagcactttgagaggctgaggcgggcagattatgaggtcaggagatcgagaccatcctggctaacatggtgaaaccccatctctactaaaaatacaaaaattagctgagcgtggtggcttgtgcctgtaatctcagctacttgggaggctgaggcaggagaatcgcttgaacccgggagtcggaggttgcagtgagccgagattgcgccactgcactccagcctgggcgacagagcaagactgtctcacaacagaaaaagaagaaagaaaagtgactttgtttgggctgcccggcaacggatcccaagatagtgattccagagcaagttgtttacgtggaggtgaagaaaaccctacaggggctgaggttgggagaagaaggcagtcctcacagaaggtgttattaagcaagtccccacatggactgttaaactttcatccc

SEQ ID NO: 14871 - DNA, 7191 bp, Human
gtgccagatgaatttaaggcccaaaatcagacaactgcaggatttgaatccacgttcttctggtggttaactataaataaaaatgtgaattagataaactacatttattacaaccaatgatgatttttttttttttgacggagttttgctcttgttgcccaggctggaatgcaatggcatgatctcggctcaccacaacttctgcctcctgggtccaagcaattcttctgcctcggcctcccgagtagctgggattataaacatgtgccaccacgcctggctaattttgtatttttagtagagacagggtttctccatgatggtcaggctggtctcaaactcccgacctcaggttatctgcctgcctcggcctcccaaagtgctgggattacaggcatcagccactgtgcccagcctatgatttgttaattatactagagatgctcttaaagggacagctgaacaattaagacccaccagtcaaatggcctgggaaaataaaatagcattagacatgataccagcgaaagagggtggagattgtgtcattatcggaacccgatgctatacttttatccctaataatactactccaggtgggatcacaccaaaagcactacaaggtcttactgccttatcaaatgagctagccaaaaattctggactaaacgaccccttcacaaatttaatgggaaattctttggcaaatggaagggatttatgtcctcaatcctcatgtctcttgccatcagaatagggttgcttattcttgtaggatgctgtgtcataccctgtgccctaggattaatacaaaagctcattgaaacagctctccccaaaacctccctcaatcctcctcctcctcgttccagtgagctttttcttttagaagacccaagtagaataacagagccaaattatgttaaaagggtttaaagaaaaaatactgtaaaatatttaacagggggattgttaaatacagtaagaaattcttcttcaaaggttcagcttgcttaagtttccttgttctttgctccctgctttcaaggccagacttccttactctctgtgttctccctgcgctggtaaacaaccttcccgccagtcgttatctatagagcccacattccacatctgctacccactctgtgaattacccctcccatcacaatggcttctcccggcaaaactgatcttcctgccttcccagcagtgtaatcacattcctgcacttttcaagttagccaaccgggttcagcttagattgtacggtccaactctagccaatggagtcaggatacagtagcagggacaagctgcgttagacataaaaacctctgctttcctttgttcggggtgctctcgtggcaaccgaacctatgaggagcaaccttatgcaaaagtaaatttgccttgctgagagaccctttgtcctttgtctcagtgctagttcttctttgcagcaccaagcatttgttttcaacaattatatatttaaggaatctttgattatggaaaatttcaagaagtagagggaatagcatactaagccctctgttcccatctttgagttatctacattttattagaagtatctttggggtgactgagggaggtttctctttcctggagggcttctgaattattgccaatgtaccttcctgactgcagccagaaactgaggcccctatacctatgtacctttctatccctctctgaagcttctgcagaattcccagcaagacagagcttgctggaagcttggtatgctcagaagcagctaaagcgtgtatgtggggcggagggtgggggcaacttcttggtcctagcacttccatatattgattttcttttctggctgcttagtgggaggagtgtgtgtgtatgcatgtgtgtgtgtgcgtgtgtgtgtgtgtgtacatgcctgtgtgtgtggatgcatgcatgtgctgtgaagcagggagaccagctttccgctccttcttgttttctctctgcagtgacctgggagctgtcatttccctcctgctctggggacgacagctttttgcactgtactcaggcaatgatgtcacggatatttcaggtcagtctttgagttgggtaggagcatgcatccctggcactgccacatcccactctgactctctcgggtctgcattctttctttgagaacacacagttccccattcttatcctgacctctgggctttcaggactgccaagaacattggggatcctgccagaaatgaggggagcttgagctttcgttggcttctatttggggtagaaggagattgatgtgcagagcagcttccactcatctgacttttcatgggtctctgggaacaatttccaaatggtaaactctctggcttctctctctttgcagatgaccgcttcccgaagccccctgagattgcaaatggctatgtggagcacttgtttcgctaccagtgtaagaactactacagactgcgcacagaaggagatggtaagacctggacaactatctctgtgctctacctacaacccctgctctgacatttccatgatgggtggtgctgaggtgatttgccagaaagttcgttgctctccttggagccaggagatttagattctgataagcgttttgtcgccagtagccatggccctttgggcagactaacttttgtcagcctcaagttttctgttttgttaaggggaggtgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatatttatttgctcacttagtccttacagtttcccactgaatagaggttattattctcactttgctgataaggaaacagaggcaccgacaggttgagtatcttgcccaaattcaggtggcctgtaagaggcagagtcaggatttgaaccctgagccctccctgtactgcttggctgtgaccgccatgaccacagtgtgttctgctgggcttaactggtgtccaggcacttggcttccagcacagcactctttcccttcctccttctcatattctctctcctttctcccttcctgtctgcctcctttcttcttcttctttttaattcttctccttaaatgccttctcactctgctctgggtgcagacttgacttttcctttggctcatttcttgccttttgtttcaggagtatacaccttaaatgataagaagcagtggataaataaggctgttggagataaacttcctgaatgtgaagcaggtgggtgctgagcactgagcacttaagagagcaggcaggcgtccagcggggaacgtcctagaggcacagccttccagtgcggcttcctctgagcacacaagagccaggaggagggatgtgggagaaccgcagctggccagggagagacttaagcagttaggtgatgactccctaaggatcaccagggtcttgttcattggggcctgaagggcactggctgaatccactgtcggcattgcccacagatcaggagagcctgtgcatacagagagcctgctagagagccctgggtctaaggagaagcaagctccagggagaacaagtcaagggataacataaaatcttaatccatggaagcctagcaggaggctggacatgggctggaactcctgcttctcgttattaggaggaactgttgctctctcctttccgtctcagaaccagaggcaaaggcccagcctcttctgctgtgagtggtgtggaactaccaacctgcctcgtattaactgcaacatctataaagtatgagctccagccaatgctgctctagattcctctttcttcagagatgatgaattattgtagctcctagccctttcttttttctttctttctttttttttttttttgagacagagttttgctctcgtcgcctaggctggagtgcagtggtgctaattcctgacctcaggtgatccaactgcctcagcctcccaaagtgctgggattacaggcgtgagccaccgcatctggcccctagccctttcaatgaatttcagggaattgtgaaaattcctttgttgagataattgtttaaatataatatagttcaccagccaggcctcaaaaaactcagtatttctcatttccttatttagaaatagagctttttgtaatgtaaacaattaaaaaaattattttaaaactgcaactattggaaatgagatcagcaggtggtaaggacaaagcatttaaatctttccagtttatgcagcagtgacagccgccaatgctttcacccctttctcagatggaaaggctcttgcacatttccactcacgagtgtcttgctctccttgacagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccatttctgtgttgtgttcagtcttgagtcttttttatttgctcctttatggtccagggtagtcagaaggtatagagtctactgggagtatggcagaaaacaccctaaacccactggaaatcccgaaggtgatacaaactcttccaccttagggaatcatgctcactgattgagtgcctattgaatgctaggtcccagaaagttaactgttgtccttgttttacagacaaggaaacagagactcagagatggtaagtgagttgcttaaggttacatagctatgaaacagggaagcagaactttgaacccaggtctgtttgatacaaactcagaggtcctttcactgcatgctgttgcctctttaaagcgaattaggagaaagggcatgggcctggtgaggaagaggctagctcaaaatgggatggggaaaaagtgttttaacacagacagtacttcagagtttgggatctaacctaccagcactccagaaaacaaaagatgatgatgtaaaggcaggatctctggacttgctgagtccaaatcatggcttggcccaaacatttgctaagtaatttaggcttcctggccattagttcctggtctcttccatgaaggacttgagccagggtaacgtccctatcagcaataagcttctgggactctgtaaagagtggggaggtagagtccctgcctcagtagaagctgcttttcctacttggaacaaacccacccttcaccaggaatcaaaagcaagctgtctgagcctcctctcctgatggcaggtcatgctattaagggtctcccagaagaaagcttctggagctctgagaaacagaagctcttctaacagaactttttcttgctataagccttcaataccaccaatcaccaatgtgccttcttctcatgcgaaaatacggcccctcctttgcagggtgtaaaatgacactgatgtcactctctctcaccagggtctggccatctctgtgaagctctcctcacaggcaccctgcagattcatcaataaacttcaacaggttagcgctagtaggccaataagacctatattctagaacctgtgaaagagataatagccagaaactggcaaacaccagtcaaactctttaaaaaaatgcctcttagaacacagtcacttacacattttcctagatctcttcagcaccaagtttcttggaagaacaaggcactctgcagttttcttaaagaattgtctgattgtattaagtggcttctggtaaaacaacagtaagagaaaagttctggcattctcttgatcactcatcttctctgccttcctccccagcaccacctcctggcctcagcctgtgggcttctgcaaagtcaggtatcaggactaattagctagcatcaaattcctgttaattccagaagcagggacaaacctgttggggagggacttaatgacaaaattaggtataggtctatacgttaatcaaggaaaattctctacttccttaaacttacttaccaccctagaggagagccaaatccactctgatgacgtttggtcataggaaggaaattggggaaaattacaagtttctccaatccatgtaaaattaagaaatcctggggaagttgtaaagagaaaacagtaccctattcccttgaaaggcagaataggtttataacttataatcgaaggtctccttcaggaaggacttcttgaaccccatatgtcctcttacaacactccaatattgcctgtaaaaaagtcggatgggtcatagcggctactgcgagaccttcgagccattaaccaaatagtccagaccacccaccctgtcattcctaacc

SEQ ID NO: 14872 - DNA, 19986 bp, Human
  misc_feature (1)...(19986): n = A,T,C or G
ctggctccatgaagggcggcaggagccctaactcatttaatcctcagaacaattatattattattattattactattattagagacagagtctcgctctgtcgcccaggctggggtgcagtggtgcgatcttggctcactgcaacctttccgcctcccgggttcaagcgattctcctgcctcagcctcccaagtagctgggattacaagcatgcaccgccacgcctggctaattttttttttttttttttttttttttagtagagactgggtttcaccatgttggccaggatgatctcaatctcttaacctcgtgatctgcccacctcggcctcccaaagtgctaggattacaggcatgagccacggcacccagccaacaattctaaaaggcgtatgcccacatgcccattttgcagaagagaaaaactgaggcagagacaggttatataatttgctcaaggtcacacagcttattctgggattcacacccaagcagcctgattcttgagtgcctactcttaaccactgagtcatcctgcctccctaggggctttggtgaatctctcagcaaggtggatgggtacctctaaagctagcttttgatgacttctccccccagtctgttcctgcaagtaactctaaacacattcaccctaggcaaagaacaagtggttttggaacctgcattctctattgcccctttgagactcgctctgggcttggccctctctccaagggacaaccctctctctgtctcctcctgggttcccctctcccccagcgacctccttttcattctcacttacctccttgcctttcactctcctcttggaaggtggttcagctaacactcattagcacatgttaaagatcgccaattcatgtctcagtcactccgtagcaggagaggggagaaaggagggatgatgctgtcactctgtgggtaaggtgtcttaccttaccacaccacaaggccaggacagacccctaagggctcagaccgcaggagagaatggggagagggcccagctccctgctggggagtcctgtctgctgccctcaggatgtgcgctcagtagctgcgtctattttctctgagaccagctcagaacatccccaagacagagttggacgttgttctctgtccactggagcaggcacattcccacgatgtccctaggtgggcgtggttaagacctggtacgggttgatctagttctgccaccccctggccaaatgtctaaaagccccccagagcatggccagcgtgaggcaggtaccaggggtggagggaggctccgaggggacggatatacgaagacccaaacagacagtggaagccccccacccccaccccacaccacttccatcggaatcctcccggggcactgctgattccagctgctccccactaaagccttgagaactcttggctgctctgcaagactgagccccatgaaggagccacgtgcggcgtggaaagagtgctgagttcaaattgtagccctgccactaatttgctgggccagtcacttaatcatctgaagtcacaagtacctcatcagaaaagtggtcccagctcttcctgctgtggaaggatcagaagagaggaggcacgacagagacctagtgaactccgaagcccgagtgctaaatatttgtcaagtttgtgttagtattactattagtgttgttactgctgttattattattgctactgccagcaataataagtggtggatgtactcaagacggtcgggagggaaggcaagggcagcctctccctcattttcaccgaaaatcctccgggtgtccctggccccgcgccgaggggtctcagcgcagaggtaagggccctctaggagtccgggccgagcctctcgcgccgccgcccccgccgcgccgcgccccggtcggattccctgagcgcgcgcgcccccttctggcggccgggcgcaggcgcaggctccagagcgtatataagggcagcgtggcgcacaaccccagcgcgagtgccagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggtcagtaaagctcccaacttctgtgcccattggcacccaggggacctgcggtgaagggggcagggggcggcgctgaatgcgggcaggtgtacgtttgccctcaggaggtggtctggtcgcagagcctgctggggtagtggtcccgggtttgggagacatccggctgctctgggcacaactgtcagtaactttcttccctaacatagatgacccagagcccacccgcatttgcacctttattctgagcaagtgggagctttctcagagaggtggcctgggctgggaaggcctccaggttccccctgccatctcccccacctcccctgccttcagctgctccagccacaggtctcagaagaccactcatttctttcctcctcttccccttttgttgaatgctaggttagcccccttaccctgctggaggctgggataaattaggggatcctgaagggaaacgtggcctccccagcttgattggctgggagcaggagtggaaaatggcattgggggccctgaacacccccctgcttcctttgtccattttccagccgccgtgggcatgtaggtttcccaatacagcagcagtgggtgtggtggcgggcagcgttggggtgccagtcccagacctgttccctcatagtgataatcctgggtactcttggtgacttcatctctgggtagggggaggcaccaccctaagtgcctcagtgactaaccctctgctctgtgtggtcttgacactgactcacccaaaaagcaagggccagaccaaatgacctttggaggtagcccccagcactgggattccaagtgtctgtggtggtctgactcaggcataaagggtggtcctcctttagaggcttttgatatcactagagactctgtttctgttactccgaaaaaataagtgatctgatttccctctctacgcacagacctggctaagatgagcatccaaaatatcctggcatctcagacattttgtggtgtctgtagctaccctcccctcgggtagctaatggctcctggaggggctgaccccaaagggaggccaacgggaaaggctaagacagatgctgtctccagaagacaagttcttaaccactgcactgcacagccccccagggggccaggctcagccttgtgggctctgacacctgtcattcaggcccctgtcccagatctgtgtgggatgacagggagtttatcctggggtctgagagcaagggggatggaaaacagaggggcatcaggtgtgcctcactccattcttccctcctcccttcctcgccttggcagggtgtggaggtggctgggcagagatcctctgcccagagtgctatggggaggcaggggttaatgtctggggatgctaatgggtgaaattttgtttccttggagccaactgagaaagctagaggggtaggggactaggcatttgaatacctgagttaggactgtgatctgcctatgaattactgatggaagtgggtagattgttaaatctgtaaaatggggctaaggagggattgtgtttccaatccccagctcctgccataaaattcccttggtacaaagtgctctcctaagagaagtgcagccttttagtattccagatgacatgcacattccctaaggaggctcctgccagtttatctgcaccagacttgcatgattcaaggaaagttaccaagcagccaaggttacaccactggcttcctggtagatgagtcagctataaacagaggactctatagttctactttcccccattctcagagggacaagcaagagcactgtccataaccacgcagatccttacgttgatctgagacattgtacttaagcacaattgcaccttctcaaggtgtgaggctgctgggcagaccatgactccccttatacagatgaggaaacagacacaggggttgacttttccgaggtcatggagcaagttactggtggggctggttcctggccagcgtttattctcccactctggttcctgaacacctgcttggtttggaagagggtttttttccatgatgataggtataagtctccctcccattcccccaaagaaaagcccccagcccacccttggggttgatgggcagtttcgtgtatcccaaaatggggtccttggcttggctagagtgtagttaagctaccaccaaacccatgatcttcaaagcctcctaaagccattgtgcctctggctccctcctgctccggggtgaagggggagcttgatgcttgcaccttcttccttgtccatcagacttccactgccatctctacatcacagcctcagggaagtcccaaggaaaggccatggacccgacagagaaggagggccatgaggattaaaataccagagatgagagagaggtgacttaggaagatatgtatacagccaaatcggaattccacaaaaggatccagaattaggctttgggcgaccttcctcccctcctgaacacccaaaggctgccaggtgagcccaacaccgcagtgcctgaggcactcccagccctgtttaggcctctctcctaccaattctggtttccgttttcaacatggggtttcttcccaattctaagagtaccccctaccactcacaatcttaaaaacacctgagagaactctcccttgcagctctccaggtccctggagtgggctcgctggagcccaattaaccacagcccccagagagttggagccacctccccaccccttctggatgctggctggtagtaaacaaagacaaagagaccttaggaggcagctgaatcccaacgagagggaggatgggggcaggaggacccttagcccattccaaaacagaaaaagccaccatcaccctaaagagttggattattttcaaaattcttattagctttgtggtagagaaaggaagaagtgtatgtttggagagtgagaaactaggactcaaagaggcaaaattcttttcacaagatcacacagcaaagcaggaagaggtgaaggggaaaccaggaatctggtctcctagtccgcaataccactccaccaactctgcctcagcagtcagccaagagcatgcgtttgggagggttccaacgttgtctctcaaaggctgaggtagggaagatgacagccaagcccacccagtgaccctggtggggtctagggctcttccgaacatcacctccatgctccgagtggccctgacgtggccttacgtatctgagcccattgctctgttgcttcctggacacttctgtatcaggacctttccccctctaaaggatccaggtggctgagggatgcccagttcagagttcacactgtcctttatttgtggttctgattagacaggccaccgggctcctattttgctgaccatctgcgagcagcaaagttgtggctccaaagagaaatgccttagcttttgctacccctttgaaagcaactaagaatgtaaagataagatgagttctcttccaggggcaagcagacattcatggggccaaggtgaacatcctactcccttccaagaatctagcctacatagatatactcgtatgtgcgcagaaagttatatgaacaaacatgtctattacagtgttcttcggaaatactaacaatttcagtgggtggaggggagaatgtgcttcactgggggacagaaaaataaatatggtcatccctatgatggagtatgatagagcgaagtgaagcttttgtagtgacatggaaaaatgtccaagatgtattattaagatattgtttaaaactgtagctgaacactattataagcccgtttttattatgaatgatatatgtatgttgcaggatatttagaaaaatacaactgaataatagcggctctctctgaagagtggatgagccaaatgaaaggggattttcttttactttctaagttaatttccatagcacttgaaaattttacaagagcatctatttcctgtgtagtcagcaaaacaataaagatataagaagggaggccaggcacagtggctcaggcctataatcccagcaccttgggaggccaaggcaggaagatcacttgaagccaggagttcgagaccagcttgggcaatacagtgagaccccccctccccccactacaaatttaaaaattaagcaggtgtggtggcgcacgcctgtagtcccagctacttgagaggctgaggcaggaagatggcttgagcccaggtagtccaagcctgcagtgagctatgattgcaccactgcactccagcctgggcaacagagccagaccctatctttaaaaaaataactaactaaataaataaagatataagaagaaaacaatgtgatagacaccttttcttcccttgtaagaaatatgtatatgtctccaggtggggggatctgcctatactcttctgggcttctgtccacctccaagtggcccaggtgacgtagggggtgctcaaagcctctcacagggactgagtcctgttccttatctatgtggaccctgaggattttgaaaataacaacagaggccacaaagggctgaggatggctctacgcaggctcccatcctcgccctctgaaacccagtgacctggcagaagtcttctccaagcccacacaacactgaggaccactcagggccagactgcagtgcccaggcaggctcttccagggcacgggtcactgctcatttgtttgtccctggtttagggaatggggaggaaatttagaacagcagcacctctcagagatgaacgggaacctgggcaactggccctgggcggctgcatgagaggtcctgcaataccaaagtgaaacacatgctgaaatagggtcacaaaatatgtgatgtatattaagtgtttatataaatgacacaacagttacaatgctataaggtaatcataggatttatcaaaacgattgggtcttggcccattaaaatcaacagggtccgacactgggaaccaagattaaagttgtcagaggagcgctttctctgaaccctgttagtgaacctctgggggtctgtatacctctcagctgggcgtggcgtgatgtcaggatatgaggctctcagggaacagccgcctgacccatctggggtaggccctggaaaatgtcccccacccctgcctctgctccctcccccaactccccagttttttcactaacagcgtccttgggttgtggagtgtccacgtgcagcagctctacgctgggtacctccaggtgggctcttgcctgctatggctctgcttctcagactctgattgcaccagccggcagcggggagcagctggtctgtgaagagctggggctccccgggggagcccgcctaagggacccgtttcacaaacaagatgccagccctgcattgccttgatattgacagccaggccggctgtccctgccctgctcagcttgtatattcccctccagacttcagcagctttaccagccaagcccctgagggaggtttccagggctaaggagacccctcagggaaatcaattccaaaaccaaaggagctagaattaatagagcaggcctgaggctcttcaagaacagtgcctctccagccccagcctgccggcggattgcatcccaggccctcctttgccaagccggcccatctggggcctctggcttcagccctccctctgtccttgttggctcttcactatctcccctctcacccaatctgccctatccttctggcctccctcatgcctgggactcagcccagcattaggctgccagatgtccacaggttcaggggacccagcccagctccagaaccacgggtccaaagcagcacagcccagaaacatagattgaaattcaagtgcccaaacattcagctggtggctggtagctcttcactctggggcttattcttttttccagaagccactggaagaagcgtgtgtgtgtgtgtcagagagagaagccaggacaaatgcagatatggacagacattgtccctgggacaaatagaaggaggccaggacctctgtcagctgtggctgaatctccttccccctccgattcctcctttctaagatggggttgataactgcttacctggcagggtcgtaaagaacagatgaggtgggaagtggaaagctttttgggaatggtgcgcaccaagcaaagcaggattaatactggggcagagcctggggaagccaatttcttaccccaaagggtaggatttgactgtcccagagggtgctccagatggaggttagaggactgtttgccttcgataaatctgaactccagatagaccgacaagcggcctggcctcctggatgccttctggtgcagcttaacgaggaaattccttaacgaggaaattctggtgcagctcaaggaggaaggtgcaaaccttccctcctttgacctctctaatctatggactgcgagtgctacacagactggtgcactagaagcgactggacgcaacatcttgagtgtgctgaagggctggttagaacacaggcttctgcaccccatccccagagactcagattctgtagtccttagaatttgcatttctaagaagcccccaagtgacactcatatgtctggcctagaccaaaatttgaaaaccactgagcaaatgcgtctcagattttagcacactgatgaatcaccaagacagtgtgatccatagattgttgggcaccaccccccagagaaagattcagtaggtccaaggtgggcctgggattctgcattcctaacaagcacccaggtagttccaatgctactggtccacagactgcactttgaacagcacggcgttatgctccaatcctactgaattaggatctccactttaataagtggagattattacggtactttttatgtaccctaaagtttgagacatgctgctctgaagcggttccaagcctttactgttctgagctttagaatcacctgcagagctttgaaaacacccccttccccccatccattaaatcagaaattctggggatggggccaaggcaacaatgttgttttcagatattcccaggtgatcctaatacacagcctcaactgagaaccaatattcttttttctttctttctttgttttcttccctctctctcttttttttttttttttttttttttttttttttgagatggagtctcactctgtcacccaggctggagtgcagtggcaggatcttggctcactgcaagctccacctcccaggttcacgccattctcctgcctcagcctcccaagtagatgggactacgtgtgcccgctaccacgcccggctaattttttgtatttttagtagagacgggatttcaccgtgttagccaggatggtctcaatctcctgatctgtgatccacccacctcagcctcccaaagtgctgggattacaggcgtgagccacagtgcctggcctttttttttttttttttttttgagagagagagtctcgccttgtcacccaggctggagtacagtggcacaatctcacctcactgcaacctccgcctcctgggttcaagcaattctcgtgcctcagcctcccaagtagctgggactacaggcacacaccaccacacccagctgatttttgtatttttagtagagatggggtttcaccatgttggccaggctggtcttgaactcctggcctcaagcagtccacctacctcagcctcccaaagtgctgggattacaggcgtgagccaccacacctggcttgagaaccagtattctaaggaaagcagtggtgctggaactcttcaggctaacgggttttcatctataaattgatttagaggaacttaagaggagggagtataaatggaaggcaatatttgttccttccatttatgtgagattttacatctttcagaatgcttccacaacattaccttgtacagctctcaccataactctgtaaagtagagagggcataaatagttattcccattttagagataaagaaactgaggctcagagagattgacttgcccaacatcacatggacagtcatagagcaggcggtagaattattaatattatacctcttactcaggtacctcttacctgttcaactcctagaaaatctgaatgtacaaggctcagggagaacaaggtctccctgaggtctcttttcactgaggggtgaagcctcctctaggcatggcttcccaagtgtccgtggtcagatgaaaggtaaagaagtattgtctcactttaaattgggggaaactgaggcacggtagtggtgcggaatggtagcaagagtagaataaggaaggatgcagggtctctggctctcacttcggctctgctccctcatgttcacaggatgtggtttgataagaagttagaagtgatggttgccatggtaaccacgtctttatcgatgtctttatcgatgcccatccgcatgagccttgcttggtgaccagtcaccccacccgctgcaagagggtcatagaaacatcagaccattcactcagtgccgatgtcatcctagaagggtgtgcaccagcccctcctctaccccagcctctagtgataagggcttcctgcagatggatggggagttgctttgagggaagccagagcagcgaaggccatttgccatccacaatcgagggctgggtgtggagtgtcccttctgggccctgcagcgccacctgccgatctctcctgtgttcctcactgtctgccatcagctgcctgtctgcctgcctctcccaggctgaccattgatgctcttgggaaatgggcccacatctaaaacttggtgatagctccctgagcaccaggcacaaagtggaacagtggctcagttcaaaacatcaaggcttactgcattgaaccacatttctgccttttgttgaggtgcccagagggaggtagtggaattcctagtgtggggaggggggttcctcctgccccgggaacctcctgctgcctgtgctgcacaagctgaattcagagaggcggcttctctccacagggctgcccttctagctcctggacccctttccctgcctccagttttcctccttcctttctctgcccccttcccagaggctgaggcttcttgggaggtcttccctgctcatcctttccaagaagccctggaagtcgatctctactctatgacaccatcattctttcattgctctcgacactggaaacaccatgtttaaattcatttccttgcttattatctgtcccctgccccacccacaccccattacagcataagccccaccatggcaggacctagctggcctttgcacctccagtgcctgcacaatgcagatgctcaataaaggttcctccaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaatgagtgaattaagcctggatcaggaattaggacacttccgttctggtcctccctggctgtgtggtcctgagcaagttgcttgccttctgtgtcctgtgcctcagtgtcttctgtcaccagaaaaggattctactctgccatgcccgtgtgtctggaaagattatgtgtgggttcatttcccccacagcaacccacacaggtcttacccatagtgagggctcaaattatctgctggagcaaagaaagacggcaaaagcgctttgaaaagttaaagacattccactgaccttcagcactttcctgctgggcgaggcactggatgattgtctgagtttcttgaggttgttaaacctccttcaaacctttctagaaaaaaagatggagtaaaaataaatacttattctaagttccagaaaaactccaaggaaaagatggcccctagagatctgtactttacttctttgggttcagagcgttcagtggggcggggctccgtgctagccttgcctgctctagcctccctctgctcccctaaatctttccaacctgaagaaagcagcccagggccaaggtgtttgcagcatgggcgggaagcacaaacagcagccataatggcagtgtccgccggcatgtttgaggctcgctgcaggccagcgctgcgagtgtattattatcctctttaatcttcatggcagctgcatgaggagggtgctatcattgtccccatttcacaggagaagaaactgaggttcacagaggtggtgtcctctaatctgggtacgacagagggaggagaagaaccaggtgtcggtgcctcagcaagaaaggccagtcactctgccgccccccaaatggtaggtgaaggggccagagaagaaatggcagaacatgaaggacctggtgcaaaacagggctccacagagggatgacggaccctgttcagagctaagtggaggcggctcttggaaacataccatgctgctctgcgggcttcccctacccagttcctttcagccacctcccgatacactcatgaaacatatactcgctcctgtgtccgcccagccctggctcctgtggcctctgcttcactgaaccatgacacgcactcgtggtgccagctctgagcccccacctcctgccctagcctcgggcttctggaagctgcagatgcacccagggctgagctcagctttccacctccccgtctgactctacaaagcctccgaggagaagaatgtgactttgccttctcagttgagaagaaattgcacctcagtgataggagaatagccagatcgctgcagggagtaaccaggaagagaaaaattactcattcttccaactcagagcatcatcaactagacgatgtctttttgcctagaaagcccatctccctgtccctcactcccctactttagccggcctcacaggaaccacactcttctgaaattccagttctcctaagaagctttacaaacatcctagaaggaagataaccaccccatcctaggataaaagggaactcaaatctcattctgcgagcccattgcaatcatgtcttttccctgcagacaaaaatacataatttatctcatgtgattcgtgccatacaatatttattgtggcatattcttcactcgagagtgcctctaagtttattaagaatttaaattctcagggggccctaggaggagaggctgggaaaagcctccccccacaacccctcacagaggctggggtaaatgctcctttattttctctgttgcgtttgtaattccatttgcccttggtgaaagctaccacctcccttcccattcgagttgaatctcctctacgggaatcttgctcaagggctttagatcaaatttggaacttgatgttaggtcagtggttttcaaactttgctgcacaggaaatcacctgggagtgttaaaaaaaaaaaaatcatggtgcttagttcacaccccaaacaaattgcatcagaaagtctagaggtgggggccagatatccatattttttttaagatccctgggtgccaggtacctgtaatcccagctacttgggaggctgaggcaggaggatcacttgagcccaggattttggggcggtagtatgttatgatcacacttatgaatagtgctgaactctagcctgggcaacacagcaagaccctgtctcaaaaaaaaggaaaaatccccaggagattctttgccacagcaaagtctaggaggcacggcctgagccctgcctgatttcccacccacaaatgcctccttccccatcacagcactgaccagtgaccttgaccatgcattcagctcagtcctggtctctagtagaccatccaggctcaaggcgtgagagcctaaaggacctctcactacttatgtgatctcgcaagtcaggctgtgacctcgggacctggttctgatcactgcacttttcccacagattcattcccaccttaggcacgggttctggtaatggaactcagtaacaacatttatgctgcactcataatgactagaggatgggctttccatacaaaatcctgtttaattataataacccactttgcagatgagatgggttcaataactgtctcaaagtcacactgttggtaagcacagcagaaccagtctttaaatctgcatccacaggcctcagagcctcctctcttcattaccaggtgggatgcctctcctacccttgatccctgtgaccaagtctcaggtagggcagggggtgggaggtgacatcccataggacagatgccctgtggttctctcttttctgggcccttctgtttttgtttcctaggactgttatagcaaggcactacaaactgggtgacttaacacaacagaaatgtattctctcacatttctagaggctagaagtgtgaaataaatgtgtcggcaggctctgctagagctctgagggtgaatctgctccctgcctccctcctggcttctagtggttgctggcagcccacagcgttccttggcttgtacacacatcacactggcctctgcctccatcttcacatggtcttcttcctgggtctctgtgtctccatgaagccttcttacaaggacaccgaccactggatttagggcccaccccaatccagtatgactcatcttaactaatgacatctgcaatgaccctgtttccaaataaggtcccattctgggggagcactccaacccgctacaccttctgaactccagggaccccagttctgcctctgaccaggtcccgccacttgctgatgacctgtcacacctctgccacctcgtgcttgcccagacattaaggacagattcggaagctgccaacttctgctctcctctgtcctctcggaccctgtgctagttcctcccagtattttctagctgctgaatgtatgttgttcatcttggatctctaggtgcaaatgccctgagggctggacccacacccctagctccactggcctagacacctgcctgttggccagctgggagaagacattctccacgaagcccccgacatgcccaccccgtgccccccttactatttagtgttgagattgattttttctctctctttttacaggaaatgggtatattgaaggtaaagagctagaaaactttttccaagagctggagaaggcaaggaaaggctctggcatggtaagcccagccctgtctccgattgtgtgggattttcctgacctatgcctttgagcatgctgtgtcccagttatgtatgccataagcaggcctcatatcgctggtcttgacacagctttttatttgtaaggataaaaaatagactgtcccctaagagtaccctatctcaatatccttgggtgtctgggattgaggggtattcatgagtggacaccaggggttgatgaaccctcctgcaaagctgcaaagctttgtctgcgtatgcgtatattaatatatatgtagtatttttttgtccctagggacagagtccatagcttccctcaggtgcttaggggtcatgattccagattggatgcccaggaggtttcaagtgccctgattctagaccagagtttctcagcctcagcgctgttggcatttgaggctgaataatttgttgcaggggctgccctgtgcgctgtaggagactagcagcatcccgggatctacccatgagatgccactatcatcctccttcaagctgtgaccatcaaaaatgtctccaaacattgccaaatgtccccctggtgggagactgggggcagaatcgtcctcagaagagaaccactgttctagagcaacacgggctagaatccccagcaaggaactagaggaaaattgaggattgctctcagccagtatctgaaccagacggcactggctggcctcatttgtggtggtgtcacgaccttctgagcctgcccaaagtgactccagatcacatcccagccccttagtgacaggagtgttgctttccctggtgccaacgtggcactactgagtttgctaaagccttttgggggaggtatttgaaatactgcaaagctcaggtgattggaactagtctgctgtgattgccgtgtctggttctggagtacatggagtcagccccacaccctcccatcagctccctcgggtcctctggaggcgtctctactctcccctgctgcgtgtctgttggccaatccactgtttatttgcagctcttcagggagcatttgggagatgagtcacaaatccaccggtgagctcctggttcaaagcttggcagagcgccccaatgaggaggtcaaagtgatgggcttaaagggttggaggcgattcatgggtttgtttatcaacagttgtcccatcaattcctaggataatgaagcctcgatcacagaaagcatgggcttcaggactgactctgggatcatgggctagtcggagaaatgtgtttttatgaagtgctttgcatctagaatccttctcttagtcattcccttcctcagatgtcatccgggtaattttcaagtctgtcaacaatcccaactgatgccatccaggactggttctcagagcagctgttatatggtagaaagaatattggccttggaagcaaaagccatgagttcaaattctggctttacttactgggtgccctctagagaagtcatctcggcctccattagtgtgtcaaatggaagggctactaacttcacaggagctactgtacaacttaaataagatggccacatttgtgacaagtgcctgggatcagactatgtacctttgtaaatataaataaatactgataaacaaataaatattgacaaattgatactaattccaaaagtaaaaagcaatcagagggattcaggaaactctcagaagtggtaggatttcccttggcccaatcctggggagcacacaattcatgtggaagtcatcagctgagtgaggcagaaacatcagccgtgcaaggtgggctcatcattgattagggagaaggaagagctccttaatgcaaataattaatcagcactatctcaaatcaggggaaggttcaagagcttcaagtctatatttaagatagacagctgtgggcttgaaggaatgttttaagttctttgctttctagtagtcagaataattgggtggactgtttaaattacccttcggctacatgatgacctcctcctcatgttcctcctgatatgaaaatcaagagtgaaaatattgtggaattgccagttagtctttaaagaaaatgagcaatctaccttgctgtaatgaagtgcttagaacctattagggggcactggattaagttcagtttgattacaacctgcttcagtaaaatgttgaggccttaattctcacatctgagtgatgggaacaagtccaaacccttcctatagagttgtagcttaatccatctcaaaggcagcagggcatgtttgattacctggtatggagcatggccacgtgtcctttgaaatttatatgactgagccttgaagaagagatgacttaatgtgaagggaacctggaaaggaaaacaacacagctctgatcaatcagagcatcggcacaacttggttctgcacccacttacccaggatgcaaatgatttccaagcttcctgctctgagatcatggttcacatgagatacagcagcaaaaatcagccccctttgtctttccacagatgtcaaagagtgacaactttggagaaaagatgaaggagttcatgcagaagtatgataaaaactcagatgggaaaatcgagatggcagaggtgagccctgcctcgctggtaaagagctgtgtgggaggggccctgggtccctgtgcctctcccaggcatgagcatcctgctgaggattggagtgaggtgggggcctcaaagctcctgcacccccagcacttgggctgaccaaagagaacagcagggacttttcttgtgtgtcacccaaggaagaaggaagtgacaaacaatggccaaagataggggtggagaccttaaatgcccacaggggccaacaggtattgtaaccaagtggcaaggccagctgaagacactagggaggctgaagacaggtgaacaggagactctatgccccacctaaagccatccaaaggcataatttttaaaagttatatacataatttacacacatatatacatttataattcacatcagtaatttacatatatatacataatttgcatataacataatttacacgtatccatgtatacatatatacattcatatatgcacacgtatatacacatacacacatacactcacacatactcatatacaggtgcatgtcaaacacctctggtaatcagtgaccacagtcaagggctcaagagtgctggccggactccgtggcccatgtctgtaatcccagcactttgggaggctgaggcggaggatccttgaggtcaggagtttgagaccagcctgggcaatataacaaaaccccatctttacaaaccatataaataaataaataagaatgatgatggtggcacaggcattagggcacagctccacccagggtatattgttgggatgctgccttaggttgggtgcctgagacagagatttgagtggaagtggcttactgaggcagaactctccagagaagggcagcaggaaaaggcaggggatagtgctgtgcaaggatgcggtctcaactggagcctcgccttggctaggcttatagggactctggagtgtggactgtgccacagagtgggtcccactttgaggcaagggggctggtctgttgtacccctgtgtcaatcagtcagtggatgcaggctgcccctctttgggcaaggaggggacctgtggaacttccccagcggggcagctctggtctggctgagggcagttcttgtgcaggggcagggctgagctgttagcagtctgacttcatagcagctgagggatggccaacagcctagttatagaggagcagggagaggcaccaagaatggccactatagatgcccatgctgattcaaaggggcttaaaccaagggttgacaggctttttctctaaaaatacagattaaggtaagtgtgttagggtttgtgggccatccagtctctgccacagctcttcagctctgccactgtagcacaaaagcagccacgggtgttatgtcaatgagtgggtgtggccacgtcttataaaactttacaaacaactcctgagccatacttggcctgagggccatagcttaccatgagaggcttctaacagaaaggccagggttagggtttgttccaggtggaagccagggctcccgctctgcctccctgcagttctcttggttctgttctctgccctcaaaataccttcatcctcaggcggctagcaagatggctgccacagcgccaggcatcacatccacatacacccacatgcatccacatacattccacatatacccacatacatccacatacaaccacatgcatccacattcaaccacacacacccacatacatctacatgcacccacatacatccacatccaatcacatgtacccacatccatccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14873 - DNA, 19986 bp, Human; identical to SEQ ID NO: 14872
  misc_feature (1)...(19986): n = A,T,C or G

SEQ ID NO: 14874 - DNA, 4982 bp, Human
cagtcaatagcacatcaaattgattgggaggtatacataattactaaaaagagaaaggaattgccatttgcccctgacttgctccaataactctactcttagggcttagagtgcatccgccctatggtagaatgaggatttcactgtttaaccatatagaattcttatttttttttagaaaagacattatttaacttacctctgtaagagtacaaggatgcttgggagaagactctcattctgagccccaaatttagccaaagcactcacagcagctataatgaagcatacaattatggtacataaatattggtttctcagagttaaccaataaccatttgaaaaaaaattagaaaagtgtccccatgttcagtggagataaactcccttgttttattgagtgtttcttgatcttatttctttgatactgttaagcataaatagaattctgcaagcccaagagagctctgaataggaaaatcttccaaaaattgaggaaaaagattcatatagattttctgtaggagctatatctccaccccaccacaaccccttatatatcacactgatgtcattaagctctaatctcaaacaaccagccccaagcataaaaagaaattctattattaaaattcctctcattcaacaaagattcattgttcaccaaacttttgtcaggaattgtgctaggtactgggacagataaaagacatgtccctgatctcaaggagctacactctagtgggaaagataggtatgtagagagacaattacaagacatcataggtaagtccatggaagaaatatatccaggatgctatgtgaatacacagaaaggaactaaatccgaattggtggtggaaaactaagacaaagagttaatacatattacttgagctaaaatctgaagaccaagtactgttagccagaggaaaaaggcaggataagagtattagaggcagagaaaataacacgttcgaatggcccctgcccagagaagaaagtgtggtgtattactggacagttgggcaaggctgagcaaaggacccatgttggagagcaagaagagacaagggagagactggcaataaaacaaaattagggtatggtttaatctcaacattattattaaaggatattaaatatgagataaatttgtacatttgaaagtcccccccgccttttcttttttttttagcagagtgtaaagaataggcaggatatatgtgagtctagaagcagtcagatagctagggatctgaaacggatgacagcctcaatcagcaccaagaaaatagaagagaatgaagaaatattaaggagacacaattgaaagcgctttgctaaagtaacagataggggctgtaaggcagcagaacaagattctatcttgataactgagtggatgatgaatgtgaggttagtttgaatttcaggttgagtttgaagtgctttaagttatttggacaaacaagttcaggaaagagacatgactggaatgtcacagcctattagcagagctctgaaaatgatcaccaagaggaatgtagatgttgagaagtcaaaatcttacagagaactaatattttaaggaatggtgctggaaagaggagctctgtaaataagagtgaggagtgatggaaacatgtaggctattgtggaaaccaaggctatggggtttcacgaagtgttcagtcaatagcacatcaagtggactgagtgtaaacaaaggtaagaacattaaagtatctaacttgattttacaactagtttataagtaattttcaataaaattacttgaggatttttaagggagagctacattattctgagttaaagagaaaaatggataatgaattcatgcaggcagctaataacggctacttcaagtttatctccgaggggaaggaaagtatagagtcagtagctagtgaaaagctcatagacagtttacatctttaatgggagagatttggatctattcatatgctaagggaaagaaagattagggaggaaaagtcgcttaaaaatatatatatagaaacacataaacaaattctacaaacattcatgcttacggctataactgaaaaaacggatgagccatcatagtattcctatcttactgaaagcgaagggttatttgtctaatctaaggcaaaaatgagggtggaaattgagtacaaagaaagatatctgggccctaagcatgctctaaaatcccaccatccaataaatcctgcaacttcattttccaatttcattatcactctcttaagtatttcaaaagatcagcatcgtcaatatcagtgtcccaatgactcaccagctctgacagcctcattctccaggacaaccctattaaaaataaaacggatatatttggaggggacaggcgttctagggccctctttgcccaacaagtgtagaatcttagtagccagaacagtgtgttcacagtcctcaatgaattcacaaaggtgggctaggcctgcttctttactctcagggttctcttccacaatgctgattatacagtccacaatggcccgcttgtactcaaagcctccctggcaaaaaagaagataaaactgccattcattctagggacacattttggagaaatgcttacactccaaggtttatgcttataatattcaaatttcatttcccaccttttatgaaagaagcaaaagtgttttttctccaagtggggaaagcaaagcaatggcatgtttagtaataagacagtaaccagacttagtgtactacttgagaggcatactgagatgataaggaaatcttaaaacactatggtatttcatggcaatcctaagaatttaagacagcaacttcctatgattaaaaagtagtctacctacatcatctcggagcatgttggagaggaaagtcatcatgacactgtgctttcgagggtatttctgacagagagcactaattgcctgtacaaccaccacctgtagaaaaacaaaaagaatattcatttttatgactgtacaactaccacctataaaaagcaaacagagaaaagacattcatctttataattatggctactaaacatactttcctacttactacaagctaagaagatcctgtagttgcctaaaatgacaataattgttcttcatggaagataaccaaggagaccacaaaggaaaatacaaagcaatgtaaaaataaagttcattcaacagatcccttccctctgtctcagacaaatgatcacatcaaagattttaaagtgaaccataaagataaaaagcttgaacagactgacttccatagaagaatagagaaagctatcaaggaactacttcacaaaatggtttctaggggaattttaccacaattttaaagaccagtgtcagccaggcacggtggctaatgcctgtaatcccagcactgtgggaggctaaggtgggtggatcaccaaaggtcaggagttcgagaccagcctgaccaatatggtgaaataccgtttctactaaaaaaatacaaatattagccaggtgtggtggcgtgggcctgcagtcccagctactcggagagcctgagacatgagaattggttgaacctgggaggcggaggttgcagtcagttgagatcgcaccactgcactccagcctgggtgacagagagagactctgtctcaaaaaataaataaaataaaataaaataaaaataaagaccagtgtcaagatgtgtgaagaacgtgagattttaccctgcttgtggctaacaagttaacctgtcacaatttcatggatgctggtagaaaacaagagactcctggctcagcgatgaaagacagttaactactcacagcagtagcagtagccagagtgtgagcattttggggtgggtctcctgagccccaattcccaaagtgcaatgcaaagagagccagataatacctggtcttgcagtaggctgcattactgaataagaaccctaaggatggaacctgaacattttacagtggggagtaagtatgcctgtccttttttccgaaggaaaacattattatattggaccataaacatgtttactttttgctccagagggctttttgctctaaatactattagtatttcctggggctgcaaggaaatcttccctttcctttagagggagacatgatctctatcttctaaggctagaagatgtcttgtattatagaaagggaatacagttatggtagcaggaaacagagggcagttagcgcctaacttgcaagatgtgcagaaatgagaagagactcatggagaatttagaattgtctaccaacaatcggataaccccaaatccatatatacagtttcagagcatagaaaatgaaagaaaatctccataatgtttgtatgaagcaatgatacttaagcctaataaagatggtatatatgtacagaaagaaaaattacagactaaaatcatttataaataccgatgtaaaaattctaagaaatatattagttaatagattctaacactaccttaaagaaataatgcaccatgatgaaatgggttttatcaagaatgtaaagatggttcagcattagaaaattgataaaataacatcacattcatgagtcaaaggattatatccaaaatgctgaaaaggctttgataaaatccaacatccattcctaataaacattcttgaaaaaaaaaggaacagatggatatgtccataacataaacatatatacttcaatcctaatgacagcatattacttaatatggaaccctgaaaggcattcccattgaggtcagaagtgatgcaaggatgccactatctccacaattatttagcattattctggagatattagccaatgcaattagataagggaaaacaaagaaacaagaatcggagaagacaaaacaaacaaaaatatctttatttttagatgacatgatggtatatatgaaaaccctagagaatgaataataaaact

SEQ ID NO: 14875 - DNA, 20445 bp, Human
  misc_feature (1)...(20445): n = A,T,C or G
ccagtggcctatgaaagctgagccaaagtcttcagatgacctgtggcctcttgagggagcaccttgtcatccacattcgctgttcttcttaatccacagggtaaaggcattctatggagagatacttgtgtagcaccccttagtttagcctgtaagacactcacttagctccaagagtttgccaagcacccaccaaacatcattataaagaaacaagcacctccctgtattgtgatatagaacagtctccaaaatatattgttaggaataaaacaaaaagtataataatttatgtaggataccatttttataaaagaaaacctatatagatgaatatgtatctatgtgtgtgtgtgcgtgtgtgtgtagccaatttttttttttttttttttttgagacacagtattgctctgtcgccaggctggagtgcagtggcgcgatcttggctcactgcaacctctgcctcccaggttcaagcgattgtcctgcctcagcctcctgagcagctgggactacaggcgcacgcaaccacgcccagctaatttttgtatttttagtagagatggggtttcaccatgttggccaggatggtctcaatctcttgaccttgtgatccacccacctcggcttcccaaagtgctgggatcacaggcgtgagtcaccgtgcccagcctccaattatttttatatttgtatgtgtaaagaatgtctctgaaggatacagaagaagttggtgccaataattgtctctggagagtagaagggtgtctgaggaattaagtgagcgaataattccttatattgtaaagcctggttccttccaaacatttttatcctgtgtatgtattatatattcccaaaattgaataaaataatatacataaatattcacacaatgtggccattttgcttctagataagttgtctgcagaagccctcactcatgtaaaaaggagaaaaaatgcaacgttgtttgtaagaatgaaacaccagaaacaacgaaaatcgtcatcaatagagaaatgagtatgtaaaatatgaactagaatatagcaattagataggtagactaaatagataggtctagcataaaatagcatatcacagttaaaggaaatgaacaggattgatctatctgtggattgatctatgtgtatatcaacatagaaaggctcaaaaacatgttgaatagaaaaaggaacataacatagaatatatttagcatacaatttaagtgaaattttaaagacacaccaagtaagacatattttaattttaaagacacacatataaaaatggcctggaaggatattaattcaccatgtactttgccttctggaaggcaaggttgcgtggggtgtggggcttcctccatatctgtaatattttatttcctaaaaataactacaaaaataaaaaacagcaagcaaatatgacaaaagggttaaaagttttaattctgagtgatagaaatatagatgtttgttattttattctttgtgttttaccgtatgttaaacatttccagatatttaaataagagtaaagaagacacatccagccaaggtcctccagatagatccttttgctttctttctaaagtcaagtaaattctaaactaaccttgacattattagtaagttttgctttaaaaaaaataaaattttgtgttagaagttttaaaacatttggaaattctagttgcggcttcagatttcataattcagatgatgcaacaggatggaaccattgtcaaagagaatgcagggacgtttgatgcttgttaggacatgactcctgtacttgcccatttgttcatcctccaacccctctttcttccaaattccatgtagcatattctctccaggaagcaagaagacttgcctggcggcatactcattttccccatgcctctttgctgtttgtggaaaataaagcattctataggcggagctagtgaacgcctcttttaaaacacgagtctccacacttccctgttcactttggttccagcatcctgtccagcaaagaagcaatcagccaaaatgatacctggaggcttatctgaggccaaacccgccactccagaaatccaggagattgttgataaggtgagttgatgccattcaggaaaaagtctgagccaaaatcttgattcataagttgtccctgtggaaaggctgtggttgaacatgaaaaccagaagtttaggatgtttgtggctttgttcaggtttctttacaactaagatgaaataagagtttttcagatgaagcctcaaataatccccaaactgtgagtgtgaccttgagcaaatcacatttcttctctgagcttcattttctccatgggtaaaagaatttgtattgtatcttctctaaagctcttacaagatatgattctagaattactaattcagtttctgatgaaacttttctaatctcaccaagtgaagccaacgtgtaattgaagtctaaggttattaacaatttgatgaagtagtcttggaatgcactgcagggaaaatttttttaaatagattgaatgaagaataatattgtaaaggcaatctacttacaaacttcatacacttttgcccaaatagatagtgttttagtcttttcatagttaaagggtaattcaactaatagaacagaggtgacagtctatagtgactccgaaatgtcatagggcaccaaattatatatggaaaaatagaactcaatgttgttagcagattgatgtgtttttcacttcttcttttttgttttgttttgtttcatttttaagagatggggtctcactctgtcacccaggctggagtgcaatggtctgatcacggctcactgtagcctcaactttttgagttcaagcgatcctccccactcagcctcctgagtagctgggattacagacatatgccaccacgcctggctgatttggggggttttgttttgttttgtttttagagatggcatttcattctgttgctagactggtcttgaattcctgggctcaagccatccactcacctaggcttcccaaagtattgggattacaggcgtgagccaccacacccatccctgatatatttttctttgtgtgattagctatcatctagctatgtagtaaacatttatttgcatattttatgaaaggaaaacatgtacaaattactattttaggtttttagtttgttgccttattttcttatattattccttcttattttttctctctgaaacatcattctatgacagcttggaaaacaagatcagctttttgtgtgattataagagttgggatcctgtatattctgggaactagaaagctctctaaggggccagatgcctagaatcccatcactcattcttggggactaattatttctctttcaagagttctttttttaaataaatatcttggagcttttttcctgggagatgatattaagtcagtaatgtcttcatgtgaatccccagatcagatcaatgttctcaaacttgaatgtgcacatgaatcacctgcacgtcttgataaaccttagattctgattcaggggacctggggtaggtctgagattctgcatttctaccagactcccaagtgctgctgctgctgccacccatggccttgcttgctggcaggaccagagatatatggcatcctacaaggccagtgggagatggggctttaaaagtcagggtgcaggctgggctcagtggctcatgcctgtaatcccagcactttgggaggctgaggcaggtggatcacaaggtcagcagttcgagaccagcctggccaacatggtgaaaccccatctctactaaaaatacaaaaattagccgggcatggtggtgggtgcctgtaatcccaactactcaggaggctgaggcaggagaattacttgagcccaggatgcagaaggtgcagtgagccaagatagtgcctgcaccccagtctgggcaacagagcaagactctgtctcaaaaaaaaaaagggccgggcgcagtggctcacgcctgtaatcccagcactttgggaggccaaggcaggtggatcacgaggtcaggagatcaagaccatcctggctaacacagtgaaaccccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaaatagccggtagtacacgcctgtagtcccagctacttgggaggcttaggtgagagaatcacttgcactcaggaagttgaggatgcagtgagccatgatcacgccactgcactccagcctggccaacaaagcgagactctgtttcaaaaaataaataaataaataaatacaggaaatgaatatcactgaatcatttcatagtaggtgcatttcttgtatatctcctaggtgtctagcattatgctaattattatagaagctacatgaggtctataagatatggcccctggcctctaggagtttacagggtagttgggaaaatcgagatatctggaacataatataaaacaatatccaattaagtgctttttttataatcacaggttttggaccagaaaagatgttagagattgctggtcaaacctccttcctttcaggtgaataattactgtgaggcagttcagctcctctggtgttaaagccccaattatcacttatctgccctctcttgcaggagtgagccttagggcacaatttccaattcagtgttagaaggtagaggaagagttggaaaactctttgtagtttaggaagcactttcacgtcaattatatcatttatgcccctacaaacagccccaagaggcaggtattattataaccgctttataggtgagaaacttgagtcaattccttctccaaaattacagttaggtccccatgcaggaatagggaaaatggatagatgctagtaatttagggacaatctccactacctgtcacttacttgctagttttattattttttatttttgaatgtatctctgttttttaaaatcacctgttaaagtggaagtattctcagaggagctgaagtttatcagctttccttggacttctcagagagcttcttagtggaaggccaactgaagaaccccattagaaggagagaaagaaggaagaaaaagatcatcacatagaaaagggaagagtgtcaaagacaaatgataactgcatgaccaaggaatttgatatcacagtgaaagaggaatattggatgagggcagaaagaaaagaaaggcaaacaagggatggcaattgagaaaacttgaatgtttttgaaggcaggagaaatgagttttcccattctgaagataacagagactgaacatgtcattgtagcaccatgtactaaagtacacttggaagaaaaccctcttccaagattctccgtattagctgatgtcattgctatactcatctttcctatttggggagacaagttgtcaggatggaaaacaactgtggtcttttcattcagaaaacattgattaggtagacagaactgtgtgaattgctatgggggtagcagggacataaaatagtgcctgccctttgggaaattaataaaatagaatggagctaagagggacacatccagaaagacagagccatacacaggcccattcatgaaaagccacaatctgtataacgaagaaccaaataaatgaatggcccaacagcaaaagcctccggatcattattgctgatccattatcttatataatatgttaataagcattttgatgagaattgtgagcatatttatgagaaggaaagaaatgttatttaattgtttttagaggtaagggctactatacatgcaatgtgcatgcacacaacaaacacacacacacacacacacacacacacacacactccccttagtcataaacctaattgctgaatactattcctggccaacacacagaacatgatttttgtcagtcaggacaccgcacaaacacttcatctgcataccatcctgggcacaccctggaacttagcatgtcatggctctcaccccatccacaaatttgcattcccctctctgaccacagcctccttattagtcgcctctcccactgtcccacacccaaagaacctgtcattcagccacaccagaatccttcaggcacctaccttcccaacttcatgagaacatgcccaggcccactgagtctctcatccagcctggaccccatgacaggagggtagcttcaaatactcctccactcatgatgatttccttgaccctgggagctcctgacattctaattctcaattaaaggtcacacccactgccaccactttctatgcagctactactgttccagaatcaaagaactttgccaaagcgaggtgcagaaccacagaaaactcaccattacaaacctgtggattaatgcttaacaacccggacaggacccagggctgccagaacattcttgcagtcatatttgttggtctttttctagaaaccccacaaatgtaaatctctcttcagttgctcattgcctcccacccccatggtccctccagcaggatgtctcagttcctactcttcttaggccagctgtccccaacctttttggtacctttgtggaaggcaatttttccacagatggggtggaggggatagttttgggatgaagctgttccacctcagatcatcaggcattattttctcataaggagcacgcaaccttgatcctttgcatgcagttcacaatagggttcccactcctatgagaatctaatgctgccgctaatctgacaggaggcggagctcaggccataatgctcactggcccactgctcccctcctgctgtgcagcccgattcctaacaggccatggatgggtactggtctgcagcccaggggttgggaacacctgtcttaggagattgcagatctctggtaagaaaatgccccagctgaccctatctcttgctggatctcattcctccctagactctattctcctctcttcagccagtccttcctctcttagccaggtgacttcatttcttgcatcctcaatgccttgtcccatacttccttcttccttcaaaacatacttagacaataaatgtccacaagtcacatcttactggccctactgtcctttcatgttactattcaaactctccttccttactctctaaatctcccccaaatgtaattcatccactttgccatcaatatctttctatctattttctattaaattaggcacagtcctattgtttctgtagaatgactacagattaggggaaaagcctgagtgttgggtgcctcatggctcaaatcctcagatctcagagaataaacacctcaccaagattcatgctcagtagcaatgagaaatgcttgaagaactctgggttaaatgcattataccaggtgcttctccctggtagcctcctccccggctggagaccaagcgacaaacctccactgtattccttgagctcccgtcaccatcacgcgtggcagactgagaaaggtgaaggccaactgcattcagcaggagatgtgtccgttcaccgccagtctcccaccaccgttcccagctggcctgcatcctcctagtgcccatcctggggagtctttcagcaccaagctaccttctgagacttaagtttcactgacaagctcccctactctgcccctttccctgctcctcagctcaaatctcatcactcaggtccatgtcatctaacattaaaccatgcaaatctattttactgggaagagggagggaggctgcaagttacaagtagagtgaaccagaaatcaaggtccacagtctgacaggtgccagaacacttcaagaaacaaaccagatcttttaaatcccctctctcatggaaaattctgcatttgtggattacacagatacgatggaaaagttaaagatttggatatatttctaggacagatagaaataaaaacttagggccaggcatgggggctcacccctgtaatcccagcactttgggagaccaaggtgggtggatcacctgaggccaggagtttgagaccagcctggcaaacatggtgaaactccatctctccaaaaatataaaaaattagctgggagtggtggcagatgcctgtagtcccagctactcatgaggctgaggcaggagaattgcttaaacccaggagggagaggttgtagtgagctgagattgtgccactacactccagcctaggtgacagagcaagactccatgaaagagagagagaagaaagaaagaaaagaaagaagaaagaaagaaagaaagaaagaaagaaagaaagaaagaaagaaagaaagaaagaaagaagaaagagagagagaggaaggaaggaaaaggaaaggaaaggaaggaaggaaaaggaaaggaaaggaagaaaaaaggaagaaagaaagaagaaagaaagagagagagaaagaaagaaaaagaaagaaagagaaagaaagaaagaaagaaagaaaagaaaagaaaggctggttggcttaggatacgtgcttaaaaagaaacatgactgaaaagcagaaggaacacagatcagatatataagttatcatgcaaggactttaaaataactatgttgaataatttttcaactttaagcagtcatgctcaactcatagccttagattctccattcataaaatgaggtttaaatggatactttgggggttagtgtagagattaactctttcaaactcagctcctaacttgactggtgccaagtactggccatccctcctttggaattttgaaaggctttggaaagggaccctaagacaataacctgtttccttactctacttctctgtgcatcctttctccgctctcctgcccctagctcttcccacttctggtttgtcctcactatttgtcttctccctttctccactttgaaatttcatttccatctcaacagaacaatcacacttttcccgtctattctcaaggttacaggagaactgagtggtggtccgtggagtgtttggcctttcagaaatggtctgagaactcacagtttgcatatgtctacatctttgaaaacagttctggtactcaaactgaggcatcagtagtaaaggttcaaaacatctgcccagggaggattgtttgagtccaggaattcgaggctgcagtgaactatgatcacgccactgcactccagcctgggtgagggggagattctgtctcttaaatttaaaaaaacaaaaaacaaaaaaaacctgcccactgataggaaggactgccttgggagaatcctagatggactggaggcctgattgaagttgtatggacatgcaatgctttcatgaagggcataaaagcaagttctcaataaacaaggtacattcaacacagagagttatatcctttttcctccaaaagacagaaaagaattggggttgaaggacaaatccacagacataaagacaacaggagataggcaagtaccacctcagaaataccaataaaattttggaagttggaaaacagatgaacaatggaaaatgctgagcagtctaaacagaagctaagcccatagaggggaaagtctaagccagaagcaagcagattcacactgcagaacgtcacaatggcgcaggcatgagcaacaccaaaaagtcgtagccaggagtaaggtctcagaccaaaagcaagaggactgatctgtatgaaggacagtgagacctcccatagttccttctccctcactgtcctccaccccggcagaagacgagctttacacttagcaggaactgagtcaagagctcatagtagactcttgcatatcaggcccagctgagagtgggaatgaagcactgtacagaaagttgatgggctcagtaaaagtttacatattgaatttgggactgtctcccttctcatgctgggttcgggaatgctgacatttaaacccaacccatatccctccatggtagacagaatgatggccctccaaagatgtccatgtcctaatccctggaacctgtgactaggttcctttacacagcaaaagagactttgcaggtgtgattaagttaaggctctggagatggagaggttatcctggattatccaggtaagcccatgcaatcacagggtctttataagaattatacccaaatactgcactctagttagtatattgttttccacaggggtataggtcaacaattctgaaattattttatgtatatgctagaactgagaaaataggcaaatacattgcaaataataagaaccaggattcttcctcagtgtttgagaaaggagttataataaggaaaagggaaaagctaaatgagtcctgtggtatttgatttattttattatttatttatttatttatttatttatgtattttgaggcagagtttcactcttgttgcccaggctggagtgcaatggtgtgatctcggctcactgcaacctccgcctcccaggttcaagcaattctcctgcctcagcctcctgagtagctggaattacagacacccaccattgcgcccagctaatttttgtatttttagtagagacggggtttcatcatgttggtcacactggtctcaaactcctgacctcaagtgatccacccgcctctgcctcccaaagtgctgggattacaggcatgagccaccacacccggccgtggtatttgattttaatcagaggaatacacacacacacacacacacacacacacacacacacgtacacacacatatataatgtatatatataatgacacacagataaatgtgtgtatatatgcacacacatacacaaatgcgtaaagatgtgtgcatgtgtgagtacacatattattttgtagccctttccactgagtgggcctagaagcaatgacatttagtaacaagagacacagcacccaaatcttgggtcttaaataccgttctccaataaaaggagcagggactccttggagaaatagttgattccagtgaggaggcaaggaaacttcaagataaacctggaacatctgactctacttttgtagagtcagaaagtaaggaagtgcttataaaatgatggaggcatgttgaaagaacacaggcatcaggtgaaggagctcccaacggccaaatctagggcatttgagtaacaaaatagagtaatgaattgtaatccacagagtaaaagaaatatccatgagtcatattaatataaaataagtaattgactacataaagaggagagagggaacagctcttccttatggcagaattccagataataaatgcacaagaaatgattttttaattaccatttggccaacaccacaattaatcattgttgtaggcaagaaccatcaatggatgctaaaattcatgtatgaaagtatggcgagaaacaagactcctcacaagacacttactaattacaaaggggaaaaaaatggtaactttaccgtggagaaacctggcagacatcctaagtgatcaaaattaacatcaccagtaatgaaacgtagctcctgataggatgcacttaagcacaacatcacgtttgtgctatccttacaaacatgtataatactaacataagaggagatcacacaaacctaaattgagagacattctaccatttaacaggccagtattcttcaaaaacatcaaggccatgaacaaaaaggaatgaacccagattgtaggagactgaggagaaatgacaactaaatgcaatgtaggatcctgcatgagatcctggagcagaaaagagacattttcaggaaaactggcaaaattctgataaggtttagagactacttaatagtattataccatgttaatttcctcattttggtgattatactatgttatgtaaaacggcaaaattaagggaactgtaaatgatataagagaattcattatactaattttacaacttttaagtctgaaatcattttaaaataatgttttaatcaagtagtaattattgctccactgatttttattaatcaaagatacatataactcttagagttttagcagtcaaaacgctcctatattgcattaccacactgagttgatgtgaattcagcctaaagcaacaaaatttgactttttaacctatgtaattgtattaaaacaggtgttttctattgaaataataaaaatagttcatagatttcattaccatctttgaagacttttaggaggatgaggttcccagatgggtacattgcatacatggagtctaatatagctttgattatttgtttcctcttttcttttctttaggttaaaccacagcttgaagaaaaaacaaatgagacttacggaaaattggaagctgtgcagtataaaactcaagttgttgctggaacaaattactacattaaggttagagttcagcacctactttagcgccaaaagatgtatttctcattttatgtaaaatattccctgatttccctaccacataattccttccttacggttgtcctaaattaagatgcccagcatgattccttccaagtggtggactctcaaatttggtagatgatgtgacaccattttttttcttgtgaattcagaaagttttattacattgattcttgatttctggaaattgtatagaaaaagatttcataacagttcagggcatgctggatttgtggctgtgctgctgcttaggtaaggagggaggatcacgtctcatctgcctgaaggtgtggggctggaccacatggtatcttgaagctgattctacctcaaagctgtatgattctctatgtctaaattaaataaattaaagtaacgactcaaatcattagctgggaaaataatttaaaccttttttgcccttcaattaatataatgtaaatactattttgtaactcaaattagatttaacttgtggcactctaggcatagtttaaaagagtggagtatttaaaatagtttaaaagttaattttatagctctgtcaaaaaattacacaatgcattgatcgagttctaattgaagttatcaagaggaaaccagttgaacaagtcaaccatgaatatttgagagccatgtttgtccttatatattaagaagatgataatgctgattttaaaaataaaaacaaatattcaagtatatttacttaatctttacttcactatttgaccagggcacagtgtggcttatttctctttaacaaatatttctattaaaatataaacattttaaaagattttttcagcaaaaaaaaaaaaaaaaaaaagtaagtgaagtaagtggagctagtcagctcagcataagaaagtttcagtacagagctatgtacacagatcagccctgttctgccaaatgtgagctcctagtaacgaccaggtcccggggagacacatgtgaaagaggaccctgctgtatcctcagaaaacaatggcaccatttcctccattctcaatctgctttcttcatggctggaaaagaaagttttccagttaaaaatgattatgtgcaaagataggaaacattccatcaacattaacatatttaataatttatgattaattcaaatgcataaatttcacatattaccagctcacatgtttcttcaacagttcatcagataactatcttgaaaatttctgcttgaaaatttgttcccttgaccacccttttgccctctcttaatcagtctcctctctctctctcatcttttcttccttctgctatcaaacttttcctactggatctcagccaccgatcccagttcccttttacttcctggtagtctggctgttgatccctttgctctgaggcactctagatttaaggtcttgccagtgatgtgaccttctctatgtatttcaagtacctatcaagaggtaggtggtagaatggaaggaccacaagcttaggtgtcagagtgtcctgggtttgaacccttgttcaatttgttctatgggaagctcctcctcctctctgagccttcattcccttatctgcacaatgagggtaataatctacttcgcagcgtgttgtgaggaataaataagctggaaatttattgagcacttataattcactatgcactattctaagaacagggcttatctcatttaatcctcacaacaaatctatgagataagtacaatcacttctcttgggttaccaacgaaaaaactgagttccagggtggtgaagaaactaaaaagatcacacaactacaagagcagagtcaggatttgaacccagatagactgagcttaactactggctgtgctgcctctaatataaagcacaaaataagagcttttacaaggttacactggcctggtgtggtggcttatacctgtaatccgaacactttgggaggccaaggtgggaggatagcttgaagccaggagtttgagatcattctgggcaacatagcaagaccctgcctctacaaagaaaatgttttaattacctaggcatggtgatgcacaccagtagtcctagctacttgggaagctgaggtaggaggatcacttgagccgaggagtttgaggttgcagtgagctgcgatcgcaccactgcactgtgagccaggcctcattccccgatcagtaccccccaaaaatgttacattgtagagtgaaaagaatgtagatgctagaggctaacagatctgggtttgaatattggctgtgccactgactagctgagagatttatggaaaatcacttaatctctcctactctgcttccacgtctgtaaaaatttcattgctccacttttcttcaggcctataatataggttaatataatcatttatataaaatgttcatcatagtgtctggctcacagtaaacatttgatatatggcatttgttaaaattaggataggaagtgacatcagaagcacaataaatatttgtataagacaaagcatttattgtctccagcaagaaccaaagtaaaaattcttaccataattttccaggtctcagattcatgtccaaactactgcttctgcttcaaccttcctaccaatgacttcctagtaaaaccccttagcttttttttttcttttcttttttgagacggagtttcactctgtcactcaggctggagtgcagtggcacaatctcggctctctgcgacctccacctcccggattcaagcgattctcctgcttcagcctcccaagtagctgggattacagatgtgcaccaccacacccagctaattttgtatttttagtagagaccagatttcaccatgttggccaggtttgtctcaaactcctgacctcaggtgatccacccaccttggcctcccaaagtgctgggattataggcgtgagccacagtgcccggctggccccttcactttagaagggagggtgtccgccccctgggctctgctcaatcctaccagtgggtgtttataaagtaggttctgatataggtatgggaaccctgcatcccaaattttctagggcaattctgattttcttctcccttatcagactgtatggcaaacaaagtgtcccaagttgagagtcagaaaacagtatcaccaaaaatataggctatcacttgttttcttgctccatgcatctttgaaaataaaatgctgtcctttgtgcccagattatactaaaaaaaataacaaaataaacctaggacctatgcctcttgccatgccattagtctacaattttttttttttttaagacaaactcttgctctatcacccaggctggagtacagtggcatgatctcggctcactgcaaccttctcctcctgggttcaagtgattctcctgcctcagcctctagagtagctgggattacaggcatgcaccaccatgcccggctaattttttgtatttttagtagagacgggatttcaccatgctggccaggcttgtcttgaactcctgacctcgtgatccccctgcctcagcctcccaaagtgctaggattacaggtgggagccacggcacccagcctagtctgctctttttctcctaaaataaggtggtggatttatgaatacaaagagtctaagaatggtggactaggtctagcaatgctgttcctcagcagctttttggacagaagtctttgtagacctgtggctctctcacttgatgtagacccatttgaatgaatctccttttgctttctctttctttaatatttttcaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcaataaagaagcattcttttccaaagaaattatttcttcaattatttctcatttattgtattaagcagaaattaccttttctttctcaaaatcagtgttattgctttagagtataaactccatataaattgatggcaattggaaatcttataaaaactagtcaagcctaatgcaactggctaaaggatagtaccaccctcacccccaccataggcaggctggatcgtggactatcaattcaccagcctccttgttccctgtggctgctgataacccaacattccatctctaccctcatacttcaaaattaaatcaagtattttacaaagtgtgtgtgtgtgtgtgtgtgtgtatatatatactttttttttttttttttttttgagacagagtctcgttctgtcacccaggctagagtgcaatggtgtgatctcggctcactgcaacctccacctcccaggtttaagcgattctcccatctcagcctcccaagtagctgggattacaggcacctaccactgcgcctagctaatttttgtatttttagtagagacagggttttgccatgttggccaggctggtttcgaactcctgaccctaggtgatctgctcgccttggcttcccaaagtgctgggattacaggtgtgagccaccttgcccagcctatatttttattctgaaacaaacttaaacatagagaaaagttgcaaaaaaaaaaaacccactttttttcctggacatttgagactaagttacttaccatgatgccccatcatcaacaaatacttcagtgtgcatttcctacaaacaaggatattctcctgcaaaactgaaatacaaccatcaaaatcaggaaattgccaggtcgcagtggctcacgcctgtaatcccagcactttggtaggccaaggcagcaggattgcttgaggacaggaatttaagacaaacctgggcaacatagcgagaccatgtctctacaaaaagaaattagaaattagctgggcatggtggtatgcacctgtagtcctagctacttgggaggctgacgtggggggatggcttaagcccaggaattcgaggctacagtgagctatactcatgccactgcactccagcctgggtgacaaagagagaccgtgtctctaaaaaaaaaaaattaaaaataaaattaaacaattaagaaattaacactgatacactggtagcatctaatccccagacaccattcaaattaccccaattgtcccaataatgtcatttattacaaaaagatccaagccaggtgaggtggcaagcacctgtagtcctagctactcaggtggcagaggcaggaggacctctagaggccaggagttcaaggctatggtgtgcaatgatcgtgcccatgagtagccactgcatgccagcctgggcaacatagcaagaccccatcccaaaaaaaagatccaatccaaaataacttgctccatttaattgccattttcctcttatttaataccttcattgagacataaattgaaacatacaacttacccatttaaagtgtacaagtgaatagttttataccacattcacaaatgcgtgcagacctcacaaaattttagaacattttcgtcacctcaaaaagaagtctcatacctgttagctgtcacttccccagcctcctccacacataagcaacaactcaactcctaagcaacaactaatttactgtctagatttgcctggtctggacattcatacatgtggaattatataatatgtggtggtcctttgtaactgccttccttcacttaacatagttttcaaaattcatcagtgttgtagcacgtctcagtattttattcctttttatggacaaatattccattttatcaatatatcacacgttgtttattaactaatcagttgacagatatttaagttgctttcaccttttgactatcaggaacactgctactataaatatttgtgtacaaggttttgtgtgtacataggttttcatttctcttgggtatatac

SEQ ID NO: 14876 - DNA, 16573 bp, Human
  misc_feature (1)...(16573): n = A,T,C or G
tcctttgggaattctgtcataaccacaaggttattccccagacatgcagtttggggaaattaacccggcagtagtaaacagactggattagaaaaggtggcagtcgtaataaggatattccaataaccggggaaagctacagaaggatcttgagttaggatgatgacagttacaatagaaaggagaccagtacaagagacggtgaaaacagaatggatacaatttagttgaagaattggctgtgggtgaaaagaagaaatcaaagatgcctgaagttgtgagtttcaggtagcccctgagtttataatcctagttctgactcgtactatctttggatatactagctgctgactactaactgaacaaggtagtaaccttgtcatcttgtaacttacctaagtctgtttcctcctctataaaacaaactatcaaaataaagccgatgaaaagattgaagtaaaacataaaacccttagcacagtgcctagtatccattaagcagtagataaatgatggcggtcattattagggagtagggtaaagaacagaaggttaaaaacatgagtagcagtaaggacttttgggtggggattcggtctttctactacacattacacatacctctaagcagagaaaggggttggaggggagtttgataatgtgactaataatcctcctccccctgggggggatcttgataaaggatagccacccacatggaggcctaatataaactggattgcagaatgcacttgagctgggagcccaagcgggccaggcttcttgattcctattttatcccctttaacctaggatagctaggtctatagtgcagactcagacctaacttacactttcatttgcagctgaagtttcggaacaaagacaaagatagccagatcatattaattacacggataggcaagaaagcatgagccctgaggaggaaggaagggactgtccaggtgtacttacctcaaagatgagaaatatcaaagacaggaaaccctaggttcttgcccttcagtcgctatctccttgccattagtaaaatgcggccgatgaatgtcctcacttctgtccatctgggcaggaggtgggaagggtgacgtgcaaatggatgggaggaacccttttttcggcagcacccaccacacccagcctagtgccacgcaccgcaagcgctccataaacgcacacagcgtcgcctctaccaggatcccgggcggccttcgcgggatttctcctggcgtcggctttcagactcccgagggtgggataaatcgagagggtggcatcctttggcttttcttctcccaggcagctctgaaccatgtttatgcaacgtttaatgggctctaataaaacggctaataattttgatccgcggaagcaccgactcgctcgctaagccgagtctgcgagggtgaagctgcaactccaacgccggaaagcgcggctaccgaaaagcgcatgcgccacggggtggcacgaagctagagtaagctgaggaggtgggcggaaaccatggcaaccatgggtgatgacgacatggggagcgtctctagcgctggattatgacgctggattatgacgcaggcagtgggcgcggactctgcggttcgcttgactgacggcgcagcctccgggcctagccacagcagcaacggcagaggccagcgggcgaggtcaagatggtggctccgcgggcgggggaggcagtggagggaggaggagtcagaccttagccagccggaaacaccgaaacccagagacctcctggggagccgccgccgccgccctctcggccatcgctgcctccgccgcctgctccacctcgagggacgcgagcgggcggcggggctggccgtgagagagacaggagaggaaggagggcaggggcggagttgcccgccttagcccccgcccccggccgcggccccgggccctgccccgcgcggccctgcccggcccaccgagccctggtgtggcagcggctcatggcggccgtggggcccccgcagcagcaggtgcggatggcccatcagcaggtctgggcggcgctcgaagtggcgctccgggtgccctgcctttacatcatcgacgccatcttcaactcctacccggattccagccaaagccggttctgcatcgtgctccagatcttcctccggctctttggtaagggaacagggtaccgtacgtcccgggacggctatgcgggccgagacgttccccggggagcgggcaggcgcgcagaggccatgggtcgagtatgtgtctttgggaactacagtttcatccctcaaagggtcgtctttacgggttgggagggggaaggagatgatacttgtctgagttgacagcggagcagtccccctagcgaggattcagtgttgtacctgagtgaggtggcgagaaagtaaggatgtgtgagcatgcagctctttgcccgtttgccttgggaaatgagtactggcttaccgcgtcctatgcgacagccttcgaaaaacaactctgctatcccagtctcgtcgtgtgtgaccttggacttctgccaaggcgtgggcctcagtttccctttattaccaaatgccgagtacttgtatgttgtcacttctgctgcacccgagggtccacaggatcgtgaagtgtctgcagtaaatgacatccaagcgaaggagacagggttttgaatgtcagaccttgaaaccattaccaaaaattctcatgaaagcggcgatgcttaaatcgagtcctaaaattttccatgaataaacgagaaggtattgaaagtgactgtaaaaagtgatgagacatttgccaaagagacttctgaaaatcattgtctttgtttcgtatggatggagtgttaaaagtatcttatatttcatttcttcctttccatcttcacttacatcatcagagggagatgcatttatgcgtaaaataattttttaagtaattgtaacttggcaaattttgttgatgaggtaattctggtgatcggtcttaagtaggctagtgcttttgaagtgttgctgagggcagactgatgggtgaggtctttaccaagcctttctgaattacaagccatctgttgctttattccttcaaaagaggagtggcaataaaggccgaattttgttcttagcaataaatagccatattttacatttatctggtattttccttttgcaaagcattttcactggtaggtattatctaacctaaccttcaaacatcccccagaggtgggtggtggtattgtcattttacaaaccaggaaacagggtcatagaggttaagtgttttgctcttggtaggctgccgctaagtggttgccagagcctgagcttaaaaatcttttgacattaaatatggtttactttcctccctaacagctgcaatccagatacagaatgcagtagtaatgatcatatgctagatcttaaaactaaagatgtaaacgtgatgttcagcccaagctgcttcagtaacccacctgctacctaattccagcctttcctacttgccactgctaacgtataccaccaccataatttgtgttaaaaactgggctctgtttgagaggattctgcatgttcatcccagaaacagtgtagtgactgctttgaatattcttacagcatgataactgcagattctgtgagaatccctttgggacctggtgctttaatgcagtagtctgttgagcttcaggttaggcagcttcaaggaaaagaagtattttctttaattaaataatttgtagtgtaagaacattgaacaaagcaatctgatattttccttgtactaggcatgtttcttttgtaataaatcttggaagtttgtgtttgacaaagaacaacatgacttaaggcaactgctcagtgctttggtttcttatttttaccttttaaaagatggagagtgaggttatctgtttcatagggtgttaaagacaataaatctattttaatgcttcatttaataccatattttgttagatattttggtcttttgaaatcatcggcaaaatattggtgttgtttatttgaaaattttgatccctggaatctctggatcagactttgagaaatacgaaatactcttcaaatctatcatccgactcttcttactgtgtcatgtaattatgctaatttttcacatttgtaaggatgataagaatgaaaaaaactgatttcggtgctaaaaaattatgttactaaaagacacaggtttgtgtgtaaatatgccaatggatagttgaaattaatcgttctgccttgttagtttttttgtagttgtagacttctcagtactactgtgtataagtcttaccacttgtcaacctcacttttttctttaaaattaatgtgtaaaaatggaaatctctaagtaaaaagcattaccagttttatgtgtggtggtagaagtatttactcccctctacctacaaaatggtgctacaactgtaccttcatttgatatcaaactaatttgagatttcaaccggttagaaaataaagcaactcattttggagatccaaataaaattctatgacaatatatggaatattgaagaacataaagctgtgttttaagggatgttaaatactaaacgaaactcaacccagagcagcataatgctgagttagcaaatttaaatccaaggcagaaaatgcaagcctaggagtttgttttaatagtattactaatatggtgataattcattgaggtgggaaaaggctttaaacataacagaagacccagaagttccaaggaaaaatctgaaaaatttcagtacataaaaataaaaagcttttttatggcaaagcttaaaaaagaatccttaaatgacaaactgagataaaatacttctatcataagtgattcacgttccagtaagagttttaccctgccagggaagctgaggcaggagaatcgcttgaaccaaggagttgcaggttgcagtgagccgagatcgctccactgcactccagcctggggatagagtgagactctgtctaaaaaaaaaaacaaaacaaaacaagaaaaaacttatactcccttaggaaaatgcctaagacaagcaattcacaataaacaaaatgcagatgttcaataagcaagagaaaaagtatttagcccttcctgcagtagcttgattttatgggggaaaaaaaaaagtacctagccttgtttataattaaatactgtcaagaccgcttaccggtgctcacgcctataatcccagcactttgggaggctgaggcaagcagatttgcttatgccaggagttgacaacagctttggcaaatggcacaacccgtgtcaacaaataattaaccgggtgcaatgactcctggccatattccaacctacgggtttggagctttcacataatttctttattcagggaggttttagtgccattagcattatagtnnnnnnnnnnnnnnnnnnnnnnnnnnnnnnnnnnnnnnnnnnnnnnnnnnnnnnnnnnnnnnnnnntatttacctttttgaaataggtaaatttatacaattttggaagacttttttttttttttgagacggagtttgctcttgttgcccaggccggagtgcaatggcgtgatctcggctcaccacaacttccacctcccaggttcgggcgattctccggcctcagcctcccgagtagctaggatgattacaggcaagcgccaccacccccggcaaatttttttctatttttagtagagacaggttttctccatgttggtcaggctgttctccaactcccgacctcaggtgatctgcccacatcgtcctcccagagtgctgggattacaggcgtgagccaccgtgcctggcccggaagactcttaatttcagtgtaaaaccatttggcagtatcaactgtcatttacaactgacttctcagtgttttgttttgtttttgagacagtctcactctgtcaccaaggctggagtgcagtggcgtgatctcagcacactgcaacctccacctcccaggttcaagcgattctcctgcctcagcctcccaagtagctgggatgcctggctcgtacaacttttgactcacaatttcaattctagggaattggcctagagagatagtttgcttaaggactatgggcaagcattactggaaataacaaagcaacaaacttaatctaaatatgtattgatacaaatctgttcattgtattaggtctagccatgcaataaagttcttgaaagaaatgagatagctatttttggtgccgaaaaagacttcagaaaacctctgaagtgaaaaaacaaagccgaagtaattatcactggcagaggaatagacagagatttctcaacagtggcagtattgacattttggacaggataattctttgtttgcggatgggagctctcctgtgcactgtaagatttttagcagcatcactatcccctgcccattagatgccagtagcaccttgcacccccacaccccagtgtgacagccaaaactgtccctggatattgccaaatcatggttgagaaccattgggatagacaaatagattagtacttagccttatttataattacatagcccagaaacagacaccaatgtatatatagaaataatgtgtttcagagatagaattgaagtacattgaggtaaatatggactgttgaattaatgatcattttgttacacctttggaaataaattatactagatgtctaccttatgtcaatatatagacagtcacttctaggttgagcagtgtagtgagaccctgtctctgcaaaaataaatatttaaaataatagccatacttggtggtgggtgcctgtagtcctatcttactcaggaggctggggtgagaagatcgcttgggcctaggagttcaaggctgcaagtgagctatgattgcataactgcactccagcctggctgggtgacagagcaagaccctgtctcttaaaaaaaaaaaatagtcatttctaagtgtattcttacctagatgtatatgtaaatatgaaatgcagaactttaaatttttagaaaaaaatatggaatattttatttttccaatcttagattaaggaagaaatccttaaaaatatataaaagcaaatacataatgaagattgataaaccgaatgatattgaggttaaaaacctatgttaatcaaaagatcgcaccactgcactccagcctgggcaacagagcgagactccatcactaaaaaaaaaaaaaaaaaaaaaggaagtcaaatcttgggtaagggggaactactgtacttacatttacccatttattataaaggcaattacaaaggacacagatgaattaacccgatggaaggagatgtacaaggtgagacaaagaaggagagaagaggagaaggggcgtggagcttcagtgttcagctatctgagagctcacagaactcagtccttttgggcttctatggaagttcattaaataggcaagattgattagatcactagtcattggtttatggactcaagtttcagcttctttcttcccagaagtggcggctgggggtaggaatcaaagttataacccttaatcactgggctgattcccctggctacctagcccccatcctgaagctatctaggggcccccaggcaccagtcatctgattattgtacaaaacagtcatcactccagagattccaaggattttagaagctatgtcagaaaatgggacaaagaccaaatattaatattttttttatgatatcacagatgggaaagacaaactagaaaaacttgctttaactcttcatttaacacctctctgtagggtttggctttttaaaatccatgttcatatatttttgataaaagcatacttattataagtttagtttaaaagcaaaagtttaattttgtgttaatacttagaataccaggttttttttcaacctaaaatgagaatccaatagaaatgttttctttataatttatcaagtataccaacagattaacaacatttcaagacactttgttgtaaacttcattgcggaaggctcccttgggagtaaggtagtagtaacatttatttctgtgcttttccatatttattctgtcaggtattgaaatgtttttccacaggttgctttttgttttagaggtatttcgggtacttggagaattgtaaatattatgttttgtaccctgatttttagtcataagtttccaaaagagggtaagggtatgaatagactttacacataaaagagtgaaacactttgttatgtaacatgtatagtaagtttttattttttcttttgtttttatttgcctgtttttggtaatccaaattgaaaaggcctgaactctttcatgagttgagttcatatatagtttcaaagttcctgaattgatttggatacctgcctctttttggctaccttgaaaactctagtgaactctcttaatcactggagaattggactgagatctctgagttgtgatttcagtaaattctgttctcaaaattttttataaagcagcatttatatacagtcttgattacttgtgcaagtcacttccaaatcctaatgagaaactgtctctggacttttatattttcttagacctacagtttaaataccaagaaaggctttcatgtctaatgtaaaaatgcagtgaaactttgatattattctgcaaaggccatgagaaagatgattactttggagacttgttacttaggatattggtttttaaaatgagagcagattcttcccaaattccataggtaggaacgtgactataaaaggaaaatctatgaaccccatatacctacaaactttgggtaggaattaaaacaaacatatactattcttgaaatgttaactcactattacatcttggggggtgtgattttaatcaggatagagtattgtcagattgttacttgctgggatacatccaaattttgaggttgtagtcttactacattatttgtctatctgatgccttcccctttttttctttgatacatttgcataaagcaaaatggcactttttcactagaaatgtttctaaaacccaaataatttcttcatttgtgtgtagtaaaaacaagcttcaggaaaaaagttattagaattttaaaaattagttataaaattatggcaaagctcatgaatagttactgaagattaatttactactttgtgaatagcaagttgacaaaaataatttacagttcctgcttgactttctcccctctaagtggcataaagtagaactagagttattttgttttggttttgacccaacttagaagatttgttttaaagtttctgaagttttgtctcaggaaaataaggtggttttccatgtagagaatgtaagattacatatggcatctggtaggctgaattaattccattttcttgttaccttccatgggaagaagtttctaataaaaaaatcttttcagggccgagcgcagtggctcacgcctataatcgcagtagtttgggaggccgaagcgggtggatcacctgaggtcaggagtttgagaccagcctgaccaacgtggaaaaaccctgtctctactgaaaatgcaaaattagctgggagtggtggtacatacctgtaatcccagcttcttgggaggctgaagcagaagaatcgcttgaacctgggaggcagaggttgcagtgagccaagatcacgccattgcactccagcctgggcaacaggagcgaaactccattaaaaaaaatataaaaaaaaatatatatatatataatatatatatattatttaaatatatatatatttaaaaatatatatattaaaaatatatatatatatttaaatatatatatatttaaaaatatatannnnnnnnnnnnnnnnnnnntatatatatttatatatatttttttatatatatatatttaatatatatatttttatatatatatatttatatatatatttttatatatatatatttatatatatatttttaaatatatatatatatttatatatatatttaaaagagcctgtatctgagctcacaactctttgggggattattagtggcccattttcttggggaatcaggtggtttgtatttagaggtttatatgtcttctactttattgtgtccttttgttttccttttcacagatgacttgacattttggcacagaatacattttaaatccctggacagagtcatcacttaaatgaactagcccttgcttatatgtgcagtggattgtgaaatgcgtctactgtaataatatgcaatgtcttgattacctgctgaaataaggtggatagatggatttttattttatttaatatttatttatttatgtattttgagacagggtctcactgtcacccaggctggcatgcagtggtgcgatctcagctaactgcaatgcctcccgggttcaagcgattctcccacctcaaccccctgagtagctgggagtacaggcacgtgctaccaccctggcatatttttatatttttggtagagacagggtttcaccatgttgacatggtcttgaactcctggcctcaagtgatccacccgcctcagcctcccaaagtgctgggattaccattgtgagccaccacacccagccaagatggatttttaatttggagtttgtcactttttctgtactccagggtatggtttctcattgtctgaaacatagattttatttttcaagcaggctatattttgtggttgcctttaaaaacatccagatgtgacagacatttcctaatgaatactaattgtacttattttgtacaaaatattgtagaatccatagatggacagggtaggatctttgctttctgttatagatacatgtgtaatagggtagattatacttagataactgcagactacaatatcaggtgatatatgagtgttaaatgtttcactaagttctgcaggtatgctgaaagaacagtttctatcaaagaaagtaggtttctaggataggtaggatttgaatagtcagggattgggaggttggggacatcattccaagcaaaaagaatgtaaacactgctgtagctatagtggagaaaggaatgtgtttggggaatccaagtctggagcactgatgtgtgtgtgttaggaggaatattactgtaaagcaaattgggttcttgaatgccaggagcaagaatgtagattttagttgatagtaatttcagagccgctgaagtattttgagcagggaatgaagaaaggcaatttggtgatggcttgtaaatggatttggacaagatgagggttttttgagacagactgattgattggtgtcacagaaaagggagatagaggtgttagaagaatttggcaactaattggcaaagtttgagcatgtggggctgggttgggagtatctctaaaagaacaataatggtaccttcaactgaaatagcaaatcacaaggaaaagctgattctagtttaaggcaagtcgagtttcagaactttggagatttgcagttgtaggagtgaaagtaggtgagtattcagatgtcattcccattgttgaaaccttggataataatgtgtttattgtaatcctacttaaaatatgcatttctgtcagagtacaaagaaagatggtgtctatggagtgggggaaggagaattaccattttctaaaaacatgtcttggttttctgagtgttacttttgtaatgtgaagaacaataaaaagagttgactattttaagaaacagattcagcattatacaggaaaaagggaacttggaagatgtttctaagtccgaaggaaactaggaggaaaaaaaatggaattttggaccctttggagaatgctcagagttaaggagtaggaaataagagctggcatgagttcacagtttgaagaaaaggaggaattaagtggaagtataaaacttgaacttgatttcctaaagaatcctttaaaaaaaaatctaaaacttggctgggtgcggtggctcacgcctgtaatcccagcactttgggaggcaaggcgggcggatcacttgacgtcaggagttagagaccagtctggccaacatggtgaaaccccgtctctactaaaaatacaaaaattagctgggcatggtggcaggtgcctgtaatcccagttacttgggaggctggggcaggagaattgcttgagcctgggaggcagaatttgcagtgagctgagattgcaccagtgcactccatcctgggcaacagagtgagactcttgtctcagtcagtcaataataaatgaatctaaaacttaataggaataaatgttttccatttgggttatttttaacccaatttttaaaattaattttaatgattatgaaatgataaaagacatattcttttgagttttaaaacttgttaaaatgtatgtaccactacaaattcatcttgaaaataatttagtaatttggtgccttggacagctacagtgttacttgaaatactttggaaattagaaagtaaggaatgaaattttaaagaataatttagtatgtttggtctgttctcctgaactctgactttacaaaacctttattaccctttaagccttagttgtcttgaggcttaatgttcataactgaaaatattcatatttcctaattaaaggaagaatataataactcttagtggggaaacattcttacaaatacttcattcaaatgactttttctttctttcttttaggtgtatttgcatccagtattgttctgatcttgtcacaacgatcacttttcaagttttacacgtacagctcagcctttctgttagctgcaacttcagtgttggtgaattattatgcttctttgcacattgacttctatggtgcctacaacacgtcagcttttggaattgagctgcttcctcgaaaaggtccctcgctgtggatggcacttatcgttctacagctaacatttggaattggatacgttacactactccagattcattccatctattcacaattaattattttggatctcttggttcctgtaataggcttaatcacagagctaccattacacatcagagagactttactgtttacttcttccttgattctcacattaaatacagtgtttgtcctggcagtgaaactgaagtggttttattattccacacgatatgtttatcttttggtgaggcacatgtatcgaatttatggattacagttattgatggaggacacatggaagaggattcgtttcccagacatactacgagtcttttggctaacaagagttacagctcaggctacagtgttaatgtacatcttaaggatggcaaatgaaactgattccttctttatttcttgggatgatttttgggacctcatttgcaatcttataattagtgggtgcgattctacactaactgtactgggcatgagtgctgtaatttcctcagtagcccattatttggggcttggaatattggcctttattggatcaactgaggaagatgacaggcgtcttggctttgttgcacctgttttattttttattttggctcttcagactgggttaagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtaattgtttctctcactgtttatacgttattcatgattgatggctactataatgtcctctgggaaaagcttgacgattatgtctactacgttcgttcaacaggcagtattattgaatttatatttggagttgtaatgtttggaaatggggcttacactatgatgtttgagtcgggaagtaaaattcgggcttttatgatgtgcctacatgcatattttaacatctacttacaagccaaaaatggctggaagacatttatgaatcgtaggactgctgtgaagaaaattaattcacttcctgaaataaaagggagccgcttacaagaaataaatgatgtatgtgcaatctgctatcatgagtttacaacatctgctcgtattacaccgtgtaatcattatttccatgcactttgccttcggaaatggctgtacattcaagatacttgtccaatgtgccatcagaaagtatacatcgaagatgatatcaaggataattcaaatgtatctaacaacaatggatttattccacccaatgaaactccagaggaagctgtaagagaagctgctgctgaatctgacagggaattgaacgaagatgacagtacagattgtgatgatgatgttcaaagagaaagaaatggagtgattcagcacacaggcgcagcagctgaagaatttaatgatgatactgactgatgaaaatagcatttattaatgattgaggtatttgtttaaaattcagttcatccaaaatggagtaatatccttcaccttcagtgtgtaaccaagcacaaaaacagtatcaatgttgaatctgtgaatggttttccgtttactgtgatgtgctactgtaaatatacctctttaattacttctggtctctttggtgacctgtttaaatttgtgtacattattgtacatagaataaaatgttttcacatttttatgacaaaatttgaacaaatagctttttaatagatgtaatgatcatatggtgcgtcacctgtgccaaatattcttcaatgaaattatataatgtaactttggacctcagtttttctttagaaatgggtgggagaatgaaaatgcaaatcaggaaaccacattaaagtcaaggaaataaaataatttgaccagaggataaaggacatgagagagtattttaaaactaaagaaaaaattagctgccagaagcaactgaggaccttttttgaaacttgagtagcagtgtaattgagctgagtttgaaagtcctgattcagagagagactgagggttgacaaataaactgtatcaactaaactttgatataaaccagaatgtgctaagtgttttttatgtaaaattgtatatttgttagcccattctgtgtctgcagtattgtcataaaattgtcctttcattcttttgaagatattacaaaacaaaaatagttttttttaaattgttttaaactaagatactcaatgatataaaaacatcctgatctgattttacgagaaaaagaaggggaatggtggggaatggtgtgtaccgatatatagtatttctttagacaacttgcagataatttctttattgaaactatcaggaagttttactatgaaattttacatacatgatggaaagtggaagacatataccaattatattccaggaaaaaatactttaatagtattgttatatagtgtattggctaattccagtggatcctcatctctcactgctgacattatctccaatatttgactaaaacaaaacaaaaacaaaaatggttaaatctccaagtatacatttagttctaaagctatataatatttttccacacaaaggaaaatattggcacacctttaatataataaagcttaacagttattaagtttttcagcaatatcaatagaaaaacttactgccagtaactggaaacagatttatggactgtcttgcatataactagagctaagaaccaggttcaagtaaattattaaagcagccatctgtattatgttcaccaattatagcattaactgagtggaaatgaagagtccttttcaattgtgagtcatagcatgttcattagtgggtcatgatgagcattttaaacattgacaagtacattgtactcaataagggtaagtactgttccattttttgttaggttttattatgtatgtgtgtcctaagtcacaacgtaatttgtactgtgggacagcagccacagttggaaatctactgctagagaactagtccttgagagacagcaaatgaaggtattaggttgctgcaaaagtaatatttacttggaaaaatgtgtggttattgagggcgagggctttctgtacctctacccttgcgagagaaataagcccaggtgtccatccttcagtttctttctttctctgtctctctcttccttcccttccctcccttcctttcctttctttttctttcctttctttttttttttcttttttctttcttttttgagacggcgtcttactctgttgctcaggctggagtgcagtggcacgatctcggctcactgcaacctctgccgcctgggttcaagtgattctcctgcctcagcctcctgagtagctgggattacaggcacctgccatcacacccagctaatttttgtatttttagtagagacggggtttcactatgttggctggccgtggtcttgaactcctg

SEQ ID NO: 14877 - DNA, 19062 bp, Human
gttcggcttcctttgcccgtcttcatccatctcacctccagtgtccagaaatttaccttagaaatctgtggtccacaggtcatgctcctagacacattgtaggaggaagaggaattaaacacatcccattagtacataatcttggaagagaagccttctgaattttacaatcaggattggggaaactctgtaaagtaccttcctggtgttcctttcttccagcctctttgattaagtcacatcaaagcgctaatggcaaagttgtttaatgtgtgtttctccaaggcaggttaggatttcactgggattcttaaaatttgagggtgtctgtgatcgtcaaaatttgtattcatgtagtccctcatgaaatttctaaaactcggctgggtgcagtggctcatgcctgtaatcccagcactttgggaggccgaggagggtggatcacaaggtcaggagtttgagaccagcctggccaatatggtgaaaccccatctctactaaaaatttaaaaattagcctggcatggtggcacacgcctgtagtcccagctactcaggaggctgaggcagaagaattgcttgaacccaggaggcggaggttgcagtgagccaagattgcaccactgcactccagcctgggcggcagagaaagacttcatctaaaaaaaaaaaaagaaaataaatttctaaaactctgtatttctttgctcttttaagttgacatctataactttctattactttaaatacctggaaaaaaaatcacttccagtgcattgtaataatgtatcaagtagaagtggctaaaatcagtgaaaacatttctttgatctgaataaatgttcaagaaaatagaaaacatgaacttacctccaatctatgttccctttacttgaaaatgtaatgttgatctactagaggtaaggcaggaattgtcacatccatattccttgcaactattcaaaatatgcatctgagaccagaacaagacacaggtgaagaagggtgctcactaggccccttctgccaatacagaaggagacagtgcagtggagtcctttcatagcaagttctgccttcatgatttccaaagcttcagtattccaaatctcaggtgaatagggtggtatccactaagctctgccacaaacttgttgctgagatgaaggaagccgccgctgtagtcagtatttctcacccacacggtttgctctctttctggctggtgtgggaaggatggcgtcttttttttttttttttttttgagatggagtcttgctctgttacccaagctggattgtagtgttgtgatctcggctcactgcaacccatgcaaggtgctgtcaggttccacctgtgcaaacaagtacactggtccagcatgggtcagctgctcactcacaggggctccagaatcctacaaagggacacacaggggtgggtggcaacctagttggaaatgggagtgatgggcatgactaaagtcttcctcatcccaccagaggcgcactcaactgtggctagggtgaccagaattcactgtccagcgtggctggcaggagcccactctctgaagatggtgggattcagaggtgggagtagagttgggtggtcctgtgagctgagcactctcccaaaagtgtcccctacatatgaggttgacagcttattcctgcagggactcaggagtaactctgggtgctaaaacaaaacttgagaccagcacagaaacagccagcccatgaagctggcctcccatcacacagcaaggctagccagatgcccctcactcttctcgggcaccattcttctcctcccctaggccgcctggtgctcgtggtgtttcatgtttgttagtccatgcacggtggtgagggaggctgctgtgtgatttgccccagccacagcctctacaaaagcaactagaagaagacggcagcagagggcgcttcttcaaacaccctgtccaactcctggcactgacaagtactgagtgaactcaaaccctctgtaaagtaacagaagttagaaggggaaatgtcgcctctctgaagattacccaaagaaaaagtgatttgtcattgctttatagactgtaagaagagaacatctcagaagtggagtcttaccctgaaatcaaaggatttaaagaaaaagtggaatttttcttcagcaagtaagtacatttactattatcttactatgggatagcttggtagaactagttaccagcaacctcactgctttttaaacaaacaatacctctgctaccacctcctggatccaggcttgccctcaaaggaacccttagggtctcattcccacaggaggctgtggcttcccgacatatttggagcatcatagtgagaattgtggcccattattttaaaatatcctagatcctagcaaatattgtttttgtgggccgtatttgaatttctcaagccagtaaaattctagtgaaagtgggaaaatcgcttgagctcgggaggttgagactgtggtgagctatggtcacgccactgcactctagcctgtgtgacagagcaagattctatcttaagaaaaacaaattctggtgaataagtctcttttaactaatcctgtctaaaatggatgatggctaataaaacaatatggcgtggctggaactctagctctagggtggtctccaaagaggacactcaagcattctctgagcagcacggggctgtgtcctggtagcagcctgaaggggtgacagtggagcacagtgtttattttcatttctcaattttgacatatttactggaaaaattaatccctagccacctcacatgacagtacataattttttttttttttttttttgagatggagtctcactctgtcgcctaggctggagtgcagtgttgcaatcatcttggctcactgcagcctccacctcctggattcaagcaattctcgtgcctcagcctcccaagtggctgggattacaggcacccaccaccacacctggctaatttttgtatttttggtagaaatggggttttgccatgttggccaggctggtctggaactcctggcctcaagtaatccgcccacctcagcctcccaaagtgctgggattacaggcgtgagccaccacgcctggccctggagtacataattttgataagtaacgtctgcagtgtctttttttccctccctttttatggatagacttttctggttattgagatctcatacccctttatgatatattatttgagtagagggtttaaagaattgagatacttgttttcttatgttaatatgtcaagaaagaagttgtttcataacttaggtcctgccttggacaaaatacacccttactgtctgctctatgtttcttggtatgttcagaagaggatttgaacttttgcaggttggctaacagatatggagggtccttagagctctcctgtttctaaccaaatcttcaccccacctattaagtagaaagccttttcatggaagggctgtggttggttcttggaactggtcccctcacagaatttccattcgcttttcctcagggtcacgccctgctttagaggttgcttaggttaagctctccaattaattttagcaggcaactcgagagttttgcaactcaaagtaggcacaccttccttcctgaatgacttttatttgttcctttttcaggctgtgaaactaaatccacaacctttggagacccaggaacaccctccaatctctgtgtgttttgtaaacatcactggagggtcttctacgtgagcaattggattgtcatcagccctgcctgttttgcacctgggaagtgccctggtcttacttgggtccaaattgttggctttcacttttgaccctaagcatctgaagccatgggccacacacggaggcagggaacatcaccatccaagtgtccatacctcaatttctttcagctcttggtgctggctggtctttctcacttctgttcaggtaagcaactttcaggaacttaactgagtcaactgctacagggttaagagaaaggacatggggttctctgagctgctcccttctattatcctataagctggaaggaaccttcagggtgttttcagaagattttaaagattagaagactgtggtccaaagaggttaaaggacctgcctatcatcacacagcaagttagcaaccaagttaactcaagaacccaggccttcaaggaagcgtggaagggacagtgttattttaacaaaaccatacagccgattcataatggtctcttccatgaatattagatgctcatttacattttgtgatgtgccgatactggcctcggagtctagtcccaaactatgttttcatgatacagctcagcgaaagtgtcctgcttctaaaattgaacaatggtgatcttctttccaatctgaaggcgggagagtagttgaggacaattcctcttaatgacattcatcttcttaaccttcttaagttcctcttaatacattaatcttatttgttctgctttggatgctgagatcttttttcaacattggcatctgactttaagtggtatcagatttaacacaaaattatgtttttagttatttttaatctgccacataggtattacatatatgtcctgaaagtaataatttgacttctagaggcttttgttcctgctcaggtgatcttaagagtgctgaacttttgggactgtcaagaagggtgaggcttgtccctgctggcaggatggttctgatttttttttttaagtcagaaaacaaaagatctgttttctagtgagcagcatacttcccagtttcccaaaaacaaagaagtttgggctccagcatgatttgccagtctgcaaagacccgactattaagggtccttgtcttaaaaacttctcacataaagtactgcctagaatatcagaggtgtgagagagaggtagagggaagagaagaggagttgggggcccacagattacttgactgcgatggtggtcatttaaaattttctgtccagagctattttacattgtttcagaaccaagagaaacatggcctacatttcacaatttacacctcaggttttttatatatttgacagttacattacatttccaacagttacaatttccttctggggagctggggaagcattcccaaactagtcttctggggagtacagaggagtttaaaatatatagaaggaaatttgtacaggcttcccagaaataaggggggcagggagggggagagacagaaagagggagaacaataaaaaaagtaaaagaggacataaaataaaaattaaaacccagactttagaaattgtacaaggaaaattagggtcagaggtaagtggaaagagatctttgagctaaagaaagatgtttaggaaagcaccttgttctctagctacatcctggttttactgctgctgtgactgagtcaatgaagcacctactgtgtgccaggtgggccataaaagttgaggctaggattcctgcactcaaagaggtctgcatatgttagttgcggaaatgcaaagctaacccatgtagaacaagcaaagagcaatgaaatgctttgccctgattgtaggagcccaagatctgggaaagtgggtaacagactgggctgcaggaaggagggcaggctttacagaggcagatggatgatggagagagaattctggtcagggcaacagcctggacaaaggcacaaaggtaaggatgaggctggcacaggtgttcattcttttgtttaatcatttattaattcaacaaacatgagcatctcctaaaaccaagagacttttcttggtcctggggacatggctcttgcatttgtgaaatttactatcattggaaagaggaaaagtaatccaatagccactcaaatgaatgtgttaaagtgtggccaacaaacaaagccacgtgctttgaaggcagggcacaggcactgcctgaggaagtgctgtcttcctctgccagcaagaaggggcagtgagctgggaagtagcagaggagggactggcccagtgagcaagaaccggaccctgcagcacttgtgagttataatcatgaatccgcatgttattcaggaagctggaagggctttacccaggagagtggcgtggtctaccccagctctgttcactctttacacataccaatagcctgggggttttgctaaattgcagtttctagcacagggaattttttagagaagtgaatctattttgcataatactgtaatgatagatataagtcattataaatttgcccaaatccatagaatatgcaataccaggagtgacccctatcgtgaactctagatttggggtggtaatgatgtgttaatgtaggttcattgattgtaacaagtgtactgccctggcgcaggatgtagacagtggcggaagctgtgaatatgtggggagggggttactttacattcaatttttcgatgaacctaaagcagctctaaaaaataaagtctatatagttttttaaatgctgtttctgcttaggtgggtctgggatggggcctgagattctgcatttctaagaagcacctaggtgatgctgatgctgctccaccatacactttgagtttcagtagtaaaggtgtaaataactttaaaaggaaaaaagtgttactgaagaacagagtggcttgtagggcagccacagtgactgtgcaaaacctattaggaggttatttcagtaacttacagtaactgatgatgtctttaatgaaaagaattggatcagaaggaagttgatgggttggagagtgtgtaccatgtaaaattagtgaggactgctcaacgggagtgtaggtgtgagtgtgcatggtctgtgggaggtgagattcagtgaatacagtggagtaggattatagagggctttattcagggcagagatttgccacactaggccttcctctcctgccacaccatggcagaggtgttccccctctcctcctgcccagccactgatgcccaggggaagggactcctctttcatgcacagggtggaaccagccaggctcctctccccctctaggcctgcaggcactgtctatggaggcagaaacgcctgactttatagtccagcaactggtggcagtaaggcagaggctctaacagggcagccctcagagggaccaatgtgggcagcttttccttcagagctggagtcctttaagagagggtcaggtctaaggagaggggaaaggcctcctgtaggaggaggcaagagatgtaggaaaagcattgcctataagtttatagtctgagaactcagagctaggagaaaagagaataccccaaagtgccaccattcacagaacacatcctcctctccctgcaacacacaccgctatgctgctggcccaggggtcccatgagcagtgattgttgccatcatcaccctgacaacagctgttcaagtccctgtgcattttaaggatataaatactgtttagaaagagaaaaagtaaggatcagatggtacagagtatatgagcagggtctaaacagggggaaaagtcaggaacagtgtgaacacgaggagacacaggtctcaagcctgtggctgccagaggcagctctgcctgtctcctttgtgtggctagcacctagcccagggctgacaccagccctgtcggtgctagttcacctaatcaaacatttagaggggggtcactcctgttggaagagtgtgcacaaaccaggaacggtaaaatctccaggtggtgagacaataggtgactttcacgcttttctatatcttccattctttctaagaatgtttatttcatagtcagggaaaatgtttatttaaaaagcacacttgtgtttccagggagatcatgtatgtcccgtcatttggtgagttaaaagatgttgtgtcaactgcttctctcccttctccactagcagtggtgatgcagctcccagacccctgcgagggcagcctctctaacggctgctgaggttgaactccctgggaggggcactgcagactggccactgcatcctccaggcctccaggctgcacggagagggtggggaagactcaggtcttcctagtatggattcttcttttcccttcatgttttatttgcaatgacataaaattcaacgttttaaagtatacaattcagccaggcacggtggctcactcctgcaatcccagcattttgggaggccgagatgggtggatcacctgaggtcaggagtttgagaccagcctggccaacatggtaaaaccctgtctctactaaaaatgcaaaaattaaccacacaaggtggcccgtgcctttaatcctagctactcaggaggctgaggcaggagaatcttttgaaccctggaggcgggggttgctgtgagccaagatcatgccactgcactccagcatgggcaacagagcgagactctgcctcagtaaataaataaataaataaataaataaataaataaataaataaataaagtgtacaattcagtgggttttagtatatttgcaatgttgtgaaaccaccatcactatcgaattccagaaggaaatgttctggatgatgatggaaatcatcatcccagaaagaaacctgcgcctatttgcagctactcctcattcccctgtaccccatctcctcgtaaccactaatttactctctgtctctatgaatttgcctgttctagacatttcttttctcttcctttttttccagaatccaggtaagaaagaatattctggacatttcttacaatatgtggcgtttcgtgactattttctttcactgagcattatgtctttcaggttcatccatgttgcgtatgtcttagtactccattcgcttttacggccaaataatattctgaaataatattctgttgtagattgagatctattttttctttttgtagcgatggggtttttgctatgttgcctaggctggtctcgatttcctgggctcaagcaatccacccgccttggccagctcccaaagtgctgggattacgggtgcctggcctagattgagcccttgagaggtccttttttttttttttttttttttttttgagacagagtcttgctctgtcgcccaagctggagtgcagtggcacaatctctggctcacagcaagctccgcctcccggcttcacgccattctcctgcctcagcctcccgagtagctgggactacagctcgtaaaagtcctccacacaaaaatcagcccgccaccacgcctggctaatttattttttttgtatttttagtagagacggggtttcaccgtattagccaggatgatcttcgagctcctgatccgcctgcctcggcctcccaaagtgctgggattacaggcgtgagccaccacgcccggccgagaggtccattatttgtctaaaattcttggtctctactcttgttggcaaatagcttcctctcctgtgtggctagcagtccagagttgaagtggtcagagcaggagggtggccaaggggtcaggagaggcagaggctgaggccagcagtgttgagtgtccctattgtgccctacaggtgggcagtttccatgcattcgccagaaggcgagcagcgttgccgtccatctctgccttctctccgcctcctttcacagcctctggccctttctgactgctgctgggtagaggtgcaggaggggctccccatgccagctatgggcactgaactcagttcaagaatcagccagttaccatggtgatgctggtcctatgggggtgtggttcagcaaagcaggctgttgtgcatgagaaagaacagccccatttaaaatctgtagagcattctaaagttaagaaagcactttacatctggtatcctgtgatcgctgtgataattatgtgaagcagggaagatagttatctcggtctggtttgtgctgctataacagaatacctgacattgggtaatttagaaagaacagagatttatttcttactgttctggaggctgggaagtccaaggtcaaggggctcacatctgatgaggaccttcttgctgcatcatcccatggcagaggatagaaaggcaggagagcacgcccaaggcagagtaggaaggaggccaaaaccatcctttataaggaagccactcctgctgtagtgaacccactcccaaaaaaatggcattaatccatccatgatggcagagtctccatgacctaatcaccttttaacagtcccaattctcaacactgttgcacccggaattaaatttccaacacaaaacctttaggggacacattcaaatcatagcaatagtattatgactgttttacagagatggaacctgaagcccagagaggttacccagcttgctcaaggttatgattctaatacacagtggatggagccagacctcatttcctcatgcctagacatgcattcagcaagtatttactgagcacctactatgggccaggccctgttctagacactgcagatatggcagtgaacaaaggaggaagcctctgctccatagctccatacgtaattatgtatcacatatacctgtaaatatacatcacagttgtaaaaatatatatcagctggagacaagcctgaagagaaacaaatcaggcaaagagactaaagagtagcaggatggaggggggcagggaggatggcgctgttcaaggagagtcagggaaggcctctttgacaaggggccacgagagtagatgtgagcaaagtgggacctgaactgtgtggatctctggggaagacactggctccctctaatgtcctaggtactgtggaggacttttatgagcagtatctcattttgaatccttgcacccactgggttgggtaggtgttacaatgcccattcaaaaatggcaaagcaagctcagaagttcaaccaggtttgagacagtaatattgagatttccaggtgctgactttccccgccagtcactgaagcagacaaaatcgttagagacatttccgtttcaactgctttttgtccgtgtgtgatggagtccctaaaacagacaaaactgatataaatttgggcaaatttataatgactgttttctgtctctgtgtggtggaatcccgaaaactgggttcccgtgtgaatttccaaattgttcggaagattttgggttcctctttttagtcctgttcttcttcactcttctcctcagaaggctggacaaaaactcctcagaagccatcaccaaaattagatagtctctctttcagctatgctttcacttttgctaacatcaccacataccaaaatcagtgagaaatattggattctttttggctgggaacgaatagttcggtggggaaagaccctattattgggaggcccagacaagtgagttgctgtctgtctggcccatagcaagaccagagtgctatatatctgacataacccttgagtgaaatgaaaggtaagagttggcagtgggaggagggagaaagaaaaatggaaactcttacagaagacctgctatgtccttgggactttttatttatatcatttaattgaactgaattttccagtgatcccaaggggtaggtgtcatacctatttagagatgaagaaacagatgaaacagcaagtggctgagctgggactagaatccaagtcaatggagatggatagcccatgttccttctacgtctcattttgctttccttgcaacactaggagtgtctgggttgtcatttgatctttagctaatatagcttcactttgaaatatgctcccttcaagtatgtctttttatttcttcctttctttcagttatattccctaaagcagggactggcaacattccacacaattgctgaagaggtgcctggacctttctgcattacctcactttgctatgcaaatacccaccatcacaaaactctcttgttcagtgctgtggtggggccgtatccagtctgacagaggcctgagaatggctggtgagatggaaaggtgctagtgccccatgatcctgctatctaagaaaagagagggcttggaaatgaagtccctagacatgggtctccctaaggggatctgtgtggctccaggggatacagggcccagaaggcacagtacgacagcactgggcagggggcgctggggccttagagggatgctgcttttaggtcctacaagagcctaggaagaatgaccatgccttctaaaccaaaaatcagaaaatacagcctgctaaggaattttggtgctattgacacagagactagtttagatattgatatgctgatatttcttggctatgtggatggagaaatgaacagaatattttaaataaaaactcttttagcaaatccaggctggagggtaattgtatggcatggactgcagatagccaaagagataaaggcaggatataggatccatttagggtacctgaagatggtagaaatagtccaaaggtataagcatgggagtcatttcagcctggaaccatgggatcaatcaggcctggaaagaaagggactctgtttcttatttatttatttatttatttattttgagacggagtctcactctgtcacccaagctggagtgcagtggtgtgatcttggctcactgcaacctctgcctcccaggttcaagtgattctcctgcctcagcctcctaagtagctgggattacaggtgtgtcccaacatgcccggctaatttttttgtatttttagtagagatggggtttcaccatgttgaccaggctggtctcaaactcctgacctcgtgatctgcccacctcagcctcccaaagtgctgggattacaggcttgagccatgatgcccggcctgggactctgtttcttatagcaaaagggctcagtggtagggctggattggggtgggtggggacagtgttggcttaacttactgactgtggcctaaaactgaagaaatcggtaaacaagaagaatggccctaaaagcctgggccagaaagaaaaaaatgtgtaaaactggggcagtttcttttcctcagctcagtttcctcatttgtaagataaggccacgagaatgaatgatcatggaagtcccttccagatctcacattccttactatgactttcatatcccctggggctgagcacatcgtttaacccatggttggcacttatattcaggtcttctcaggggaccagtggactttctcactcactagggatccctgtctctgtccccaactcctggcccataggcatctggctatatacataagacaagcaggtgcctttccatatttctgaatgctcacgatgtctcatcatgctaggcgtggtggctcacacttgtaatcccagcattttgggaggctgaggtgggaggatcacctgagatcaggagtttgagaccagcctggcaaacatggtggaaaccctgtctctactaaaaatacaaaaattagctgggcatgatggcgggcgcctgtaatcccagctactcaggaggctgaggcaggagaactgcttgaacctgggggtggaggttgcagtgagctgagatcgcgccacttcactccagcctgggcaaaagaacaagactccgtctcaaaaaaaaaaagaaaaagaaaaaagaaagaaagatgtgtcgtcttatggagattcagggaaggggaagattctggataactcttgaaagataacgtcactggaagagctttacccatttggtggggtgttgaactggatgtaggagcagcacacagtggtatgtataggtggaaaaataaggcaatttgcttgtcagtatatcaatagttatatcaaaggtgtaaggtggctgctaatatattgaattcaactttaggctgcaaacatagatttaggtaaaggaagtgacaacccggttctactctgagccaatcacacagtggatgtctggaatgctagatttagtgacttcgctctctcaaaaaaatatacacacaaatcaaactgtgtagtgaggaaagtgagggtactcactttcagtacatcaataaggaacaggggcagatgggaacctgcagaactgtctgagagaggatataagtatcctcagatatctgcaagtcttgttacataagaagaatgagatgtgttttgtaatgcatgtagaagctagagggaaacagacttcaacataaagcaaagcaaaacttcctcagtcaaattgtccaaagacgaaatcaaaagccttagaggttggtaaattccccacccccttggagaaaggagaatgggattcatatttggtgtgggtctaggcattgaattacagtatgtgcttgccataaattatctcatttaatcttcataataaccaatgtgaagactggggttcagagaagtaaagtaagttgcttaaggtcacacaactactgtggattttattgaatgaaaaaagcccatgttctttctataccaacaaccaggagcctctaggcaaggatgttagcagggtgcacttagtcatggttgcctttaaggtaggtagggaagtaggcagtcctgagagctttaaatcctaagtcactcaagtgaaaaggggaggaatcaggatgtgtattaaggtgacagatgaaggttttattcctgtgccacgccactgaagtcacatgaaatggattgtctttagctcacttaatctggataaaatttattcttagatttttcccacggttaaatgcagttctgtagtttaaatgaatgcgtgtacatgtgcatatctgtgtgtgtgtgtgtgtgtgtgtgttgttgcatcacgtgattgtggggagaggggctgtaggagaaacgcaagggaaaaggcagtgagcatcagagactaggtctttacagtgaaattcttccttatttctcaaggcagtagtagctgaaaattacctaatcaagtgaccaggcaacagatccaagaaggaggccttctgtaagtgagaattcatgaataatgaagattgattatattccctacctatttaaagtatggccctcttttttcttcttagttgacctcatctccctcccttattcttcgtcatgactgcagaatcataggcccttggaatctcaggctgacctgccctgtcctagacttcctgaacctctcaatctctcagttgtctcagctgcaaaatggggaaaataatacatatcttgtggggttgttgggggattaaatgacatagcacctgtcccctccatagagccaccacagaggaagcaaaaaaaggaaatagtatgaagagtaattcaatataggctatctagacagaggtgggcaacagcaccttgccctcctccaccaccactgtacccagaaccttagtcaggactgacttctcttgggggtggtattgtgttaggtaaaccaaataagaagtaataggactaaaaattgcctgctgtgagagaaggctcatatgctcctaaatcttgcatgtcattggaaaattctcaagaaaaaggaaggggataggttatgttataatgattggtccatgagtctgattttagtgatttgtcttcattgttttcaaaaccaaatttgttttttatgcaatcacatttagtttttctagatagtgacttccaaaacctttaacaagcattgcgggtgcaactgctatagaaaacactattgaggttcctcagaaaattaaaaatagaactaccatatgaccccaaaattccatatatccataagaattgaaagcagggtcttgaagagatatttgcacacccatgttcatagcagcacagtagccaggaggtgggaagcaagccaaatgtccatctacagatgaatgggcaaacaaaatgtgggggggggtgtgtgtgtaatattattcattatccttatgatcatatcattaccattccaaaggaaggaaatcctatcatatgctacaacgtgaatgaaccttgagtgcatcatgctaagtgaaataagccaatcataaacaggctgttactgtatgattctatttctatgagatatttaaagtagccaaattcatacaaacaaacagaatgacaattgccagaggctgaggggagagggggaaaggggagttgtttaatgggcatagagtttcagatttgcaaaatgaaaatttctagagatctgtttcacaacaatgtgaatatacttaacattactgaactgtacacttaaaaatcaataagatgataaattttatgttatgtgtttgtttgtttgtttgtttgtttggagatggagttttgctcttgttgcccaggctggggtgcaatctcagcttactgcaacctccgcctcctgggttcaagtgattctcctgcctcagcctcccgagtagctgggattactacacccgccaccacacccggctaattttttgtatttttagtagagacagagtttcaccatgttggcccggctggtctcgaactcctgacctcaagtgatctgcctgcctcggcctcccaaagtgctgggattacaggcgtgagccaccacgcccagcctgttgtgttttttaccacaatttttaaaaaatgaagagaaaaaaagcattggggaccccaaaaatcaaactggattgatacttagtcactagacacaacaccctaagttctgttactgccgactttggattcctgaccatgcaggaatctgtatttaataaatatacaatcttgttctgtttgcctctccataggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaaggttggtgggattttctgattttactctaggccggcagattcttaatgcccttaaagacacatggctattgatttaggtgaaaattttaccaaagagggatgtatctcacttcatttcttggagttaagtctctagttgtacaataaactctaactggtttctaaagatgtcctggaaatatctgttaatgtgcatttcttgttctttgacaatccaagttcatgacaatcatcctggggcactataatgacctaaagagcctctcaatcaccaaggggcatctttgatttgatgtagccttgctactaactgcacttgacccagcaatatatgcctgtgaaagtatgctgaaaaggtaacggggctgggtatggtggcttatgcctgtaatctcagcactttgggaggccaaggcaggcggatcacttgaggtcatgagttcaagaccagcctggccaacatagcgaaactccgtccctactaaaaatacaaaaactagccagatgtggtggcgcattcctgtaatcccagctactctggaggctgaggcagagaatcgcttgaacctgggaggcggaggttgcaatgagctgagattgcaccactgcactccagcctgggtgacatagcaagactccatctcaaaaaaaaaaaaaaaaaaagaacaatggaggcataaatctttttcaggtagtatgtgaacgtctattactatggctatcttactattatattctaatattttcaaagtgataatttacttattgcatatttgaagctctaatctagcagtcagtcctgaaaaattagatgttagagaattgggccaggtgcggtggctcagcactttgggaggccaaggtgggtggatggcttgagctcaggagtttgagaccagcctgcccaacatggtgaaaccccatctctactaaaaatacaaaaattagccagggacgtgttggctactcaggaggctgaggcaggagaatcacttgaacctgggaggcggaggttgcagtgagcagagatggtgccactgcactccagccttggtgacagagcaaagactgtttcaaaaaaaaaaaaagtagactacagaggagggtgagcatttccctactggtagagactctgtcttaaaaaaaaaaaaaagttagagaattggatgcataattaattcctgccacaaggaaaaaaactaatttatgaatcaaagccctgtttatgtacctactgtggaaggcaagcatttctggtctcggaaagaaaggacccttgcttttgtaaccacccaagaggtttacctcgcctgctgcgtagatagagccaattcatcaagacaggggaattgcaatagagagagtaatttacgcacaactggctgtgcgggagaccggagttttatcattactcaaatcagtctctccaagcatctggggagcagagtttttaaggataactaggtgggtcgggggaagccagtgagctgggagtgctgattggtcagggatgataccatagggagttgaagctgtcttcttgcactgggttggggggccacaagatcagatgagtcagtttattgatctgggtggtgccagctgatccatcaagtgcaggggctgcaaaatagctcaagcactgatcttaggagcagtttagggagggtcagaatctcatagcatccagctttatgactcctaaaccataatttctaatcttgtggctaatgttagtcctacaaaggcaatctactccccaggcaagaaggaggtctgctttgggaaagggctgttaccatctttgtttaaactataaactataaactaagtttctaccaaagttagttcagcctacacccaggagtgaacaaagatagcttggaggttagaagcaagatggagtcagttaagttagatctctttcactgtctcagtcataattttgcaaagggggtttcactttaattacagtataacagaggatactgaaggagccaga

SEQ ID NO: 14878 - DNA, 17704 bp, Human
  misc_feature (1)...(17704): n = A,T,C or G
gataggtggtgattttattacaattacaacattgtaaattctgaaaacaaatgcagttgttagataattatacagccaagagaaatcttactcgttttttttatctgaatttttgtcctaaaaagcctacgatccaatggaattaagtgagcttatttcacaggcaaatatttcattgatacgtatatcattttgagcacaaagttggttcagtgtgttctaactgaatgtatacaattttcatattaatagcagagcgatcaacaatatttgccaactacccagtttaaaacggctattaaatgttaaaatgtcagtgttcacattagtcttcaataataaatttactgttgcttaaaagtcaactcagtcacattattttttagaattaaacaaaaaattcagctgacaaggcaaaaagaaatggtcaatattgactaagataaaattaccataaaaatcataatactatttttagtcacagtcatcaagatgagacattactattagcaattatctacttaaaacaagcaaaaaatcaaatctctactcaaacaaaaatcggctgttgagaagtcactttaactgttctacgtatcaaataccaacaaatttctactgtgtggctttcagaaatctaacattctaagtttactgaaagcagacaaaaaagaaacaacctggtggcaggcaaaatcacaaccagttgcagtcaagatgggatctgtatgtgagcaatgaagggaggagggcaatttatgcgttcaaaatttaaaatgccaaggtagggggaagagagagaaataaagatatatagctccataaacaaagggagaaaaccatgttgggtgggaggcaacctaaaatttctgacagtccagaatcagcaaatcgaaggcctgtctcaaacaaaacagcttctcacgacaaactttgaagtgggcaaggaggatacattcctttgcacccacaagaaccaaccccttgaccactggcacgctattactgagtcgatcatgatttaccgaacggcccggatgatgggcaaaaagaagagtctgctggagggggcctaggattccagaagcctggggaggcacaccctaggctcggggaaggagagaggtggagaggggctagcactcctcaccgtgattatctttctgcccgatattgtgcgtgcggatgagagaggagagtctcctcacatcccccttgaagacgcactcgtgcaccgggtagtgtgcggggcaactgcctccatccgcgacgacagcaacggggttggtgccggccagaagggccggggactgggagttggcagtcacggaggaattgtgcagcggcagagccggggcgccggggggattggaggaggccggagctgccttcagctgtagccggtggtgatggttactgaagatcttatgacaagctttgccgcccttgccaatcctgcttctggtaaaggtaccgccgagggcagccgccgcttcctcatccccgggctccagcaggtccccttcttctttgctgggcttgtggtccctccgcagtgagcggatcttctccccggtcatcgccgccgccaggggcaagggggggaatcgggaggctcaccgctggcgacggagctggcgctgcggcggcacaaggcgattagagcggtggccaagagcctccagcgcagcatgaactcccactgagcccccgagcctgggacaaacgcatctcccggggaagagccggctctcgcctaggcacgaagggacgcgcgctcgctgggggaagctagaactcaggtgcccacgacaccaggatctcagtctcgccgtcgcagccgccgtcgctgccttacaccgaaaaacagggcacggccatcttcctcttgctcctctcgcgagagctcccccaggagtgaagagagagaaaacaccgcgataagtgagccacccgctccctccctcgcaccttctattcccagaatcactaggcgccggcgcctccgaggcagtgtgtttccgcccagagctggagtctcccagctgccagccgaccccgaacccgcactcccgccaaccgcgctttttgtgggcggtcggaaaccacagcctccgttggatatgttcggtgcatgttataaacaaccacttaaaccctccggatctgagcctcccgcagaggaatgcagaatgacgccacggcacgcaggatgtgatgtcaccgagatgcagaggatactcagtcaaccaacatttactgagcatctacttcgtgccgtatgtacgaagctagcaaatatgtacagcaccagtactgattgcagggagcactgtagaagaggaatgaaggccaaacaattaaaagcggaggcggggaggtgggttgcacacaaaaaagggagggacgaattttagtgttgagttgtcaggaaagtcatagaagagtttaggtgctgactttggaaaatgatgggctgtccagcaatcggaaagaggggaggccactcaaatatttattagatgaatgaatttcgggcagatgtcagagttaacatatatgagggtggggacactcaaggagggcaaagaatcgtgtaactgaaatataattgtattagttcatggccaacctcaacctagtgtcaaactctgaagaaacgtaaatctgccaaccataaaactttaacaaagtaactaaagctggccactgaggacgtaaggagggggcttagcaaaacatcctaaagatcttcacccatttaactctccaaagtccccctatgttctgagagcaaatacttcagatctctctctcttttttttttgtttttttgtttttttgacagagtctctgtagtccaggctagagtgcagtggtgcaatctcggctcactgcgacctccacctcccaggtccaagcgattctcctgcctcagcctccagagtagctgggattataggcctgcgccaccacaccaagctaattgttgtatttttagtagagacggggtttcaccgtgttggccaggctggtcttgaacccctgacctcagtgatccgccagcctcagcctcccaaagtgctgggattacaggcatgagccactgcgcccggccagatctcttctttcttaaagtttatactactgctaactcatctccgcaaacaaacaactcgatgggcctctcttaatcctccccagtcactcaacttttcacctccaattttcttctcagtctgttcagataaatctgtttcttcctcttctttctttttcggtggagtggagagttccgtttatgttaaaacattacccaatcaacagttcaaagcatcctcttgagacagcagtagagactgaaaaaatacatgcaataatgtttgcttcttccacaatagccaatatttattgttaacgctaagccaggcagtatgcttggcactttatatgctgttatctccccctgattagcattagtatcctcacttgacagttaaaaaaaacttgcccaatacttcaatgctagaatgtggtacagtcaaatctgacagtaaggctagagagagaggaagggccaggtcatgcagggctttgtatgtcatcttaaaagtttacacttggccgggcgcggtggcttatgcctgtaattccagcactttgggaggctgaggcgggcagatcacgaggtcaggagttcgagaccagcctggccaatatggtgaaaccctgtctttactaaaaatacaaaaattagctgggcgtggtggcttgtgcccgtactcgcagctactcgagaggctgaggcagaagaatcgcttgaacccaggaggcgggggctgcagtgagctgagattgtgcccctgcactccagcctggggacagagtgagactctgtccaaaaaaaaaaaggaatagtctttttagagatctttaaacagggaatagcataatgcaatcacctttatagaaaattcagtgactcaggccgaacgcagtggctcatgcctgtaatcccagcactttggaaggctgaggcgggtggatcacttgaggtcaggagttcaaaccagcctgggcaacatggtgaaaccctgtctctactaaaaatacaaaaattagccgggcatgatggtgggtgcctgtagtcccaactactcgggaggctgaggcaggagaatcggttgaacctgggaggtggaggttgcagtgagccaagatcgtgtaattgcactccagcctgggtgacaagagcaaaacttggtctcaaaaaaaaaaaaaaattaaaaaaaagaaaattcagtcactcatactttagagaagtatgcatcaagaacagaactttaaagaagtatgcagtaaatcagatgatgagagcatgaaccaagttagtaagagtgaggcagaaaaaggtttaagaggtttttaaaaatgagttcaatcttagcatattgagttgaaagttgcttatctgtagggagttagatgttctacattttagatatttgcaagtgatccttaggtaacagagaactaggtatgggctggattcagaagttatcattacacagtaattaatgctccagaagtgggtgagttccccaaagaaaagtttatagaatgagaaattaagaaggtccatatagaacaaaatcttgaaaacaccaatattcaaagcgtgtgtatagggtaagtggccagcatcctattactaaaaacctacaccaaataatatcccgttatacttgtgaagtattctatcactagagtctgaatttgaaatttctttattagtggctgtcacccatggatgtcacccatggaatgtggaaactcataagtatccctccagtaaaatcaaacaccatacatatcaaaaataatattcaggccaggtgtggtagctcatacctgtaatcccaacactttgaaaggccaaagcaggaggatcacttgaggtcaggggtttgaaaccagcctgggcaacatagtgaaaccccatctctatcaaaaaatataaaatattagccacctgtggtgctaaacacctgcagtcccagctactcaagaggctggggtgggagatccacttgagcctgggagtccaaggctgcagtgaactaggattgcactactgcacaccagcctaagtgacaggtatcctgtctttaaaaataaataaataaataaataaatatcatccttttttattttttattttattttatttttgagacagagttttgttcccgttgcccatgctggaatgcaatggtgtggtctcagctcactgcaacctccgcctcctgggttcaagcaattctcctgcctcagcctcccaagtagttggcattacaggtctccaccaccatgccaagctaatttttgtatttttaatagagatggggtttcaccatgttggccaggctgagtctcgaacttctgacctcaggtgatccgcccacctcggcctcccaaagtgctgggattacaggcatgagccaccacaccaagacttattttttgttgttttttgagtctcattttgtcagctaggctggagtgcagtggcatgatctcagctcactgcaacttccacctcccatgctcaagtggatcctcccgcctcagcctcccaagtgctgggactacagggcccagctaatttttgtatttttttgtagagactgggtttggccatgtcacccaggctagtctcaaactcctggactcaagccatctacccacctcggcttcctgaagtgttgggattacaggtgtgagctactgcccccagcccattcattattattattattttttatagaggccgtgtctcactatgttggtcaggctggtcttgaactcctgggcccaggtgatccttccacctcagcctcccaaagtgctgagatgacaggtgtgagccactgcacttggccccatccattatttttaagggcttgtaaaaatgacagaaatgtaagattacaatatattataaaaaagatagaaatatgattgtaatacattatgaaaaatacaaggattgaaattatataagctcccaatacaatatagaaaaggaagtcattaattctatttggggaaaatagaaattggatgatcagaaaagctttctggggctgggcgtggtagctcatgcctgtaatcccagcactttggaaggccgaggtgggcaagtcacttgaggtcaggagttcaagatcagcctgaccaacatggtgaaaccccatttctactgaaaaatacaaaaagaatcagccaggcatggtgacgtctgcttgtagtcccagctgctcgggaggctgaggcaggagaatggcttgaacccaggaggcaaaggttgcagtgagattgcaccactgcacaccagcctgggcgatagagcgagactctgtctaaaaaaataaataaataaataaaagaattacatcaaattttatcccttcttagcacaaatttttttttaacttggcatagaattcagagccaggaaattgtgttgaactaactttccaaataaaatttagcatgtcattctattatgaacgtatgccacaaaccacaatagtattagcattagtagtacctgtgacttcacaaccaaaaaaaccacaggtattttcatttcacataacagttgctgcagacaactcaaaatttcatttatagtcattagtacctctaaaattatcttaataggtatgctcattgctatatcttgttctttaattagttaataaagaagcatatacattactgtattacaaatttgcttttaaaatattttgttaggtatttcaatactcagagtttccttttaatccaaaatattttatgcatttaaaaacactgttctgaaaatgggtccctgggtttctccacactgccaaagagtcaatggcacaaaaacagaagttaggaacttcttcttaggaatctttgatgatacctgcccattcgtctccttttctctcctatccaacaaacccatcgttctgaattaggtgtccctcctttgtcttctttttgatttcccattgtaacttctgcatgcctccttgatattcttgtctggtctcaactaatccttggagctctctgagcactggaatcatgctgatcattgctgtatgcacagtgccctacagggagtgaatgcttatattaataataagcagttgttgaattaatcagtctattagaacacaaaaccccaagtatctacaaggtactaagacaactgcagactcagtaatgagatgctaaataaacttcttaaataatcccaatataactacactgaaattagctgctacactcttgaattcttacatgaagccaaagagtagatatatcatttaggactttttgtttttcatgtagaagtaacaataaattcaattgaaacagggttaaattaaaggaatgtattgacttacataccagaaaggtgcagagataagtcttcaagagtggcccctcaggatcccatgtcagtttttcagtgaatctctcggtgtttctctctgtatgaggagtcctcctcaggcctgcttccttcaagaacacaagataactgccagcaggtaaaagcagccacgtgcttcctccttaaggtccaaaggagttcctgctcccacataaatctggagtatgacagttacaagataactcagtccaatctgtgtcccagagaacggtgattggctcaagcctgggttatctgacaaacccctgtgaaggaggggttactcagattagtttcacccaatcaggattgatctcggagccggaggtggggcccagctctccaaacagtgaactgtttcataatgggaatgaggtggggaataatgttggagagacaaatgcaagagtggtcagcaaaagtactatatccaaagacttaaaacaggattttgcttcaaaaaaatctgttatcacagtgtcttgaattcaatatgataaaatatgtagtgattatcaattatatcaatatgtaatgagtaaataacttcactggtaaacactgtatttactttttattcaaattttacaagatagaatgcaatccatcaattcaagtatagaactaaactactggccaggcgcagtggctcacgcctgtaatcccagcactttgggaggctgaggcgggtggatcacctgaggccaggagttcgagaccagcctggccaacatggcgaaaccccgtctctactaaaaatacaaaaattagccggacgtggtggtggacccctataatccaagctacctgggaggctgaggcaggagaatcgcttgaacctgggaggcagaggttgcagtgagccgagattgtgccattgcactcctgcctgggcaacagagctagactccatgccaaaaggaaaaaaaaaaaaaccctgagaactaaactactgaatttgctaggtaatactctgtagttctacaaattagcaaattaatttctctcctggtgtagttaactcaataatgctcaatttgccttgaatagcaaaaagcttctgaaaaatgaatgtttttcaactttttctaatgagagttttgttagatagttatgtgctcaccaacaccaaacactgactagacagttaaatctgtctctaagaaagaacgttgtgaattttgccagaaatttatgtatctctattagccctacacaaagcacctaatccctgtcctggtgtcttcatttaacaaaagcagtagtatggtaacatgaaatacagaacagcagtactgtacaaaataaaatctcactcgttatattttttaaatatatcaacagacttccaattaggatctgtagttactaaccttactcaattctcattgcattgcatactaataatgtttctaatgtaaatattagtgcaagtttagtctacatcttttttctttcatcttctctgaagatttgtgttttatattctcacaataatctggaatatgatttcctacattccacaatggttgaacaagatctaggagtattttgtttgatagatgatagggctatctaactaatgaggtaattgtctctgaaatctgacgacacagcagtacactgacagatgaaaataacaaaccatgtaaatcaatacttaattcacacattttacttccatctccctgggtctcagtatttttctctttcctctaaatctgcccccttcctttctcagaggcaatgcagagcactttccctttcttctacggtttctgatcagtggttatcagtgattttgtaaaatttctcttaagtaatcagaaaaaaaatctgagaagcaggggttgccaaggaaaccagagccaataacagctggaagttcctgaaggaagaaattcctttgagacagataaaacctacagactgatttggaggaagaaggagaaaaaatgccaggagcacagtgaaaggctgagtcaatgagatgaaaaggaaaagataaagtgaaacattcataattaaaattatttttagatcgacaaaggctagaaacaagagaattagaacagagacaggaatgggttttttagtgaaagaagaggttaagacacaatgggtaggcccaacactttggaagaccgaggcaggcggatcacttggggccaggagttcgagaccagactggccaacatgacgaaaacccatctctactaaaaatataaaaattagccaagcttggtggtacatgcctataatcccagttactacagaggccgagcaggagaaatgcttgaacctggcaagcggaggttacagtgagccgagatccagcctgggtgacagggcaagactgtctcaaaaaaaaaaaaaaggcacaatgggtagtgtgtaagagattaaatggtatagatagacaagggtcagtacatgtgtccatagcttcctgaatatgttttattttaaattactttattgctcagaatatatgtaactacatctgtatctgtagtctaaatactccgggccgggcgcagtggctcacgcctataatcctagcacttggggaggccgaggcgggtggatcacctgtggtcaggagttcgagaccagcctggccaacatggccaaaccccatattgtatttttagtctctcctaaaaatacaaaaattagctgggcgtggtggcaggcgcttgtaatcccagctactcggaaggctgaggcaggagaatcacttttacctgggggcagaggttgcggtaagccgagatcatgccactgccctccagcctgggtgacagagcaagactccatctcaaaaataaaataaaataaaaattcctcaagaacaactaactcaaaacttccaaaatgaaactcatctccatcagcaatctcactgaccaaatccatatttcacttctcattacctttgactcctcccttgccatgaggcaggaaaatagggtctggaggcagggaacacaaggccaattcacacttcagctatgacaggaaatatcctctctatgagatgtatgctgtaaataactttgtaattttacttcatcctctccatttacatagggtgtaacacaagtaaccaatggaatcctctagggggtatttacactccccaaaaaatctgtaacaggtcctttgaacccctatgctgctcccacgctgtggagtgtactttcattttcaataaaacccttcattcttccttgctttgtttgtgcgttttgtccaattctttgttcaagatgccaagaacctggaccccctccactgttaacagccataaaccccacattcagccagtcacaaaatcttgacctttctacctactgcagagctctaaaatggaactctttctcttgatttttccactgccgatgaagagtcaaactctgtcaaatatttgaagagatttcttctgaatcaaatatgaggacagccctcaggaggtcctgagaacatgtgccccaggtagtcgggtgcagcttagttttatacattttagggaggcacgagacattaaccaaacacatttaagaaatacattggtttggtccagaaaggcagaacaacttgaggtggtgagggagacttcaggctatcggtaaatttatttgtttttgttttgttttgttttgttttgtttgagacgagtctccctgggacatccaggctggagtacaatggtatctcggctcactgcaacctcagcttcttgggttcaagcaattctcctgcctcagcctcccgaatagctgggactacaggcgtgtgccaccatgcctggctaatttttatattttcagtagagacggggtttcaccatattggccaggctgttcttgaactcctgacctcaagtgatccgcctgccttggcctcccaaagtgctgggattacaggcctgagtcactgcgcccggcttataggtatatttaaacattttctggttgataattggttgagtttgtctaaagacctagaattaacagaaaggaatgtctggcttaagataaaggatgatggagacccgagttcttatttgcagaggaagccttcaagtataggcttcagagagaagagaatgtaaaatgtttcttatcagacttaaagtctgtgctgatgttaatgatgaagaggtataatgaggcatgttcgaccaccacttcccatcaggacctgaaacagtctctgcagttaaattttaaaagagccgtgaatgaggaggaagtccattcagatagacggttggaagggggatcttagaattttatttttggtttataccactagccatatttgggttcaggctactatcacttgaaactgtctcctaactgatctgtgactcccatttcccacctgtgcttgcacacacaaaacctcacatcactcaccccttggattgccagatgtatcaaataaaattacaggacacccagttaaatttaaagttcaaatatacaacaactttttagtataagtgtatcccaaataggacagggatatttgtaatacttgaggtattgtcccatgcaatatttgggatgtacttacacttaaaaaaaaaaaatattggtgttgaccaggcacagtggctcatgcctgtaataccagcactttgggaggccaaggtgggtggatcacgaggtcgggagatcgagaccatcctggctaacacagtgaaacctcgtctctactaaaaaatacaaaaaattagccgggcctggtggcgggcgcctgtagtctcagctactcgggaggctgaggccagagaatggcatgaacctgggaggcggagcttgcagtgagctgagatggcgccactgcactccagcctgggcgacagagcaagactccatctcaaaaaaaaaaaaaaaaaaaattgttgtttatctggaattcacattttacttgggcacttttgttaaccaaaaataaaattgtaaagcccccccatcatttgaatgtgcttcctccatggacaggaagctcgtataatttaacctcaaagtgtgggggcagtggctcacatatgtaatctcagcgctttgtaagacctaggcggacggatcacattaggtcaggagttcaagttcagcctggtcaacatggttaaaccccgtttctactattatctcaaaaattagctgagcatggtgtcaggcacctgtaaccccagcctcttagaagattgaggcaggagaatcgcttgcatccagtaggtggaggttgcagtgagttcgagattgtgtctattgctataccagcctggagtaactggagatgaaatgctctgtctcatggaaaactaaaaaaaaaaattaaccttagagagtgcttgagtaccatgatgattaagtgggggtcgagttgctggtctgcatgatacctaacccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggttgcagtgagttcagattgtgtcattgctctccagcctgggtaacaagagtgaaattccgtctcaaaaaaagaaaaaaaaaaattaaccttagagattgcttgaggccatgatgagaagtgggggtcggatctgcttcatgatacctctcaggcattaacatcaacacagatcttaaatctgataagaagcatttacaatctattctctctgaagcctgctacctggagacttcatctgcttgataaaactttggtctcagcaagccagacatttcctttctattgatcccaggtatttagataaactcaaccgtcaaccagaaaatgtttaaatcatactgaaagccctcctcaccaaccactttgagttgtcctgcttttctgaaccaaacaatgtatttcttaaatgtatttgattaatgtcccatgtctccctaaaatgagtaaaaccaagctgctcccggaccacctgagacacatgttctcagggcctcctgaggtctgtgtcacagaacatgatcactcacatttggctgagaataaatctcttctaatattttacagattgactcttttcgccgacaccttgtatttcgtctggcaaccttactcacccctcaaccatttgtttgagttgtttagagttatggatatagttaaagtacgaagccaaatgtgtgggaataataacgccaaattcaagatagtggtttcaatggagcacgaaggagaaaaacaccatcaggggtatataagaaaattctactgtgtgtgtttgtattgtatatgtatttttaatttttgctttttaggtttttcctctttttaaagagtacttatgtgatttttttttctgtgataggtcttgtcaacggaaaggggtccctatccagaccccaagagagcattcttggatctcttgcaagaaagaatttgaggcgaatccatagagtaaggtaaaagcaagtttattaagaaagtaaaggaataaagaatggctactccatagacagagcagtggcacaggctgctcaactaagaatactcagttatttttgtataccctaaacacggggtggattattcatgagttttccaggaaaggggtaggcaattcctgaaactgagggttcctctcctttttagaccatatagggtaatttcctgacattgccatggcatttgtaaactgtcatggtgctggtgggagtgtctcttagcatgctaatgtattataattagcatataatgagcagtgaagatgaccaagaggtcacttttgttatatataaagttttggtgccacaaaagaagtagcactcgaatataaaattttctttttaattctcagcaaggcaagttacttctatatagaagggtgcacccttacagatcaaacaatggtaagcgctcatttggacaagggaggggaaggggttcttatccctgaagcacgtggcccctgttgctgtgtcattcccctattggctagggttagactgcacagcctaaactaattccgattggctaatttaaagagaatgaaggggtgagtgctttggcgggagtcagggcagagcaggtagcaggtaattggaatgagttagggtggagccagtgattggaatgtagggtggagcaggtgatcagaatgagtcagggtggagtaggtaattgaaaaagattgctttatgaggaagtttaaaagtagaaggcaaagaattgaacatactgacatattaattctttgaaaagaaatttagaactcatatctaacaccatcttgcttttggtgggttttggctggcttctttaccgcatgctgttttatcagcaaggtctttgtgacttgtattgtgccgacctccttaacttcctgggaatgcagcctagtaggtctcagccttagtttacccagccgctattcaagatggagtcaccctgtttcaaacacctctgatagtcttgctctgtcacccaggctggagtgttgttggttcactggaacacgagtatttatgttttatttcttaagcttagtgatgtgtgtcagacctctgagcccaagcaaagccatcatatcccctgtgacctgcatgtatacatccagatggcctgaagcaagtgaagaatcacaaaagaagtgaaaagggccggttcctgccttaactgatgacattccaccattgtgatttgttcctgccccaccttaactgagcgattaacctgtgaacttccttctcctggctcagaagcttccccactgagcaccttgtgacccccgcccctgcctgccatagaacaaccccctttgattgtaattttcctttacctacccaaatcctataaaacgggccccacccctatctcccttcgctgacactctctttggactcagcctgcctgcacctaggtgattaaaaagctttattgctcacgcaaagcctgtttggtggtctcttcagacggacatgcatgacatttggtgccgtgactcagatcaggggacctcccttgggagatcaatccgctgtcctcctgctctttgctctatgagaaagatccacctacgacctctggtactcagaccaaccagcccaaagaacatctcaccaattttaaattgggtaagcggcctctttttactttcttctccaacctctctcactatccctaaacctctttctcctttaaatcttggcaccatccttcaatctctctcttctcttaatttcagttcctttccttttctggtagagacagaggagatgcgttttatccatgaacccaaaactccagcgccggtcacagactcgggaagacagtcttcccttggtgtttaattactgtggggatgcctgcttgattattcacccacatttcagaggtctctgatcactggggacacctgccttgatccttcacccttagtggcaagcacactttcctggggggcaagcaccccccatcccttctctccgtgtctctaccctctcttttctctgggcttgcctccttcactatgggcaaccttccaccctccagtcttccttcttctcccttagcctgtgttctcaagaacttaaaacctcttcaactcacacttgatctaaaaccgaaatgtcttattttcttctgcaataccacttgaccccaatacaaactcgacaatggttccaaatagccagaaaacagcactttcaatttttccatcctacagatacccnnnnnnnnnnnnnnnnnnnncatatttctgaacaattccttgcctccactgtgagagaaatcccagccacatctccagcacacaagaacttcaaaatgcctaagccgcagtggtcaagtattcctacaggctctcctccatcagaatctagcttcaagtgccagtaatctggccactgggccaagcaatgcccacagcccgggtttcctcctaagccatgtcccatctgtgtgggaccccattggaaattggactgtccaactcccctggcagccactcccagagcccctggaaccctggcccaaggctctctgactgactccttcccagatcttcttggcttagcagctgaaactgatgctgcccaatcacctcggaagcctcctggaccatcacagatgcttttggtaactcttacagtggagggtaagtccgtccccttcttaatcagtacggaggctacccactccacattaccttctcttgaagagcctgtttcccttgcctccataactgttgtgggtattgatggccaggcttctaaacctcttaaaacttcccaactctgatgccaacttggacaacattctttcatgcactcctttttagttatccccacctgcccagctcccttattaggtctagacattttgattaaattatctgcttcccctgactattcctgggctacagccacacctcattgccacccttttccccagttcaaagcctccttcacatccttcccttgtatccccccactttaatccacatgtatgggaaacctctactccctccttggtgaccgatcatgcaccccttaccatcccattaaaacctaatcacccttaccctgctgaacaccaatatcccatcccacagcacactttaaaaggattaaagcccgttatcactcacctgttacagcatggccttttaaagcctataaactctccttacaattcccccattttacctgtccaaaaactggacaagtcttacaagttagttcaggatctgtgccttaccaaccaaattgttttgcctatccaccccatggtgccaaacccatatactctcctattctcaatacctccctccacaacccctctacaacccataattctgttctggatctcaaacatgctttctttactattcctttgcacccttcatcccagcctctgtttgctttcacttggactgaccctgacacc

SEQ ID NO: 14879 - DNA, 7546 bp, Human
tgcctcctaagatcctgttctgggattgaggttttcccaggagcacgggaagccaccttgaggccatgtctgccagacaaaaggctaggaaagggagctagtgcagtgaatccgaacagcagggctggatacctaagtgggcagacacaccctgtggccctcagcaggtgcagttgaaacttgtcccaacccaagcccaggtgagcaggaaagcattcactgtggggctccccttccattcacagccaactaggggtaggcacggtgtggcacttccatgccaggaggttacatgtggaattggtcagagctggaatgggaaaccagctcagcctctttctttgtgatcttgggtaagttactaaatttccttgggcctcagtttcctcatctgtaacatggggataatagtttccatgtcatggtttcattgtcgggataaaatgagatgatgcatgcccagggcttagcaccatgcctggcacatgtaagtgcacaggagctgaggccagcaggatatggaagggagaggacgtctgcgagtactgggggcagagggtgaggcagtgagagtggggccatgatactggcctcatcactgttcctgagtgcccctgctttcccagccaccacctgcttcttctaagtgccctccatcccacagttccaggtgccccaagactcatcagagcagagcagtttctcccaattttccagattgccctttgacttcatcacttctctcttttggggctgctttgccctaacgcattggaaagattcctctcactgcagtttaagttattcctggttccctttgttgatttcctagtccttggttactagaggagtattttctaagggaaagcacatgcaaatcaagccacatcattctaggggcaatgtctgtgtatgggtatgttgggtgcgtatgggggatgaggcaggccaataggcaagcatgaagagaaggacctggggggaaggacacactggcccactctcagcacagtgtctcccaagcaggctggacccggctgacctgtgtctttggggtcaagcccaactgtaagcctttctggggcacacatacaccctcctggctaacagtggcccatgtttctggacctgctgaggctgagtgggctcacttcatggcctgaaagcagtagctgaccctgtcatgggcttggtccccaaggctctgtgaatgagagcaggttggttcctggaactgagacctccttcctgttgggtcttaggtgaggctgtttcagtttccctcctcttccttgcttcaccttctcatttgtgcaatggggacactcacccacagcttcttccatcagaccttgcccatccagccaacaaacttaggaagtcagggtcttccagcagccctgtgagggtaggcttgtatccccggtggggggcagtgactggcgagggcaagggggagttagggagtgggtcatggacaatgggggagaagtcatagctgatgggggtcatagaattttggggtcattgaaaatgtggaagaggtcagagaacaaaggggatgggagtcaaaggatgtctaagggaaaggaaataatcacgaaggtggatgatcagagggacacctgggaagaggggaatggtgaaaccagaccctggatggggggagcagggatcatggaaacgaggcctcttgaagggaggccacaagacatttcctaattttggctaccaaaccaaccagggaaatcccgctaatgccagttcacaagaatgcagaacagcagactgttattgctttgaccccatggccagaaaaattcaaagagcaaagtttacccaatcagctaccaggcatataatgatggtcatcacaacttccatgagtattgcattttaagcagcctttggaaatactttcagagtttttttggttttgttttttaacctcaagtcactccctaaaaagacagtggaaataaatttgaataaacaaaacaggcttgctgaaaataaaatcaggactcctaacctgctccagtcagcctgcttccacgaggcctgtcagtcagtgccccacttgtgactgagtgtgcagtgcccagcatgtaccaggtcagtgcagagggctgcctgagggctgtgctgagagggagaggagcagagatgctgctgagggtggagggaggccaagctgccaggtttggggctgggggccaagtggagtgagaaactgggatcccagggggagggtgcagatgagggagcgacccagattaggtgaggacagttctctcattagccttttcctacaggtggttgcattcttggcaatggtcatgggaacccacacctacagccactggcccagctgctgccccagcaaagggcaggacacctctgaggagctgctgaggtggagcactgtgcctgtgcctcccctagagcctgctaggcccaaccgccacccagagtcctgtagggccagtgaagatggacccctcaacagcagggccatctccccctggagatatgagtgagtctgctgcccctcccgaatgcctgccctgtgtgtgctggccagggtatgcgtgagggaccagggcaattccagcttactttcccattttgatctcagaggggctgtaaaggtttgggagttagacaaggtctgtatttgagtcctagctctgactctcattggatgatcttgagtcaattcaagttttcaaaactcagggtttttttttttttcacctgcaaaatgatataatgccccataggctaatgtgcagatcaaatgaaatataatgtatgtaaaagtctgtatttatgttggttctctccttttcttttaaaacatccctataatggcccatgttttttctgggtaaaatattagggaataatggcatgatacaggcatgaagcatcccaataccaattgatactgccctggccatgaatgggttagttataagcatactaaaggagtgaaacccttaacttttgggggcagctggctggctggagctgtggactggatatctttgatcatgatcatgggtactgtattctttcactcagtgtgccacataaatattatagttctctatttgtgccatgatatgaaaaatattaggaagtgctgaaatatgaatgatgaagcaaaatattaaaaactagggtcttagggattccagacatgtgatttcacttcttccttctagttctgtcttagcattggctttgggggtagatggagaagttcagtggtggggagggggtcagatctaactgagattggatctagtgtggacactacaggtcatgactctttggagtggtctcagaagctggctgggtcctgggccaaatcagatggcatgggagcttcttaggggaggcgggtgccagaggttaactcagctgtcttccagaccccttgctgggagtctgtgaacccgagaaccactcaggtggctttccccaaagtgtgttctgtgcaatgctcatcccatgagctgcttctcagaaaaaagtgatgccaggtaaacttgggaaagactgctgtatctcctaccccttggagattcatactgtcattgtacattaaagtctgcaagaagtctgtagaaagtaaaccgttaaactggtgtttcccaaattcatttaagcacccaacaggtgcaggtgatttattagggaacccactttgggaagtgatgtgctagctaattccatttgccagggcttgtctgtgtggggaatggtcccacaagctggagactgtcgcctgccagactaatggagtcgcagacctgtgggacatctacttttcagtgtttttcatctttctttctttctttctttttttttttttgccatgaaatcctttcagaataagtaaataagtcttcccatgcactctcaagtatgcttataatataagcttgcacagcgtctggaagaatgtgcaggaaatagttgaggatagcttcttctggggagtggggctggtagggagagactattaactttcactctttatactctttaatacttggatgtcagagtggtttttacttttgcaataatgctataataataatagaaacaccacctaaagtccggcccggtggctcatgcctgtaatcccagcactttgggaggtcgaggtgggtggattacctaaggtcaggagttcaagaccagcctggccaaccatggccaacatcatgaaaccccatctctactaaaaatatgaaaattagctgggtatggtggcgggcatcaggagaatcgcttgaacccaggaggtagaggttgcagttgagccaagatcgtgccactgcactccagcttgggtactccgtctcaaaaaaacaaaaacaaaaaatcaaaaaacaaacaaaaacacctaaagtgtaatcattacaataagaaacctcatgctgagtcagatagaagcagtgctggtcaatggaggctaaggcaggagcctgctcaccctcccctgcctccctcacggtcccaggaccagttggaaagcactctgtcacctgctaccctcatttacagtggggaaaatttaataaaggagggaggtgacttgttcaaagttacacagcaagtgggttcagaactgagacaagaggccaaggccccagacggaccatttccttcttctggcactcccatgccaccccaccctctctgtttccggcccatctttccaaggcctgacaagtgccgcccccacaggttggacagagacttgaaccggctcccccaggacctgtaccacgcccgttgcctgtgcccgcactgcgtcagcctacagacaggctcccacatggacccccggggcaactcggagctgctctaccacaaccagactgtcttctaccggcggccatgccatggcgagaagggcacccacaagggctactgcctggagcgcaggctgtaccgtgtttccttagcttgtgtgtgtgtgcggccccgtgtgatgggctagccggacctgctggaggctggtccctttttgggaaacctggagccaggtgtacaaccacttgccatgaagggccaggatgcccagatgcttggcccctgtgaagtgctgtctggagcagcaggatcccgggacaggatggggggctttggggaaagcctgcacttctgcacattttgaaaagagcagctgctgcttagggccgccggaagctggtgtcctgtcattttctctcaggaaaggttttcaaagttctgcccatttctggaggccaccactcctgtctcttcctcttttcccatcccctgctaccctggcccagcacaggcactttctagatatttcccccttgctggagaagaaagagcccctggttttatttgtttgtttactcatcactcagtgagcatctactttgggtgcattctagtgtagttactagtcttttgacatggatgattctgaggaggaagctgttattgaatgtatagagatttatccaaataaatatctttatttaaaaatggcctaatctgtatttggcatccgtggtgcctgaacatctcgcggtctcccagcctgtcccttctcctttccaccattggccctcacctctgtccaccctgccagctctctccgccctccagagtttccgctgcaccctcccgtcctctcccatctctgtctccctggcccatcccaaacaccagggtgggggctaggccgcgctcccggcatgctggagagacagaggcccattgaggcattgcagcaggcacagagcgcccccttgtcccccaacaatccgcctttgtcctccagtcctggctgctgcagcttggtcctgggggtgctgcctgggctgggctccagctcacaccctccctaaaaggaaatgggagaaaggaccggccaaacaagagggttaaggttagagaagggggacacaaatgtcttcaggcttaggtccctgggggctcccagtcctgcccctgttcctctactcacatcccagctcctcccagtttcttttcggacctcctcctctccccttccttctctattccaggctgggttgggctctaagcaaggggagggattagagcctccttcctctctgcccctccccatgggtctctagggggctggtgcaggcagcagcagaggcactctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggtaacagctgcctcccaacctggtgcctccatctccctgacccccggctcctggccagccttatgccagcccccagctcacccttcagtagcctccttccccaagccctctggacacctctcctgcccgcagctgccccttcttcgtctcctactctgccttcttgctgcctctccacccggagacatttacagcaggtttcagttgcagcaggaaggactgcagttagacagggtgactttttgggacattgaggaagcttgagacatagggatgggacaggggcaatgacagcctctaacatggccacttctcagcacgtccaagaagtctaactatcaaaaagggcagacttcctgcaactgcactttatctgtggtctgctgcccagaaacatctcttctcaggaaaggatcttcccctggttacttagcaagaccacagtgtagagttaaggcctctgcacgtatgccaccctaggtcatcagagctaaaggggctcccagaaaccactgggcagcatctgccttctctcttggcatggaatcaaaggctctggtccttgtcagggggctttcaggcatctgggggtggggaaagcattatgaggcagggggctcctcttggtccctgtggagtcgggtctctgtgggcacaactccaggggctggcattcacactgtacctatgaattactgtgggatagtgctcctgggagccatatggcttggccagactgctggggttgctgggtgagcagagtgggaggccggagactgcccttgaccggcaaatgccctgcaacggtggctcctgacaccaggggatagggagatgtgccagagtccttcctcccctccaaggacaggtagtaggtgccagcctaggggagcttccaaggaggggaaggcaaagccctggcccctgcctgtgtccccttcttggcatgttccacatgctcggtcctgcaggccctgaccctcatcatcttcatctgcttcacggcctccatctctgcctacatggccg

SEQ ID NO: 14880 - DNA, 10857 bp, Human
cgtttcaaatcattctaggcctcccagtaaaactgtgaaagccatactttcttctttgcctttaacgcattactgtcaaaaagagtacctccgggtactccttgcttaggagccagagcggcagccaaacaggagggcctggagagcaaattcaaggacatgcgcaggagcctagccacctgggaaatcaaatagataacatagttcattcattcatttattaacccagcaaacatttattaactgtctatgtgagccctgcactgcggggatacagtagtgaacaaagctcttgtgacgcttacattctagtgggagtgctgacagcaaacaaatgacaccgggaatggacaatatcactgggaagcatgttccaggcagggagaacaggagttgcaaaagctgtgaggcgggagcatgcttgctgtgcggccaccgcagggaagccagtgaagctggagtggagtggggaagacagcagggaggcccatgcagacaaggacagcttctctctttctaggacctcccttacgacttggacccgactccagagtgcaattaaggggccggcaagttgggtagcaggctgagagtgtctaaaggacactaaaatatctttggaataattcaggtatttggtgccagtgtactatgatttctgtgtcttggtgaaatatgagttggctttcatccagtgacatagacttattgacaactccttacctggactgcttgtgtctggagtaattttccaacagacaggtgcaaattgcaggatgtagccctggggccagccagctgacagttgcttaaaggcgttagtcacagttgtaattccaaaaattcctgatgcattgtgaatgctgctccctgagggcaagagatttatactattatccacattttaagtggtttactatgcttaccaagaagttgtttgcttcagaagattgcatgtgatgaagatatgtaataatttttttcttttttttttttggactggagtgctcactgcaacctccgcctcccgggttcaagcgattctcctgcctcagcctcccaagtagctgggattacaggcgcccgccaccacgcctgctaatttttgtaaatttagtagagacggggtttcactatgttggccagactggtctcgaactcctgaccttgtgatctgcccgactcggcctcccaaagtgctgggattacaggcgtgagccaccgtgcccggctgatgtgtaataatttctaattttaaatataaagaggcttacacaatttgtattccaggaaaattgatatttcccccacctctgctaagtaaacgttcgacggatgtttaaataaaactggttcgaagggatgccaactcattagtctgcccagggtgccatggcccagttggctcttacctggcgacatatatcgatatcacctgaaccaattagagatctcagctgtgagtgagcttgcttggtgtttaaatgtgtgcttggctgtccccctataagtggtcttccttggcttgcattacctccccttggcttgctttaggggctgaaatggcactgacactcttgagatgggactgcagagtttccttcccctaaccatgggatcgtatcccctctgcagaactaaggatagtacatgagtgggagatgagtaggaaatgggatgagtggagttgcaagaggcatcagaggtcactgtcaatggaggggaaagcttaagtgctcagtaaatgtagggcaacaaggaaggggggggtgaggctgaggtagggaggagaaggagctgagactcaggtatttggtgccagtgtagtagagaaggtgcctggaggcgggcaggcactgaggtcctctgggtctgaccaggcagtcccagctccagcccgtcccctggcccctccccgctgccggccagagtcacacatgtgttttcctgttttccatttcagtccccgttaccctctgctttttctgctcctcagagtcaacagctgttgcagcatgagcgatacgcttggttctcctaactagcaccttcccctctcccctgactcagctggtagcccctcctccccgcacctgcccaaaggtcactggacaggtaagaggtgggagaggagggacaatgggcgagaggggaagtgcaggaggaggatggagtcctaaaaattggctgaatggagacccaagagcctcctgtttcttgatcccagccctgtccctccctgggctgaaccttctgcccagagacttcagcccttccttaatggaagccctggccacaggagtaaacaatttcttttttgtttcactttttttttttttttttaaagagactgtcttagccacagtggaatatagaaaaacaaacagagaactggggagggaggagctgagcttctagcttggagtgatggggaaatctagtcataccagagtgtatctgttttctgtttctgttgttaggggaggcagcacagactgattggagccaggaaggcaggacatggggtctctgggagagaaagtgtgttcttacagtagttccctgagcttggctgaggagccaagaccccgaattatgtgctagttcctggagaaattgtgttttggtgttgtcattcgagggtgaggttagggtgaggggctccattggctgtcctgcccagcactgcatactggaggccctgctgccagtttctgaatcaaatttcttccacaagctgtaggatgagtgtgttgtcctgtaatcttcactgggtgttcagagatgaatgcatctcagacagggaaaggcaacaagggctgctgttatcttatggggtttctcatgtaaaacctggggtgggtcaggcacggtggctcacacctttaatcccagcactttgggaggctgaggtgggaggatcacgaggtcaggagttcgagaccagcctggacaacatggtgaaaccccatctctactaaaaatacaaaaattagctgggcgcggtggcgggcacctgtaatcccagctacttgggaggctgaggcaggagaacccgggaggcagaggttgcagtgagcagagattgtgccactgcactccagcctgggggacaaagcaaaactccatctcgggtaaaaaaaacccaaaaaccaaaaaaaaaaaaaaaccaaaaacctggggtagaagagcccctttgggagagcctaggggtgttgctggtcccaggctgcctgaatggtggggctgcctgaatggtggaagcattaccctaagacccagggtctcagggagaaatgtgagctgccaaagatggtgccttcttgtccagggtgctaggtagtggttgagaaaagagggggtcttcatgttctcaatgcatggcagcctcccttgcctagtgcgcacgggcagactgaagtaggttagagtccactagcacttcctggtgctaccactagggcgtgctgtttgctggagtgtgggttttacccccagcagatttctgtctcaaaattccacggataggacttcacttttcagatgctaccagtcaggaatgaaaccctgtacacttctctctccattccccctcacagttttcccttcctttgtccctccttccttcctttcttttacgtcatattaggacacatgcccaccccttggtgccagtgaatttggtcttaaaagggcaggcgtgatgatgtgtttgtgtttttttttttgtttgctttagaagtgggcaccctagcaatagcagcactgccaagaggacttgtaatcacctcttatccctgcaaagaatgagaaaggggaggggcagccaggaaggagattaacaaactttgttggagcctttcgtctaggctatagactgaaggatgacagaggctttctttctttttaatctagtctgcttacatcttcccccaggtaattcatgtagataattcctgtccaaaagcaaggtctaaggtggcaccggtggctcacgcctgtaatcccatcactttgggaggcagaagcaggtggatcagttgaggccaggagttcaagaccggcctggccaacatggcaaaacctcgtctctactagaaatacaaaaattaggctgggcacaatggctcatgcctgtaatcctagcactttgggaggccgaggtgggcggattgcctgagtttaggagtttaagaccatcctggtcaatgtggtgaaaccccgactctactaaaaacaaaaaagattagctgggcgtggtggtgtgcacctgtaatcccagctactcgggaggctgaggcaggagaattgcttgaacccagtaggtggaggttgcagtgagccgagattgcaccactgcactccagcctgggcgacagagtaagtgtctgtctcaaaataaataaataaaataaaataaaataaaataaaaataccgaaataaaaacacaaaaattagccaggtgtaatcctagttactcaggaggctgatgcatgagaattgcttgaaccaggaggtggtggaggttgcagtgagtcaagatcgtgccactgcactccagcctgggggacagagtgagactctgtctcaaaaaaagaaaataaataaaaaaaaaaaaaaataaaaggaaggcctagagactaaggcaggccagggggatggggagatggagagatagtatacttgtgtgattaagagtatatgagctctggaggttccatgagataatgtgcttaagtccttagcagtgtgtctggcccagtaagtgctcaataagtgatagcaattattattacaggagcattttggagaaaaggagagtctcctccagaaggatttcagatcattgtgagcctgtcttgggagaagcatgatctctgggaacgctcacaccagaatcctcctcctagattaaattaaaagtttaaagagctagaatgggaggatgtatggtagagatgtctcccagagatatttagatctctattctctggttgtagaataaccaaagagggttagaacagataggagaagaaacagacagttggatttcagaatggatagggtctatttctgttggtaaaagagactcagaataccagatttaaagtaaataataaagatagcataaactatgtgatttccaaaaagtgctcagcttcctctgcctgttctgggcctgtctgtccaacagaattcagtgaaatctgatttcctcatattcttttttaattttttttttttttgagatggagtcttgctgtgttgcccaggctggagtgcagtggcctaatgtgggttcactgcaagctccgcctcccgggttcatgccattctcctcattctcctgcctcagcctcccgaatagctgggactacaggtgcccgccaccacgcccggctaatttttatttttttgtgtttttagtagagacggggtttcaccgtgttagccaggatggtcttgatctcctgaccttgtgatccgcctgcctcagcctcccaaagtgctgggattacaggcgtgagccaccgcgtctggcctgatttcctcatattttttaggaaagtggagtcaacttatatttgaggaaggcgtttataggaatttatgcttatcccagagatcttggtatgttttgtcaagaatgaaaaggcacgtgggtctggtggggatgcagtcagatatttgatctcttgactgtgtttcttttgaagtagtctgaggctcagactttggggcagtggcccaggcttggaggcaaccccccagtctctctttgcatggggaagtgtgcagagttctcttagaacacccagtcacatggtgtagagactgctcttacacttcctgtaatctcagcatgggaacaagcctttgtgtcacactgtgcaaccttcctccctttcttaaatgcttggggtgagagagaagagaggctagggtggggcatggaggacacagagagagagagtgctgtgtattccttccccgctactgtcctgtcctcagctaacttgctctgggacagcttccccagggctacagatactgcactcagctgactgtcctttcttctgggcccctggtcccagagcagagctgacaaaggagattcctgagagagcaccttcttatcacagaaagtgctgagccaagagctcctagctgccccttttgcagatgtgaagggccagtgaaccttggacccagatggttgcttaatactcctttccccctccctcactccttcctttgcgggctgcctcacctcctccacccttcttgcttaaatccataggcatttgtctggccttcccttttactgctggctgggaaggaggagcatcagaccacagatcctggaaggcacttctctccctgactgctgctcacactgccgtgagaacctgcttatatccaggaccaaggagtgagtgtgcgttccaccctcttctcatctccacttaccttgctaaccctcctctttgctgctgtgcagtgtctaatcgcttcttctcccgagtgcctctcaccctaacatctctccattgcttgactagcctctcccattttcctctcagctgtctcctgttcggtgttttccagcatgtgctgcctggctgcagctgtctccctgccttggctcggggtgatatctctccagcagcaactctggggtagggagtggccatcagctgcctccaatcatccctaggttttatggtacattggatcgcccttctctcattcatacttttttgggtgattcaacgatgctgatgtgagggatcgatagcaggaggcttagaataccagagaatgggaaaggaaaagcaaggaaaagataatagcctgtcttctttcagggtgaagtgggtctacttgggctttgccagggctgaagactccagctaagggttaagggatgctctttgggcaggaggatggttgtgggtttccagcaggtttctgaagcctttagttttggcagacgtagagtccttggggaaaagagcagtgtcatgagacgctcccacagattagctgctggtagggtcagttcctaatgttgtacctcagcacaggtgatccctgaagctgaaattggagggaagacgggttttggataaggctgaaaactcggggtcaagccattatagttattttctgggagccgccacactgcccccatgcctgtcttgtattatagcaggctcagagagaaccaacatttagtgttttgtttttgattttgttttttttttgagacagagttttgctcttgttgcccaggctggagtgcaatggcccagtcttagcttaccgcaacctctgcctcccgggctcaagtgattctcctgcctcagcctcccaagcagctgggattacaggcatgtgccaccacgcatggctaatttttgtatttttagtagagactgggtttctaaatgttggtcaggctggtctcgaactcccgactttaggtgatctgcccgccttggcctcccaaagtgctgggtttacagatgtgagccacagcgcccggcccaagatttagttctctatttggtgagtcgggtgggcagcaatgtcctaatgatgagagacagatcctttctctctggcgaatgagtgccttctcttaaaaattcaagttggaggctgggcaaggtggctcacgcctgtaatcccagcactttgggaggccgaggcgggcggataacctgaggtcgggagtttgagaccatcctgaccaacatggagaaaccccatctctactaaaaatacaaaattagctgggtgtggtggtgcatgcctataatcccagctacttgggaggctgaggcaggagaatcacttgaacccgggaggcggaggttgcagtgagctgagatcgcgccattgcactccagcctgggcaacaagagcaaaactccatctcaaaaaaaaaaaaaaaaaattagccacgcgtggtggcaggtgcctgtaatcccagctacttgggaggctgaggcaagagaagcgcttgaacccgggaggctgaggttgcagtgagccgagccgagattgcaccactgcactccagcctgggctacagagcgagactctgtcaataaataaataaatacatagatagatagacaaatattcaagttggggttgttttgatgagtgagctggagaaaaggttatttggaggtctccgcattggttggtgagctgcccgtattaccctgtgttggaggcgggtagaggttctatgtaattgccaaccacctaatctatagcatcatctttcttccttaaagggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatttgtaagtggggctggggtaggaggtggtgggtggagggctggacagaggctgggatgtgagtgcagtctgggagtaagaaggagatagagaggaatgtctctgacaacatatatatatatatatatagttaaagtatgctttgtgtgaaaattcaaacagtaccacagtgtatcgcaaaaacactcaccttttccccagcttctcacagtaagcactattagcagtttgcatattcttcctgatttttttttttttttttaaagagacaggtattttgctctgtcacccagactggagtgcagtggtgtgattataccttacttcagcctcgaacttctaggctcaagctatcctcctgcctcagcctcctgagtagcagggaccacaggcacactgatttttttttcttgttccttcaagagatgtagttttggcagggtgtggtggcttatgcctgtaatcccagcactttgggaggctgaagtgggcagatcacctgaggtcaggagttcgagactagcctggccaacatggtgaaaccccatctctactaaaaatacaaaaattagctgggtgtggtggcaggtgcctgtaatcccagctactcaggaggctgaggcaggagaatcgcttgaacccaggaggcagaggttgcggtgagccaagatcgcaccactgcactccagcctgggcaacagagtgagactctatctcaaaaaaataaaaataaaaaaaaaagaggtgtagttttgttcttttacaaaaatgaggtcatactagtctacatgtaattctacagtgtgcttttcctctagcattatcagtgacattcttttctacttacagatctactttttaaaaaatgcttcatattatttcatgtgaattttaaggatgcatagtagtttatttatctagctggtcctctgttaatggccatgtacgttggtttcagtttctcagtcttacagataatgctccagtgaatatctttttgcagctgcatgagtatttctgtaggctggattcttcctttttttttttttttttttttgagatagagtcactctgtcgcccaggcttgagtggtgcaatctcagctcactgcaacctccatcttctgggttcaagtgattctcctgcctcagcctccctagtagctgggattacaggcatgtgccaccatgcctagctaatttttttgtatttttggtggagacggggtttcactgtgttggccaggctggactcgaactcctgagctcaagtgatctacctgccttggcttcccaaagtgttgggatcacaggcgtgagccactgcacccggcctctgtgggctagatttttaatactgtcatttcagtccaccttggctttttctccatctcataaataaaacattatttaaatctgtacattcagtaaagccattggaggtgctgagatgatgattctccatagccccatccctcagatgccactattcttgaaaaatgcccttccaacctgggagagcctaggaccttagagatgccttccaccctgcaactgtgaagaagctcagacattctgtcaatttgaggggcagctgctctagcagttggggcacaggaattttgcaccaggtgcaattgctcattggctcaccgctctccaatcagtttgtgtccttttttctttcaatttctgtattgccccattcactcctcaacttcctttccagcttctctgattttactgttgtgtagagaactggctgtcttctgtggggtccttctgtgttttgtgtgtccttgtgtctggcctggactcatctctgcatatgggatgtttgtcatacatggcaacagtcagggaggggtggaaggcactgctttgtgttgcaagaagggggttttcactgaggttttttttttccgagacggagtttcactcttgttgcccaggctggagtgcaatggcacaatctcggctcaccacaacctctgcctcccgggttca

SEQ ID NO: 14881 - DNA, 146307 bp, Human
aaggaactagcaggatcctaagctttggaattatactctctacctacaggatgtttcctacatcatgtgacactctgtgttcatatgctggtgttctctcttctgagtgtgggaactccaaagagaaaaatattgttcctcctcttccttggatggtgaaacggcttctagctttcgtcactcctgctggtgacaaccacgggttcgttccagaagccattactgagcacttgctatgttctgagtcagctaatatttaagcttcattcttgcccctgagtggggtgcatgccacgctgccccctcatgagtgagcctggcccagtatgtgttgccaagtgagatcatctgtccttcggggaggctgtctgaaatcatgtctaatgtgacctgcttcttttacattttttagctttctggctccctcaaaacaaacaaacaacaacaacaacaacaacaaacagccattgttttgagtccaagtgcttcaaaaggctcctgcttaaggactgtgctgtggtagacatggcggttccttctagcccacatgtggcctagaactctgtcagctctgtcaggcactagtccccggggagatggcccagcgtccatggggtgcgctccagctgctgtggaaaacacagacgggtcatgaagctgatctcggtggcatctttccgcagcagctgtgccctcatggcaaggccagtttggtgctgcgggaaagctctaaagccagatggcggcctcgtcaggggacctggaccagcgtgggcccagcaggaggccaagcatcacgtgaggaaggctggagagacccttctcagggaggactgcaccagaggcccccagcggtgacacccacccctagaggaaaccatggagggagacagcccccaccttaatggcaccacccccagggtccagggaggctgccatgcccctggccccgcagctcagctcctcggggtcacctgttccctctgccagccaccaactgccattccaggatatggtgttctcactgataaagccattctgggcagatgacatctcatcccgttgttggacgggcggacgttgcaaaaggcggcttcctaggccaggcctgcaggagcttggcctgggatggtccagcctggctggtgggcagccccgaccttctggcagctgcgggaccgcctgggcgcccccctgcccgcgccatcccacgccctcctagccgctgtttgcggtgactcacctcggttcccaggaacgttgttatttttggccctggtgttattaagattgtgcccagattccctgcaaatcggccactaagcagcatggggccctagtgaaagcacgcggagaacagagggggcagcgcgcttcgggaggctccccggccttggagagctccagcctccccggggggcggaggggccggccagaaggactcctgcgccccacacccgcagcgccgacagggcgtgcgccctggctcagcgctccccgactgctcccaacccaggggcacccagggccgaagcttcctctacagagcctccccctccttaggaaacaaaacaaaacaaaacaaaaaccaggaaaggcaaattgtgtagatgccactaaaaagaaattcccgcttagtattgcttcccctgcacccagcgacttttagacaagcagaagaggagatgccctgcccgcgactaaaccggactccctttcatttactaccctctcagcgtgtggcctgatgtccaactctgggctctgaactcagctctccccggctgctctcgaccccggggcaaccaggggtccgcgccggccgaggcctggggagcggggcctcctggggttgggggaggaggtgctcttgtaatctgcggtccccaggcgggcgccacccctccgcccgcccgtgccgggagcgcccggcccgacagcaagcgcctctggggccgataaggccctcgggggcctggcccgcacgtcacaggccccgcagaggctgcggtgagtccgccagccccagctgctcctcctcaagcccccaaggcccttcggcgggcccctgctgaaagaccggcatgccctattctgtgggcttccgcgaagtgagtactgggcggctgctcgggtggacggggagatgtcaggagggggccacccaggccgcgccagtaggcagcacgcgagcaagagcagctttgcacaccccacccgcctcgcctccccgtgggctccctgccttagcatagcggcacatcgaccttgtagctgaaggcagcaggtggactctgccctactcgctgaagccagtttcatattttttacatccagagatttgctgtcaaattgagttccaactacctgggtctctgaattatgtcctgtcagcaatagcgctggggagggatggtttttggattatagtccaaatctattgagatcttagaggctttcctttgagtctgctaaactgcgttttgtaggtgtgttattacaggctgcggggtgggccacccggctagggggctgtcactgtcatttggaaggggactttggcttgttttctcaaagactcacggaggccggtggtctcatggtcacacctgctcggttcttttaatttatgttgttaattcatggagagaaatatgtctacgaaggaagggaaagagcggcagcgtggcctggggagataggctctcatggatatttttcaagtgataatggcgcgttagcaaggccactccagccttcttgttctccctgtgtagatagaacccgtcctatctctgcctggcagcacggccagcctgtgccatgtgtcagtgtcctttgttgggtacggttcttagtttagtgatggattcagagcccagagttggacatcaggccacacacacgctgaaagggtagtaagtgaaaaggagtctggtttagtcgcgggcagggcatttcgtcttctgcttgtctaaaagtcgctgggtgcagaggaagcaatactaagcgggaatttctttttagtggcatctgtacaatttgcctttcctggttgattttttttttttttctaaggagagagaggctctgtagaggaagcttgggcctcccactttagttccaccagcggcaagcaattcaggttaagttggtagagtctttttcctcttgtggcaccactctagggcagaggttcagggtgagtcttggagacctgatcatagccaactttggaaggaggcaggtgactgcaggtgtcccgtgcaatgtgtgaactgtcttcagactcaaacgcaagtgttttgcaggaataaggaatggccgatggaaaaaatgggtaaaattagccttctttcacaaatcaagttacagcctcaagccacttttctctgtgtctcagttttcttgtctgggaaatgggtctgctgtgaggctgaagtgagttactcggttatgaaaacattagcaaaggggacagaggcttgaagacgtttattgtaaccaggatccatagactcaactcacccttgactttatgggtcaattataattagtttcttctctgttattggtatataataatttacatatttgtggaatacatgtgagtgtttgtttcatgcatagaatgtgtactgaccaagacagggtatttggggtgtccatagacttgaatgtttatcatttttacgtgttggtatcattacaagtcctctcttctggtaactttgaaatgtacacggtattgttgctattatagtatagtcaccctaagctgctatcaaacaccagaacttatttcttctatctaactgtatgtttgtacgcataaccaatctctcttcattctcttgccccccacccacccttcctggtctctggtatctattattctattctctaggtccaagaaatcaacttttttagctcctatgtatgactgagaacattcagtatttgtctttctgtgcctcgcttatttcacttagcataatgacctccagttacaaccacgttgctacaaatgacatgatttcattctttttcgtggctcaagcagctgtaattagtttttatatttatttatttaataataattattattatttttaagacagagtctcgctctgttgcccaggctggagtgcagtggtgtgatgttggctcactgcaacctctgcctcctgtattcaagcaatcctcgtgcctcagcctcctgagtagctgggactacaagtgcgtgccaccatgcttggataatttttgtatttttaagtctcagtctcaccatgttggccaggctggtctcgaactcctgacctcaggtgatccacccgcttcagcctcccaaagtgccggcattacaggcgtgagccgctgcgcctggcctataatagtttttaaacccaggttgccacctctcaccccaaaatggttctgccagtgtctctgcaaaaccagctgacttattttgagattaatcaaactgcaatatatttagaaaagcagggtttcagttgttggtgttgccaaaatgaacagagaaaataagagtgttttctaaaggtgaagtgactaaaaacctttgtcctccaggtctgtttaacaacctttacggccaggcacggtggctcacgccggtaatcccagcactttgggaggccaaggcaggtggatcatgaggtcaggagttcgaggccagcctggccaatatggtgaaaccccgcctctgttaaaaataaaaaaaattagccaggcgtggtggcgtgtgcctgtagtcccagctacttaggaggctgaggcaggagaatcgcttgaacctgggaggtggaggttgcagtaagccgagatggtgccactgcactccagcctgggtgacagagtgagactctgcctcaaaaacaaacaaacaaacaaacaaaaacctttaacaagcatttatgaagcacctattgtgtattaggtcctgttggggcaccgggaatatagcagtgaataaaactgacaaaaactctgtccttgcagagcttatttcccagcaggggaaggaaacaggctaaaaacaaaataaaggagtaaactgcattctgttgaaaggtgaaaagtcagtcctgttattgagggagagggaagcgggcaagggaaataggatgtgtggggagttctgcaactgaaatagggtactctgagacagcctcattgaggtgccattggataaagaggtgaaggaaacagccaggccaaactccagaggaaacagcacatgcaaaggtcctgaggcaggcgtgtgtcatgggaataaccgggaggccagtgtggttgaagcagagtgaggcaggaggagcaggaggaggtgaggtcagagagattgggaaaggggcacaggtgcagaagatgcagggctttgtacattgatgtggggattttacttctgccttgagcgagatgagaagcattagatagtatttgtatgaggcaaatggcaccatctgacttctgcctatacctatgacttcctaatgcctttgaaaccagggattcacgttttgtagggatgggctaccaaattaaaccacctgatatagtgtggcaaatggtgttatcatgcaattgtagtacaaccgttctcaacttgcttccctctgggatacatagggctggttgttgacatagttctgcatgacatatttcatggctatacctgggtattaataatccccctctctcttacacgttcctatttaatgagaaaatagtgccatagatgctccctacttaataatttaccactggttatatttaaaaggagatgggagccactataaaatcacaattcatatgtagtatatgaatttgcaatcacagctgcagaagatccttcatggtcttcttgggaccttggcatggataaagcggaacaaggttctggagcatgagctgtcaagaaagctcgggtgtaagtgtgcaagagcagagctgtgatagaggggaaccttgaatgtgttctaagttttaaaaagcaacagtggtcttcttacaggtggtctcactccctctaatccattcttcacacacaaccaaagtgctgttttagaagggcaaatcttaccacttcactttcttgctttaaatcttcagtggcttcacagtgttcttaggacagtgtagactccttcctgagatgcctcctgtcctgatcctgcactgttgtatttatttttttttattgtttgtttgtttgagacagggtctcactgtattgcccaggctggagtgcagtggcacaagcatagctcactgcagcctccaactcctgggctcaagtgatcctccttcctcagcctccagattagctgggactgcaggtgtgtgcacctccacgttcagctaatttttgtattttttgtagagacaggggtctcactatgttgcccaggctagtcttgaactcctggcctccagtgagcttccctccttggcctctcaaagcacagggtttacaggcatgagccaccgcactcggccctggactacttcttattcagaactcccacaataattgctccaggacactgtcagttccttcaacaggctgcacttggacatttttatataatattcagaaactctacatgggtgggactcaggcttgccttgttcactgctgtgtccttggcacttagcacagtgcctgccacatggtagatgctcattaaatgttggttgcattcatgaatgaacagtaaattatttgcagaacacctcgtggttgatgactgcttagcagtttgctcacaaacctgcgattgaaaattattgctctagggtttgcgtggatgactttttagatactctgctcttgggattttttaaaattcataaaatagtttctccttcctctgaactctcattgcacttcatcagaacctccctcagggccctcctcattttccacacctccccgcttatttatatatatgtcatctctcctccacgctgtgagcgggcgggaggcgggcaacagctccatctgactcatctttgagtcacttcctcttattttccctggcttcgaccaaggtcttgaacctggggctgaaaaatagatttgttaagtgaattaattggaaacccatgaatgagtctgagctcctgcttctccttcgcttgcccagatcgtgagctttggctgttaggaaaatgttgggccaattgatgtcgggaaggtctggaaaataaatttgcaagctggccccgtgcgggagtaggtggttacagcctgacacccctgccggacgaggtttctcagcacagcccagcctggactgcagccctctcagggcaagtgtggcgtttgtcatcattctccgacaggcagtgacaaccaattagaaatctagtgagaagtggcattgttttccctgctgcctcccgctcacccttgactgtcaccctcccctcggctgctgctctctgagcagaggctgatttatctcctgaatttactgtgggggctcaggaagaaaagcgcattacaggaggaaggctgactgctgctaatgggcccggctgagcagctgctgaaacctattagcgtgtaggggaaggtggcgcaggaatgagacagggtgtgttgcctgtgcagaaaacttgtttatagacagattaggaaaaacaaagcaagcaaacaaccttctgccccccagcccttctctcctataggaacgcctggaagggttttccttcctgagaaagctctgggccccccatggtgtctggaaggcagcggggagcctctgtggccctcccccagggtgttattggtcagaacactgttctgccctttccagatatgggaaatgaagcaatattttggaagaaagggcacctggtttcagttttcttcagaaagttagtgcctccccactttgggagtccgaggtgggcggatcacgaggtcaagagatcaagaccctcctggtcaacgtggtgaaaccccatccctgcctaaaaatacaaaaatcagctgggcatggtggcgtgcgcctgtagtcccagctactcaggaggctgaggcaggagcatcacttgaacctgggaggcagaggttgcagtgagcagagctgcactctagcctggagacagagcaagtctccgttcaaaaaaaaaaaaagaaagaaagagagagagaaagttagtgcctgccaatggatcacctgaggttaggagcttgagaccagcctggccaacatggcaaaaccccatctctaaaaatacaaaaattagccaggcatggtggtaggcgcctgtaatcccagctactcgggaggctgaggcaggagaatcacttgaacccaggaggcggaggttgcagtgagctgagagtgagatgccatctcaaaaaaaaaaaaaaaaaaaaaaaaaaacaaagttagtactgagaaaagctgaaaagaggctggcacaggtccagcccttctccacacctaggggcgcagccattgatggagggtgatgatgatttgcaaacagtggagcagattccagctactcagaaaacctattagcggcttgtgcagccacctggtgccctctgtcctgctgtcagcccactctggcaacctctcctctgggtgggggagctgggctgggccagggtgtgtacctgtagtttgctttttctccaaagggagtcaatggctagaggaccctcatctcccatctgtctaacctctaacatgtctaagtcccgcttgggactggctaatgttctgtctacacggcgtgatttgaagatgccagaatgtcttcgtagtctttgaatacctcccccaacccccattagccagaaagtctaaagttccgccatcagagattattccttaaattcttaaaggggttttatatctcaaagtcttctattaattgcatgcatttaaagctgtataataggatctcgagttgtacagatgcagggaactagttcttagtgggattagttgaggattaggcaaacgccaggagtgagattcagggcaggtcatgaattggtggggtgggggtgggaggtgcagaggtgttggtgcagtggttaggagggaaggggaagctcgctccctgagctccctgagctccctgacttaggatagtgactgggctcaagattccttcccaggccgggtgtggtggctgatgcctgtaatcccagcactttgggaggctgagctgagcggatcacctgagggcaggagttcgagaccagcatggccaacatggtgaaaccacgtctttactaaaaatacaaaaattcgctgggcatggtagtgggtgcctgtaatctcagctacttggaaggctgaggcgggagaatcgcttgaacccaggaggcagaggttgcagtgagccgagatcgcaccattgcactccagcctgggcgacaagagtgaaactctgtctctgaaaaaaaaaaaaaaaaagattcctttccaagtggtcagataccctaggacagtctggcctgtcacagcatggagagtgcagtttggtgagtgatgtgggacttacagtggacctggaggcgggtgacaggaactgcccagattctgaacaccctcttcacaaacgtgtcatccaggtggcgacaggttcagcccaggaattggctggactgtgtggcctgaggtccccggggttttatcccttgcctttctaccagcttttcaaaccttgtgtgtggaattatatcattttaccatacaagaagcacagcactttctttatatatttcatcttaacgtggtattgaaactatcttgggatgtaggtgacagtgtcctcgctttctagatgaggaaacagggttgaacagttaattgattggcctatgtttcccagcgaggttcccagctcacgtctgtctcctaactctctaatatagacactcttcaccatactggtcgtgctgaaactgttatttagatgcctgtctccccactagtcttcagtcccaatgtccagattgcctggtgcaggtgaactcgtccacacagggccttgaggctggcagtgtgaccgcaggggcccagcagcacagcacatggtccagcttgtgggcaccgcagccagagtgcctgacctccaacctgtgctctgctgctttctggactttatcctccatcagatatgtgccctccccgcatctccagtccgcacctggaaaccaaagaccatcgtggttgccctggggttgctgtgagcaacacaggaaatcagagccagccttttgggaaaagtcggtgattataaacttttttgaaatcacaggttcttctctggatcaataactcttaaccttctaagaactctggaaatttaaagaagatcttcctacctttaacgtacctttgactcaggccaacagaaagtatggaataggaaacagtaaatcacacagtctcttgttctcaggaagtgggaaatgctgcattcgaacaataccatggaggctgaaacagggaagagtgaacgctctggccaggaaagcaagagagtgtgccagggaagctttgcagaggaagagaactttgaatgggccttgaagaatctgtagaatttcacaaaacagagaaagcctcatgaaaagtgtggcttgtgtgtttgggagaggtgtaggatccagtgttgagggacaggtggggtggacagagtaggagatgaggatgaagagatagagaggagctggtttgaggagccttctgaacgtcagcctgagactttggtctttagtccacaggggttggggaagcccacaaagctttctgagtaggaaagtgttagggcttcagaaagcccccatctggcagggctgatgaagaggggtcactggagtgaaaatattgcccctctaccagtaaggtttgatgaggtcctaaatcgaggggattggaagatcatgaacattcttgagtagcgactttgtacccgccaccatgctacgtgattaaatatcgcagcatatttaatgcttacagtggccacataaaaattacccatgttacagatgaggaaactgagattgcagctaggaagagtgatgaaataaagttgtttattggggatattgactggctggtcgtgtaggtgcccttgtggtctgagatgtagttctggtaacttgattttgagacacaaccagaggatagcaggtttggaaactgacttaatgcacctcacaggtgtctggtgttcacgtcagtactccgacttcacaatgagaaatctgactcctccggtcctctgccattctgtgttcttgttcacttgtgttctccggtcagtgaattctgtcctaataagaaaacctaaaaggcaagtcagtcacaaccaatgtcctggtaagggcgcaatcagagaaacaggaggcgacatcatcttgaatctgtcatcgagactgtgctatggcctgatgaatcatgcacgccccatagccaagagcactgtgtttgttacaaattgctgattaaacaacattggaatagaaaatgagtctcactgcctggtgtcaacgccaatccaattgatagcagctgtctgggatgctgtgttgagagattctgaagccactttaaggcttatgggcaagagtgctgtgataacttagcaacctctgccaggggtactggggggcagggtggtgtattatggtagccatttctaggtcactggtgtttttccttctttctcctcctcctcctccccctcctcttctccttccttccttcctgcctgcctgccttctttcttcttccttttgagacagggtcttactgtgtcacccaggctggagtgctgtggtcatggcccactgcagcctccacctcctgggctcaagttatcctcctacctcagctgggactacaggtgcaggccagcacgcctggctatttttttcttctttctgtctccttctttagtttagccttaatcagatgagccatgttttgactgctatttacttaagagacatcctgtttttcaaggatgtttgaagctagctggggctatgcctctgtgttgattgcactggtttacctctcagaaggtcatatgataccacacgttttccagttccttatctctcccagctacccctgtcaggttgggctgggggttggggggtgggtcaccattaaatataggtcagagagccagtaagtggcagggtctgacctaggactgtgtgaattctaagcccagctctttctactacacagaagccgtaggtaggggaggcttttcattaccaaatgggtgtgaattgccatttaatatcaccagccagaatggacttttcccacattttttatataatcacccacaaagcatgactgctcgtctccactggcctccagcccctccaccactgtttccctgcccctgtccaagcccagcccacccctctgggccaggccagggcctgccctccagtccagcttcccagctcctcaccctctggtccccttaaggccatggcccccatcaggcatccctctgtgctttgggacgtctctggcactaaataaatacatgtggagtggaaaaatgaatgaccactggacacccactctgacttcagtgtgtgggaaaccatgaaaacatgtcaaccttgctgtgttgagtgattcgttgaagggaacttgttccatcactgcctttgttcttttctctttatggaatctgccatagaaacagcctttcattagaaccactgtgtttctcagatttggttaaaaagcatctgtaggatgaactggcaaatcgggaggcttgaatttccaggctccatcgagatagttttcctgcggagttttgaaaattcacttgttttcagtgtcctcatgcctgcatctgagaaacagagacactagtgtgtggcaccgaccaccacaaaggggcctggtggtgagtgctgggctgggattagcaaattgctccgaatgtctcaggcacaaagtggtacttaaatagccattccaggattaggataactgttctgagcccttctctcgactccattagtttgcaacgtggccactgggggcttgtccctagcctttgaataaatgggatggcttcagagccagcagtggctggggcagcctgaaggtgttgttgaaagatctttgctttacttgtttgcatctaattttgtttatttctttaccaataaagatgctttctcctcaggggcattatgactgtgacctgggtggagcctgtctacagggtccccaaggttctctcagggctcaggggcaacacccagggctgcctgtagacgcccctccagccctgactcctacagggagcccccctctgagatgttcctaattcctagcccctggcaagacgcgagctcctcctcttctttcagagtctgtggtggctgctctgaaaagcatttaagagcctggaaggggagatgggctgtgcctcgaccacaaaccgcgccaaaaggaacctgctacaagatacaatgctttggaaactcgggaggaggagagaaaactgcatcggagggaatcaagggacgatctgcagggaggtgcctttaagttggctgtaaggggcactccagagtacagggagaagagacgcgggagggttcccaggcggagagtaccgctgatgacaacgctgcccgacagtgcggaaagcatgaggtcagctcggaccctcggctaccaagtggacccagaagggccgagcaaggctccgccagggtgtttaaagggtctggaaagcaccgaggagcaatggacggctctgagcgggaggacccttgcagtgagtgatctggaaaggaaggaagcctggagaccgcaagatcaattcggcaactcctgcgggaaggcccaggcccggaagtgatggagaccctcagggatgcgcagcgagcaggggcagcagtggttgggactggagtgaccacacccacaagaggggaaggtcggaccccagccaggcctcatctaagaaccatgcaggcaggagcgcatttcatccccatagttatcccgtgaggtcactacaggctacagataaggacactgaggcacagagagattgatttactcacctctccgtagctagacagctgcggactagggcaggaagccaggcaagctggccctagactcagagtccttaatcacaaactcattctgcttcatgtgtttttattatctaattaattgcttttagagacagggtcttgctctgtcacccaggctggagtggagtggtgtgttcatagctcactgtaaccttgaactcctgggctgaagccatcctcctgcctcagccttccgagtagccaggaccatagtcatgcaccacacccctggctaattttttaaaaattttttgtagagaagaggtcttgatgtgttgcccaggctggtcttgaactcctggactcaagtgatcctcctgcctcagcctgccaaagtgctgggattacaggagtgagccatcatgcccagtctcattctgctttcatctgaggggcagaaacaggagactcaagaggagaagccggggctcgagggctggcaaagcccagcgtcgctcttccaggtcctgtgcagcatttcagatggaacccttggaagcccactgaccacatgtgtgacctggggaaggcccatcttttggaaactttgtatcacctgctttgcccattccttcaagaaacgctgatttgttgaaggaacataatttgttccactatgtacagggctttcttctgaacttagaaaaccaaaaacaaaaccacctcaaaaactgtgcatgcatcaagattcaaagcccagatgcattgcaggatgtttgtttaatttgcaaaaccttcaccatgaggtttctttcagtaattagctcccaagtgcatatgaaaaatattatagataaaaacgtttgtggaaggcaaaaaaaagctttaactgaatagatttagttatacatgcatgataaaaagtgtccaaaatgtttctagttttctccttgcctttcatatttgtcagtgaatttaatgacaaacatcaattacctgaaaaatgtccttgcggtaggtggtagcattgaattgtattacagatcttattgaaggggtgaatacttaatatactaacgttcacatttacaaagccagaaaattagggaattgattaattctatcccaaaaggatgctttgctttaagaaggaattcactaaatactgagagctattgcattaaagttctttgttttgatggtgttagttcctgggcaccaggaggctaggagtggagaatggggtagagagagtgggggtgagagagtggggtagagaaatatagtgaagtgttcaaagctcggtcagagtgaaaataaccatcctttccctaagtgtgttatgtgggggaaataaagagttttagagtcaaatgcgattatggaatcttggcttaaacactgttaatcagtttctccaagaatgctcacagctttttttttttttttgagatagggtcttgcgatgccaccaagtctgcctaggctggagtgcagtgatgcaatcatagcccactgcagccgcgacctcctgggctcaagtgattctcctgtagctgggactataggtgcatgccaccatgcacagctcattaaaaacaatatttttagagatggagtcttgctatgttacccagtctggtggcaaactcctggcctcaaatgatcctcccactttggcctcccaaagtgctggaattacaggtgtgagccaccatacctggccctgctcagggctgtaatatgcttccttggtttgtgactctgtaaggacaaggtttgcattgtccacatttacttgcccagagcaccctttggattggtgtgggtgacattgcacagggctggtgttcctgggaacacattttgggaagtgcagtgtcagtctccattaagaggatggcgttcagattttcctttgttggagagaccttgatcattggatggacataggcaggggttcaatgaggaaaagggtctttctgcatgcctgggagaaactttggaggaacagaggaaaagagaatactgaaaaggctgaaaaaaagtcccgaattgtcaccaggttgctaccagcaagagtagagattcactccttggtgctccagggaaggacccaggaaagggtggggtagaagtcacaggaaagcagatttcaacttgagatgagaaagaactttccaaaaattagaattctccaaagagggaagtatttgatcagagtcttgtggataatttgggaggagggacagttgcatggaccgggagtaggacttgggagactttcgaaacgatctccttcaatgactggattaccagttagacaactctcagaggaaataggacttggttcacagaaaccccatgcgctgcattcacttaattaggtgcactactactttgctaagaactgacttatccaaatgtcgtctaatttcttcctcctcctgggcctgcggagctttgatagtttgcttggctggtttaacagctctctgtggaaatgagaaaatcattcaatcagatgaaatggatttgggatgagcaaaggagctttttttcagtgtggatattttagaaacgcctataccatttagattacagtagttagaaatcttgggactttctgatcagccagcatctaatgatcaagttaatgaaatacttgaaatttgataagctgaacaggatggaattttttcatctaatttcggatccagatttacaccttgcttacttagtttcgcataggtgattagagaggctctaactccaaatgcataagatgaagtaaacattaatgtatgcaatgtgatatattttgattcaaataaaatgcttagaattcaattcagcgagaatctgagaccccctgagacagttctcaacaggcggccccatcctttctgggtgtcaggaattacctgggggcacggagggctctacaatgtttaggggaagacctgctggatgcagggctcactcagtccgtacgctgctccctctgggaaataagatcttattttggggaggaaactggggagtggaatggttcagtggcttgctgcttagtggcaaataggtaaaaggagacgcagagggtgacattaagggacctgcaggagagcagctttactctccctgtttgaaatacccacccaagaaatgccaggcaaagcctcccccaacacggtgggctcctttgcagcaaacctctgcgttttcttcttggccatgcattttggccttgtgagtttgcatgtttggtttgaaagctctctatggaaatattcagttatttttccatctggtggccccatggcagggggtgtggcagcaggaacccttgctaaagggccccgggcccaagtgagatggagctggtgtcaggcacataagaaatgtttcctctagatggagggctctgcacattgtcacaaacccctgttttgtgcctagcctttaaaaatcccagttatttaaatccctgggtttacttagctccattcccagtttggccaggggtgtttcttggcgctctgtccctgactgtgacatagacccttagctgtgaggcagcaggggagccgccagcagcagggacccccagccctcacgcagggtgctctccaccctctcctagtaccagcccctgggatggaccctgaagctgacctgtgcccccagccctcttggccttggagaccctctgcctccctcctggccctgggtcaccgccctgagtcgggggtctgttggttgctggtctctgtgccctcagctccgtcccttcccatgaagggcagggaggagccatctgtgcagactccagtggggtgactgtggaatggtccgtcccaggccacaggggatgtgctctctggtgccacctctgccatgcctcctgctcttgctgggatggggactgaggcatgcttattcctctgcagaagacaacagcagtgtgtgtagatggctgcagaagggagggcagggtggtgaaaatacagtgagagggcctgggaaggtggtccctgggtgtggtacccacacagcaggcaccgtgcacagctgtgctggggcgagaacagattctcgtgaattctgcctaaaaggcgtctctcggaattgcctggcatggtagcccttccagttggggaatggctgctcagcagggagtcctggctgttgggcttgtgtgtggtccagagcttgccacgttttagagaaactgcagagggccaggagattgaggtggctggagaggctttggggtgcatgggccacagatggaacccactccacatcaccagcaagacctcctgttggctttcagctcttctctccagccttccaaatgtagtccccagtgaaagcagaaagtggtgactgttttccagagagggagactttccacaaatgtagaagaaccaggcagagacgtttctctttagcacttctggttgaggattttacaagttttctagtgagatgagattagaaattaaatgccagaaccactcttgatttctttttgtagtatattctctccccacccccagctgcatcctccttgtcatcctctcccccaaccctgtccccagccccagaaactaaccccctgggacccactcttggtttctttgtctgaagttgccttgatatgtgcacacacacatctatgcatgcatgcacagatacatacacacacacgagaacatatatacacaaatacaaactcatacatgcacacactcgtgcacatgcatacacatgcacgcatgcacacacagacacacgtgcacacacaggcatgcacacatgtgtacacatgttccctccgggtggcccatggaacacatgttcccttggcggccagcgctgccgaggcctcagactccaggaacaccctgaccctcagtgtctgagacacattggcccatttaggaaggaagaatctactgagggagaagcgtcccctcccctctgcacccgctgggtgggcagaggaggacgtctcaccccccagagaagaggagaataagctgaaggctctctggtgagtcactcaggttaactcaacaaactcctatgggcatttgaaaaatgttaatgctattcatgaattcaactggagtctaagaggaaataatggaaagttattggtcaaaaatcaagaagaggctgggtgcagtgtcttgtgccagtaatcctagctcgttgggtggctgaggtggtcggattgcttgaacccagactgggcaacatagcaagaccccatctctaaaaaaaattctaaaagaagtgaacccaggccaactgtctggtctgattggccagttgcatcccaggccagttcctagggaggccctgggaggactatgtcagctgtcactgacttcagcatccttccattggcctcagcacagggtaggcacttggcaaatgcaaaatactaattagagttagtggcctgaacaaggggctaccgtgctctgtagcaaaagctgtcggtggagaaccaagaacctccctaggctctgtctcatggctttcccagccagatcccatgtctctcttaaccattacttcctcagaatttctgagcttcttgttgctgcacaggcgtctttgaggcacaaaagcagaatgcttgcggtggccgacttggctccggttgctgagttcaaatcctaactccgccacttctctgctatgtgaccttgggcaagttttttaacctctctgtgccctgttttccacttgtaaaataaggataagtagaacacctgacttataaagttgctgtgagggttaagtgggtgaacacttgtaaaatgcttagagcagtgcccagcacctcctaaaatgctattgattcctgtcttttctttttttcttttgttcctccaccagtgcctctaactgcttgtcccatgggcatcaaactagaggctgagcacagtggctcatgcctgtaatcccagcagtttgggagcccaaggcaagaagatcacttgaggccaggagtttgagaccatcctaggcaacatagtgagatcctcatttcaataaaaaaaaaatgaaaaacattagctaggtgtggtggtgctcacctgtagtcccagctgcttgggaggctgaggtggaaggccctcttgagcccaggagttcgaggctgcagtgagctatgattgtgccactggactccagcctgggcaacagagtgagagaaagggaaaaaaaagttgtctagcatctgtaggtgtagagaagggcattccagaccaagcaaggggcatgtctcagggataggagagggatgggttggggcactagagtggtctcccactgcatggagcttacctgtcacagcctgggcatgtccaggtgctgctgccttatccctgcctgcatccagctccccaagtgtcacctcctcataaaggcctccgggactgaacaccatcgggtactgcaccccacagccctctccatccccactccacgtttgattttcctcttagcactcaccacttccctgtgggataaatagatcttactgctcctctatctctctctcctccctcccataggaatgtcagctctatgagcgcgggattcctgcctgtgtgttcagtgtcggatcctaaacaaggcctgacccctccacaggcacacacataatttttaaatgactgaataaatctaaaaatcatcactttattttcctctttgtataaaatctttgtgagggatggaaactccctccaacctcacaacgggagacatttaatgctgtaaaggctatacgatcgttagcaacgaatcattcctttacataacattcacacagcttcctacaatagacgtatttatgttgttgtctaacatacatgttttaattttcaagcgtttggttctggatccacacgttctctccaggaggtcaggaagcctgtgttctctgattatcttttataatcaagaagattctggaacacagcggcctttgaaaaagcattggtggtattgaaatggatccccacaacttcctaaaacctggcagtctttgaagattctgttcaattctcactgctccatcaaagatgcccccagtgctgtagccctctctgatctcagccactcccttgaactcctggtggttcttgttgcaacctctcgtttggtatttaattgcacactgtcttggggcatctcttgagctattatcttactgagtatttgacccttttattgtcctatttttcatacagctctatctttcacctctgttagtttgcagtcttcccaagagtaggaaccaaacagcctttactttttttgtgtctaccactgggtgctgagattgtacaatgcaattcaacagttcacatttgagtgaaagaataaatgaatgaggaaaaagcctatctatctagtcccaccgaatttttgcattgagactttatctctgtgaccctcacccgaaaagcacttgaggcagtagaggcgggtgtggatattggtaatgattgtccttaggaaatgttgattggcatcttggtatcttatttcagaaatcctggaaatgtctctctccgaaggctaaaactcagtcattccagaaatgatgcgctggctgtttttgtttgatactagattcactgtgcatttttcattctttctctaatgcttgacatccctttattcaggagttcaaggtcacgagtgctgagacaggtcactttgaaaaggagattatgaaagtggacttcagcactgatgttagagtagaaatgaggtcttcacttcacgaattcatggaactgcagagctggaaagaaagttgccaacacaaccataacattgtttgtttgtttgtttgtttgtttttatttattgttgttttgttttgtttttttgagacggagtcttgctgtgttgcccagggcccaggctggagtgcagtgccgtgatctcagctcactacagcctctgcctcctgggttccagtgattttcttgcctcagcctcctgggtaggtgggattataggtgcacgccaccacgcctggctaatttttgtatttttagtagagatggggtttcaccatgttggccaggctggtctcgaactcctgacctcaggtgatccacctgcctcagcctcccaaagtgctgggattacaggtgtgagccactgcacccagccatatttctttaaaaagacatgaagccaaggctttaagagggggccccctagacacccttcaatattgtgcagataagaaatacccagattagagacataccttaggattcccctgggatgggcagagttttctgcagataagcaacgtagaaagaaatgcagctgagggttgacagtttagagcttatttcctcaccttttaaatttaaatagttacaaaaagggtgatataaatactgtatgaaaagatatctgaaagagcagccagccagaattcataagaggattaaacagaaagaaaatggttcccttcaattattaaaataatacgatgagccctgtgtgaagtattatgtgtgacacctgctcttgtttccttggtagtaaagagaaaacaggactaggaagtcgagggctgacgccaaggtgttttcgagtggtagctgctaagcaccccgttgaaaggagcttaagtgcatcttggaggaaggatcctgtcttcctgttgttaagttgtacaaatggaaaaattaaagaggcataggtaggccagttagtagtttaattgggtttaattgcaatgttttggctctgggaagagagaggaaacctctgcagtcagcatttagccagtggaagccaccccttatcagcagggccccaatgaaggcgaagaagtgggtttcacagcagagggtcccctgggcttggtctacctcattatcctttcttggagtctaggatcattgtgggccagccgggaagacgtagcaccagctccctggagcttctttctcttggttcagaagtgtgcaatggaggttacatgacgatgttactgttgtaattctagagaactcgattggagtggactgggattattgattcaaggcctccccatttctccatggctcttggaaaggacagatccccgctcattaaaccctggagggcctagttcatggaaacagatacctcacatttctgcattgaatgtgatagtgattggtggctggcattttttctgaatagagagaatggccacattattaaagatgccccggttgcacctaaatttccaagactgagcaactcttactggagaatattgaatttcagttttcccctctaccctaaaaataccttaggttgcagaatggtgcaaagcccagggccagcccctttactgtgtttcatgcaccaccccaggcatcaggcatcatgttactcctggaggactttggacaaatgacttaatgtttttgtgccttagctgcttctgtcaaatgggaataataatagctgttaactcgtagggtggttttgagggttaaatgtgttaacatctaacatgctttgaacaatacctggctcacacattgtagctattattattgttattattagaaataaggtctcactcttttgcccaggctagagtgccatggcaggatcatagctcactgcagccttgaacttctggcctcaagcgattctcccacctcagcctcccgggtagctgggactacaggtgcgcaccaccatgtatggctaattttaattttttgtgtgtatggagaaacagagatcttgctatgttgcccaggctggtctcaaattcctggcctcaagtgatattcttgcctcaacctcccaaagtgctgggattacaggcataagccaccatgccctgctaactgtagctttattattattatcttcaaatcagttcccccttcctgctctcacttctgtatctcattgtctctgcggtgaatcatcatgggctagagggtgtggacggggccttccaggcctagttcccaatggatggttcaaggctaccttctccatgtaagggaagccttgctccagaggctggacaaactccaggggcacagaccccaaatttcagggtcacaagcccctctggaatcttgggcaggtctctctggctggcaatgggccacccatcctggctctgtcccttggggcaaattgttcaaataaaggaggagtctcagggtaccccctggtcggccccgcctgctccagatggcagctcatatcaggcaaagttgcatttctaaggaagggtgggaatctttcttcattgctgaggaagagcgtgccatgcagggctgtccaacgcctgggcatccttcagaaactctggagccatggggttcactgccagtacttaagcctgtttggcaacttgaaaaaaaaaagaagagtccctattttccctattagcaccttcccaatgattttgattttgcattttctccagtatgtgctcctcctcctcgcataccagcaggctgcagaggaaggtttccctaatgtttggaaacactggaggtagtttagtaaatgggcccattctggcagtgccgctcatccacattttccaaaatgtgtgtaattccactctagtctcggctccccagtccacaatatgttctgaagtgtcaattctaaatgcagcccattccttgcgcagtggggaaatgtggcatgctctgcggcgtgggccagggtgcttggtgatgcgggtgcacttggaattctatttaggcacccacaagacaccccaatatcttcccaccctcagcagaaagatgtgaactattgaagagctgtctgcttcgctgccttgggactgaggaaacaattgctctcttgggcttggactggcaatttaggactaatggagattgtggggaaaggatgggcagggcaggttggggtgtggaggcttttttctgcagcacggccctggccctgggatgggaagcacctgaaacttccctgcccagaagaggacagtggtccccaggctgtttctacaggggctataatagcacgtggggacattgacaatttagtcaactagccccgaacatctgattcatttagaaatctgagttgactggattccaatccagctaacgtttatggagcctctgttgtgtggccagcattgtgcttaaactcatgtctgttgttttcagcatgactggtgggagctcctacctggttgacatggggcacaaaactgcatcatgttctgctcaggaaacatgtattgagtggtgcttctgtgctaggcttggggattctgagttgagcggagatgagaagagacctcgtctcctacttccctgcccagggggtcctgggtggtcccagaactattcagcagaagcatttgcttaatctcaaggcattttgttctttaggaattctggttctatttcttatccaaaaagagacacagatactgaagctgaaatttgttattgtacataaaacattctgttcgcttcatctggttatttgatgggaaacagtggcgtttggatgcctgtttatttctcactattgggaaaataatcctgtcccccgcaggcttgccacttgggtccactccccatccttctccagcaccgggactgggtttctggggagctgggcaccgtggccgtggggaacttagactttccttggatcttcctgttgtagattctcggctgtgggctctgcagtgcatgcaggagggagcgggggttccagaacatgtgatttgaaagtaggaagaagggggagatgccggatatatcaaaagcacatggagttttcacactgggggtagagggatttaaaaaaatctcaattctgaaaaatagacccggtgtgcaaaaccctttccaactcacgagctcgttaggagtcgaattccaccaaagccatgccaaagagtgggcctgtaacccaagagatccctttggaaggacagtcaatatctgatcccaggaataaggggaacccctgtgtgtgtgaagagaaaatcctaggttcagctgtgcctccccccttccctccctcctccagggatctcgggtttaatgttggccctttttggaatccacacagcacctttctcatgggtttaaaaatagactccagggctgccaaccctcttaaaaagaacatgatggagattggtgccaactctgtggggcctgatccgggctctgatcacctccctaaatagacccccgcacttgccatcccttactccagccaggccgggtgcccaggacaccttaattgaccactgggcactccctacacaaagttaaatagaaaaacaaccaagactccattcctctctccctttcttctgtcactgccattaaggttaagaaggaatgaccaggtttagggggggtcaggctggatttctgattgaattcaatgtgacatttgtgtggaacattctgtaaagttccttcctagttaataacatttccccaacagcgatgctcctggtggctgacacactccccagggtggtcgctggctgggtctgagtggcgataaaccagcctgcctttctcggtaaagggtggagttcctggtacccacccttatcagtggtgcccagagtctctaggagcaggggcggctccttgggtgggtgaggatggaacagatggaaggagggtcaggaggagagcccaacgggtcagctggccacagccagcagcaggacactgcaagggcagctgcggacagggagcgtgggggcacaactgagtccacacattgtttctttgctgcagagaatatgggcattgaaaagggtgcattgtaagcccaagaggtctgggtgcagggtagagctttgagatttcttgggatcctgatcttgaccatgggtgtttgaccctgggtaagcagtgatgaggccttgattttccagtgttgaagcaagatcagtgacaacccacacctctgggggagacattaacctttgacaaaagctttagtcgagaagaaatggaggggaggaggaaaaaagagcatcagctgtcattgatagagcacttaccaaatgtgccagaagtggtggtcagcattttacattattctcccaatattggagagatgggtgaagctattttcactttactgatgaagaaatcaatgctcagaaaagtcatttcctttatcaaaagctgcacagctcaattgtgggagacctactgatttagagcctcttaagaggctgtccagaaagcaaatagtgttgttgctattgagttctgggtttgagttgattgcataagagggttaagcgcgacggtcattgccacagggcctgagctgccaggatgcccttctctcgaatcctggggctgccctgatctcagctctgatgtccctgtagagaggagccacttcatgtctctgactggccaccatttgaagcagcccggacctgttctcccaaatcatcctggggaggcagagtcgcctgagaatcccactcgcatgggattctttgctgcaggcttgtgttcttccagctcgtgaaatccctgcaggaattgacagcagcagcagcccatcaagtgtcccagagtccctgtctatactgagaacagcccactgcatcaagccaggagtgagctgggggtttaagtgctgcatagtctatttcttccctttcttctctcccacatcatccctgcttggcatagctgcatgtggcccagaggacagaaccccacaggcgaggcctccagcttttcattatgcttgtctgcagagagacctgcaaggagacagtaggtaaaatatttagcaagacgggaaaagcctgaagactccatgaagctacaggctagaacagtggcctgtgtctgccgagagtctttagccttttcttcagcccatcaattcctttctggtggtttgttttgatctcactagcaagttcttagcacactaaatgcctacattaaaacgtgcagccttgaagtatgaacaaaatgcagatggagaagcaggatgattatttgtggtctaagggtgtggttgtgatggaaggttgaggggacagtcagttatggggaaaagaacaatagtttagctttctgaatccctagggcccaaagagacccttccaagtcgtacagcttacccagtggtctatatgccagatcaaatgttgaggttttttttttctgccatcctgaaggatctcctgcaaagattaaaccctttctgaataaagagttctattaagtcacgtatctcttatagctggaaagttctttctgtggaatctaaatcttttccatagcaactgaaccccaagacttacagtttctttatgactcatggaagtgttggggacatcattcttctaacaccagtcagtaatcactgtgtttagcactgcccggcactgtgccagtcacatagaggagtaggtggggaaagcaagggagagggactgggaatttggaacatgagaaccaagctgtctctgcctgggagacatttagaattcagtcctggtggcaggccaccacacctgggactgggcaccatataattagctccaatgtggcattccaggctgcagtgctggaatttatgtttcaagggctctctcccttagctttatcatctcagctcctttagcctcaggcctcactgagcaacatgtttgtagttgtgttctttctcctcctcttgggccttgcctgactcatcgcctgcctaagtttttcaaagcctcaaccctaaggaggtcatgactaatgtcaagaattcttggcagttctgagaactaaagtcctctgataatacttcagcatctttcccattacactcagagtgctgtgggttgtattcagcttctggtccactatgactatcacatcttttaatttgtgattgtatataacccacagcgttgtataatatgaagaaagatacagcttaagaattataagaaccgagtaccaaaatgcgactgggaatgttttgctactgagctttgaatattttacttgtaagatctgtttatctcacctttaagacagatattctgtatagatagaactctcaaaactcaataagaaaacaaacattccaacttaaaaatggacaaaagatttgaacagatgtatcaccaaagaagatatataagctgggcgcagtggctcacgcccgtaatcccaacaacatgggaggccgaggcgggcagagcacctgaggtcaggagttcaagaccagcctgaccaacatggagaaatcccatctctactaaaaaaatacaaaattagctgggcatgttggcgcatgcctgtaatcccagctactcaggagtctgaggcaggagaatcgcttgaacctgggaggcgggggttgcagtgagccaagatcatgccattgcactccagcctgggcaacaagagctaaactcttcctcaaaaaaaaaaaaaaaaaaagaaaaaaaaaaaaaagaagatatatagatggcagataagcacctgaaaaaggtgtttaatattatcagttattggggaaatgcaacagaccccttctctacaaaaaattttttttaattagccatgtggtgcatctattaggatgtctgaattaagacagatcataccaagtcttgacaaggatgtggactggccggcaggaggcagggaataccaagaggcatgaggaaacttttggaggtgattatgcccattatcttatgtggccatggtttcagggatatacatatgccaaaacttagcaaattgtacattttaaatgtgcaactcgtagtgtgtcaattaatcctcaaatagttgctaaaaaatagtatctctttcagttcattgtgcaagtcaattgcattcgtgtttttaaaagtattatatatattatttactcatctgagcggggaattttctctctctctctctaaatattaatgttggaacagtgcattagaatcccttgagatattccactgggctgtgatcaggggtgttccagtaaccatcatttattaattggagttctctgtgtagaggattctagcaaatctggaaggtggttttcagaggtacaaggcgagagacctggagggtgagctgggctttagcagcatgtgcctggggagggaaggggctgtgtgacttacatccagacaggctgctgccttcgagagggtgcccatcctcaagttcagccccagtgctgtggaggatcttatgcctggagaattctcacattgtcatcttcaaataccagttttttaacccccatggggaggagttgtattattacatttcagatccctctttttggcaacaccctggccttttctcttgatctttgattatcccacttccttgggatgccccgattgctgcatagctttgaagcgtacctggctttgtaacacactctcacagtattttcttcttttttaatttttatttttttagagacagggtctcactcttgtcacctgggctggagcgcagtgttgcaatcatagctcactgcagcctccaactcctgggctcaggtgatcctcctgtcacagcctcctgagtagccaggactacaggcatgtgccaccttgcctggctaattaattttttttttttttttgtggagacagggggtctcactatgttgcccaagctggtcttgaactcctggcctcaagcaatccccccgcctcagcctcccaaaatgctgggattatgatccttcaagatcatcccccacattatctcttcctggcgctgagtacactattgttaggaatcttgctggtgcggccagtggcagggctttggatcaatttggcttagaaccagttggacccaccatttactagtggtgaccttggtctccacccattacctccctgggctcagtttcttcatttatccaactgtagtagtgttgcctaccttatgggtggctgtgaggattaaatgagataatgcagtatgtccatcagctaataggcgctcagcgtgctagttcctcaccaacgcgcagctgtactgtacaatgtcaggggacagcgggagaggaaaagagcatttggtattgtgtcttgactgtgacttgaagccagcaagaagccggcttatgatacaaaacacctatgatctgaacaagccatattgccaggggcccagttacctgacactgcttttacttacggttccctcatccctctgaattgagcctactcttgatgatgtcacccctagtcttctccaaaatcccaaacatgggttttgacatctgcccctgaaatgactgcatgaaagggtgatagtggtcccaggacagaacactggttgcttactgcacggacacagcctcgggtgacgctagttaaccgccagcgtcagagcagtgcgggaggcagcggggagtgacagctctgccctcctgcaacccagctgcgtctggcggctctcaggcagaatctggaataggctgattaactggtatctcacgacacgatggaagagctcaaaacatgcaaatcggttatggggcataaatagagtttgctgagctcaccccggccacgtctcggcaagctccggggcccattcaccagggcattcggggaggcgggaggcagggagggaggccatgcagcttggagctcctcacctccactggacgtgtgtgcctcccctccgcaggggcaggacgcccgccccgagcccgccggccggcacctgcagctggggctgcacccccgcccgcgcccccgcgcgcacccccttcgcagggcttggcagcaggtgcctgctctccggagagcgcttcgcattaactttcccatctgacataatcatggagagaaaatgaagagatcccattagcggcaggctggcgggcgggagagcgcagggccagggccgggccggggcgagtggagggcgcctgtatttttagccagatgccgcgtaacttgctggcgctccccgcgccgcccagcagataaccgggagggggagcgggagccgggctcggatttcagcgcgggcgccggacgatggcagcgcgacagggcaggtccgggccagaccctgcggtgagtgcacgagctgtcgcggttgcccggccggggccggggcgcggggatcggggccggggccggggccggggctctgcgtccgtcctgcgggttgtggctccgcgcccggctgcccggcgccaactttccccggcgggtgcgggtgcgcgcgctggggctgcccttctgctgccgaggcttctagcaggatccagaggaaaattcctctggcctgaaggctgcggccgcggaggggctggagccggggttgggaggcagcgggacttgtggccggcctggaagaggggcacgggcgggagcgtggagccgccgccggggtgccccgaggggggccgggccctggccgaggccaagtcccctcaccccaggggacagcctggccgggtagattcagcagggggtgggagatgcacggccttgggccgggcggggacctggcttgcggcacgtctggcccctaaaactcagaaacgtgaggcgcccggaggcccccaggtagcaggaaatgaatggggcagaggaaggcagacctgttgggcgccctggcaagcctggagctctctgccgctgtccccttcgattctcgcagccccctggcaagatccccattttagcaatggggaaatggaggtttggggccttagatgagcacagcatcaagtggtcgagcagtgcatctcagccaggtcttccccagtgacgtcccagcccaccctgcccagcctccagggtcgggtgcagacagcacagggaaccccaggggttttcccaatgtcccgagttcgggttgagagattaagagggagcccagcacttccgctcaggcgtcttgtttcctcagtgacacctttaacttattcattttatttttgccaatggtagtcagactggggagcctggagacagtttgtaaagctgtaacagcacacctttctggaaggcaaaaggaaagaaacataataaaacacacactcactagggcccagtgttcacctctgtttctccatcgtcaagggagtaaaggcagggctaccaggctatgctggctggggacagctgtctttcctcataccccagtgcggctctcagatcccccaagcacaagcagacagctccacatcagggctgctgcctgtcttctggctgggctgcaggtcccccaggaaaggacctgaaatctcttcctgagagctctgacagtggctgcgttaaagaagctgcattttgctccaacaagaccccttgggaaagtggcattgccttatgactgtttacagcaattgatattagctcagtttccattcgcctttctagataggaattttgtactaaaaatcttgaggtcagtcatgatttgtcctagggaaaacttaggccaccccaacccccagagaaggtgtgaggaggccctggggttctctcacctgggtctgcctgctggtgtttcccaatgtcccctgctcatgggtgacagcatgttgacattctgcagcgtgcttccggcccctccctctcaggatactggagccccctcgcaccccatctattgctatattagtatctgctcaggaagtgcaagtttaataatagtctgggtgtctcaggtaaccaggattcaccaccctttcagagcagtcctgatgagaacttaattcctaggaagaattctgttcccttccttctcttccattccctttctcctgacgtgggcacagcctccaaacccaggcagaaggctttctccagccagagctgaactggagaggacccttatgagcactagaaaatgattaggccagcacagtggcgcgtgcttgtaatcccagcattttgggaggtggaggtgggaagattgcttgaggccaggagttcaagaccagcctgggcaacatagggagactttatctctacaaaaaataaagaaattagccaggtgtggtggtgcacgcctgtagtttcagctattcgggggaagggggtgttgacgcaggaggatctcttgagcccaggactttgaggctgcagtgagctataactgcaccactgggggaccactctggaagaaagagggagactctgtcttgaaagaaagaaatggagaagagagagagagaaaaagaaagaaagagaaaaaaagagaaagaaaaagaaagaaagaaagaaaggaaaagaaaggaaaggaaggaagaaggaaagagagaaagagagagagagaaaaagagaaggaaggaaggagggaaggaggcaaagaaggaaggaaggaaagaaggaaggaaggaagggaaatgattgacccaggaagcggtatagcacaatagttaagaagtatgctacctagactcaaatcctggccatgctacatattagctatgtgactttggacaagttacttttctgtgacttggtcacttcatctataaaaaggagataacaaaacacgtgccttgtgagattattctgaggagggagtgaattaatttatgtggtgtgtttaaaacctagggagagctttgtgaaagtaaacttgttttgttttgaaaggaagttcagggacatcacattgattaggcagcagggatgcaggcacagcagaatgtctgctgtgtgcagatccccgaacacgcacacaggtagaattagattaaaacgaagctagagatgaggaggggaagagacaccagaagacagctttggtggggtgcacaacagaggtgccagcacctcactggtggccagggcttgtggacacggtggggtagttttctgtataggatgagcaggcctcctggcctcctgatctgggaatggatgagccttggagagggccagtcattctgctccggtttgtcatagcccagagatggtcaggtttgtattttgttgctgttgttttttgggtcagtatgtgctcaggtaaatgttttgaatggaacacattggattctttggacacacctcctgccctgttgcatttgctggatgtactgaggacaggtcattgaattggagcagttggactacacagatgggcagtaggggctcagcagaacacaatggtaaagatgagtctcatatcccaacaagggccatttgctctgtagctgaaatattgcctggcccctaggaggttctcaatgaatactcatggaatggatccacaggtgcatgcatgcacatgaccgctttataacacaattgcttgattattcagatcaagagagcaaggacctatattctgagtgattattctctctttgccctagcaggatattggtcctgaaataggaccccagtaaatacattgtggaattaaactgaatgatgtgtagttgctactgggagtggcatcattatctgcagttcacctcccagatgccctgaggatcctgcagagtcctgactactctatgcctggagaagaccaaaaaaaaaaaaaaaaaaaaaaaaaaaaaaaagaaaaaaagaaagaagaaagaaagaaaaagctttagcaattgcacttcactgctaactatctaggtgaccttagccggtcactttacttccctgggcctcaattttatcctcagtgacaagaagggctggaactagatggttcccttctagagacctgtcttggtctgaatagagtgctcagggacagagcctgagtgggacctcctagcatttttcctctgccatggattagctctttaacggccgaggcatataggcctgcccagccgccagcctgtcagggctgcctgaacaccctcaggcttgaaatggccaagaacgcccttggggtcaagggcagtggaaaggcatagacttcagtggggtacccctggattgaatcaccccaagtatttatctgcagaacttgggcaagttattaacctctcaaaacctcagtttcatcacctctaaaatggggataataattatacctacccacaggttgttataagaattaaaagatataatgctggtaatacatttgtcccaatggttggtattataattttagtattctattatggcaacaacagaaatggtttagctttcctcaatctagtccatatggagcttcccttaccctctatttatgtgcttgtctgtcataaattttttttttttttttgagacagagtctctctctgttgcccaggctggagtgcagtgccgcaatctcagctcactgcaaactgcctcccaggtccaagtgattcttctgcctcaccctcccaagtaactgggattacaggcatgcaccaccatgcccggctactttttctatttttaatagagatgtggtttcaccatgttgaccaggctggtctctaattcctggcctcaagtgatccatctgccttggcctcccaaagtgctgagattacaggaaccaccacgccctgccagtttgtcataaatattcttcttttcttcctggattcagtgctttgagcagtcagtgtcattagtggatattgagtctatttttatccacccattctcaggttttcagcctgaatcctattattgtgccataaacggtagttaattggtgggagaaatgtctctttaacattcttattcttggggaataatatagtgtttttcctaataactgaatctagacagactttctgaatcagtagcataagtaacatttatctgagagactaaaccttgactgggttttctctggaaacccagctcatgcctggagagccaacagcttgatcttcatttctgaaatatttcctgccccacagatgccttgctgaggaacctaggatgtgaatgccatgtgctttaggtcaagggaggcctcgccctagcagacacttaatgctttggaggattcaaaagagatagaagacttggtccctgccccaagaagcaaacagtttggctggggagacaagacttgcctgaattcaatagctagagaaagagatattttaagtgcattaaaaaaaaaacaagctcctgttttgtggttcctagatttaaagatggcaaatactgagtgtctaagcatagtgtcattcatgcaggaagtagccaccatcagggccttgaagggaagaaagattggaagtagcaaaccagagggagatggagcttcagggcccagggaggaggaaggtgcaggccaggaggtagacagagcatgagaatgtcacagaggacaagggaggtgagaaggggctcctgccgctgtggggacagcgagatgagtgtgcctcatgaacagacagccacagggcttggacttgaacttgagcttacatcatagggggcccatgtgggacctgaggttggggagggttggcaggaagtcaggatttggggaagaccagttaggcagggatggaggaggttggctgggtgaggcagggatggaggaggttggctgggaggcagagcgaggaagcagcatttctgcaggcctggggttgtgggtgggggctgggaggtggtgtggggcagcacctgagtgtggagggaggaccccctgtctggaaggctggagaaccctactgctgatgccctagggactccctgtttcagtggtgaagacgtgaagcgctgctttgtggaggaggatgagagttccatttggtcttcggctgtagatttggagtcttctgtgttcaagggtgttcaagggtggtcatcactagtgtgtgcatgagtttcccatggttgctgtaacaaatcgccacacacttagtggcttgacactacggaaatgtgttctctcgctgtctggaggctggagatctaaattaaggcctccacagggacacactccctccagggcttcagggccttcttctatgagcctccacctcccagaggttccttgcttccttgtgcatggctaaagtcactccagtctctggctctgtcttcacatagtttcacctctgtgtgtgtgtatacatgtgtgtgaacatgtgtgtgtgtgtgtgcacacaggtctctgtatgtgcatgtgtatgtgtgcatgtgtgtgtatctgtgcatgtgtgtgcgtgtgtgtatatgcatctcttggtgtgcatgtgtgtgcacacacgtctgtgtatgggtgtgtatgtgtagatttgtgtgcacacatctgtgtgtgtgtgtgaatctgtgtgtgtgcgcatgcatctgtgtgtgcatgtgtgcatacacatatatgtgcatgcatgtgtgtgtgtgtgtgtgtgcatgtgtgtcttctccttttctgtcttttctaaggacacttgtcattgaatttagggccagcctaggtaatctaggatgatctcgtctcaagatccatgacttaattacatctacaaagacttttttttcaaataaggtcaccttcacaggttccagggataagagtgtggacatatcttttggggggcaccattcagcccactgcagcatgttttttttaggagggcatgtagaggaaggagacaaagtgcctgggtggagaggaagccactgtgggtcttctgtgggaatggcgtcacacgcttctcccatgtgtggcttgtcatatgaccactctcaccctttcaactcagccttgtatgcaactatgtgccaaacactgtttatttcttttaagcatcatgaaaaggggacaagaaaggctttactctccccagcttacaaataaggaaatagaagccaacggtgtctaagtacctgagggcactcagctagacccagtggagtggctctgagtctaggccacggactccaatgcctgaggactgggctttaatcattacatttgtctttgtgagtgtattagtctgttctcacactgctaataaagatgtacccgagactgggtaatttataaaggaaagaggtttaatggactcacagtccaacgtggctggggaggccttacaatcatggcagaagatgaaggaagagcaaaggcatgtcttacatggcagcaggcaagagagtatgtgcaggggggtctcttctttttaaaactatcagatctcatgagacttattcactttcatgggaacagcatgggaaaaaccagcccccatgattcaagtacctcccaccagatccctcccagggcacgtgggaattatgggagctacaattcaagatgagatttgggtggtgacacagccaaaccatatcaattagtaaactttattttattgtcctcagctctcaccctctctggctgtcactcatctttaaaggaaacagatgttcctgggggcaaggtctgagatgcatggggtgggtgacgtagcagcagctaaggaacagaagagcttcactctcatttaagaaatctgttggggggcgcctggtgttaaagctgagaccgagctggctgcagagctgggaggttcggctcatgaatttctgagccacactacctgcatctgagtcctggctgtgcctcctccctgctgtgggatgctgcacaaggcacttctgctctctgtgcctcagcccactcatctgtaaaatgggactctgcaatcccacttacctcttgggtattccaaatgaggataaaatgcttatctgtgcgtgtgcatgtgtgtgaatatatattatagtcatccttcggtatctgtgggggattggttccagaaccccctgtagataccaaaatccacagatcctcaagttcctcatgtaaagtgatatagtgtttgcatataacctacccacatcgtcatatatactttaaatcatctctagattacttataatacctaatgtaagtgctttgtaaataattgttgtacagcattgcttttctgtattactgggtttttttgtttgtttgtttgtttgtttgtttgtttttgagacggagtcttgctttgtcaccaggctggagtggagtggtgcgatctcggctcactgcaacctccacctcccgggttcaagcgattctcctgcctcagcctcctgagtagctgggactacaggtgcacgtcaccaagcccagctaatttttgtatttttagtagagatggggtttcaccatggtggccaggattgtctctgtctcttgacctcgtgatccacctgctttggcctcccaaagtgctgggattacaggtttgagccaccacgcccagccttctgttagtattactttttattttagtattgttatttttaatttttttcctgcaaattttccatccacagttggttgaataaatgggcttgactgtatatgtaaagtgctaataatggctcttagcacatagtaagtgctatgtgctgtttacttgacagcacatagctgtttgtttacttaacaaaaacacagggctgggtatggtggcttatgcctgtaatcccagcactttcagaggccggggcaggaggattgcttgagcccaggagttcgagaccatcctggggaacatagtgagaccccatctctaaaaaggaaaaacagacaaatagaaacaaaaacacaaaacagctccaaagagcccacgcttggttcctttggtgcctgcattcatgattcttggggccagggacctctgtgatattgcaaactcttcagcaagactgtggagcccctgaaacctcagagcagggagacaccaggctgtgctgtgcgcttgccataggaatgggctccccctcaaaggctgattcttcctgagtccaagccaagaacgtttgcttataaaaataccaaaagggggccaggcacggtggctcatgcctgtaatcccaacactttgggaggccaaggtggaaggatcgcttgagctcaggagtttgagaccagcctgagcaacatagtgatgccctgtctctataaaaaaaaaaaaagtttaaaaaaatagttgggcttggtggtacacacctgtagtcccagctacttgggaggatctcttgagcccaggaattcaaggctgcagtgaactgcgcttgtgccactgcactccagcagcctgagtggcagagcaacactctctcttaacaaaacaaaacaaaaaacaaaaaaccaaaggaagggaggcctgggtgtgaaggcagtccaaccaggggctctcaggctcctgtgcacacctggtgtcactgtgggcaccagggtgccacatcagaggatgcaggggctgctgcgggggcctgggacttgaacggggtggagaagtcattaatacacccaggacactcaccgcctgttgtttttcctcacaggccgatgctgctaccagctttctgagagcagcaagatcaggtaacttggacaaagctttggatcacctgcggaatggggtagatattaacacctgtaaccaggtaagtgggatggaggcaggcctgttgtctctgaagagtagctcttgcctgatgccatttcctgagagctttgaaactgcctctattaaccttttctcagtggcctcaaaactcccccagggcttctgcctgtggaaggccctaaccttgctgtttccactcctgccgtggcccagggccccacagagaagggctgatgcctgaacagtgtgggcgaggcccgcacagatcccctgcggtctcctcgcttagaagttgcaattgattcccgctgttgtcttagaatatgtggcctttgaattggggcaggaggaagagcctttgaaagatgctgtgtcagtggggatgttcagtctcctttgtccaccagcagtctgtgtgggttctcggctagcctgagaagaaagtcgaggaacgaggccccgcttgtgttaggtgctgacaaaggcgagtgggctcgggttgaggatggtggggctggtgcagaggctggctctccagggctcctgagtgacacagccaagccttagcttcagaaggggctggcgaggaaacaaaatgtgtttgggttgggttggagggcagagactcgggcttggagccaaagatccaggaactaactaaatagagaggcaatgaccctccaggaagggaacaggtgtgtggcttgggcttgtggattggtgacaggttttgtttgtttgtagatatttgcctgccaattaagttgtttagttacacatgctaattgtttctaatttagaatacagttatccattgcgactttttaaaaaccatcttagccattaaaaatgtgtgtttaattgtggtcagatatacagcatagaatttcctgtcttaaccatttttcggcgtacagttcaatgggattaagtccattcatattatcctgtaatcatcatccatctccagaactcttttcatgttgcaaaactgaaactctgttctctttaaacactaacgccccatttccgactactccccagcccctggtggccacccttcaacttccagtctctacgaattttactactatagggacctcacagaaacggaatcctgctatatttgtacttttgagattggcttcttttatttagcatagtgtcttcatggttcctctgtactttagtggcttgggtgacttttccaagccagcagggccagattttctgaacgtaggttaggttttccatgggcgacatgcctctgtcctaccccctcatctactgtttccctatccatcctgcccctgtttaaaatgcaaaatactatccggtgtagtggctcatgcctgtaatgccagcactccaggaggctgaggtgggcgggtcacctgagctcagcagttcgagaccagcctggccatcgtggagaaaccccatctctattaaaagtacaaaaattagccgggcatggtggtgcatgcctgtaatcccagctacttgggaggctgagacaggagaattgcttgaacccaggaggcggaggttgcagtgagccgagatcatgccattgcactccagcctgggtgacagagcgagactccatctcagaaataaaataaaatagaccgggcgcggtggctcacacctgtaatcccagcactttaggaggccgaggcaggcagatcacgaggtcagaagttcgagactagcctggccaatatggtgaagccctgtctctactaaaaatactaaaattagccgggcatggtggtgcgtgcctatagtcccagctatttgggaagctgaggcagaagaatcgctagaacccaggaggcagaggttgcagtgagccgagatcgtcgtgccactacactccagcctgggcaacagagtgaaactctgtcttaaataaataaataaaataaataaataaataaataaaatgcaaaatactacctgcctccattcctagggctaagaccccatttggattcagttggtcttgcagtggcagaaattcacagctaaaagatcagaaagaatggagcagtatggtatgtgatgggaaacagaagtaggtgtgtgataagaagcaaagaccctggcagtgcacttcagagggaaagtgaggtatgtggacctgactggaatttgcaaactggatgaaggaccaggccccccgccccttttctcatccctccacccagaaatgccaacatccacatatccacagcccagaggacattgtggtggttctaacaaagcatctgccaggctggcctttgcatagcaggttgaaactcagcccattttttgatgccaagaggtggatgcagcaaagcctggaggcagggtgagagtcttggtgtgagagttgttcagaagacagggtctgggaccttcttagcactgcacctccagaagcagctgcacaggctgcagctgtgttgccccagccccccataggcagggtgggttgctcgctctctccacctgggatgcattcttgggcttgtagagatgcacacctggaggctttctttgttcttactgtggctggagaattgcagatgtgtttctccgcagtgcagttctcagcggaggtgaatcacaccttcagaggccttccaagggttaagattctagctctcaaaggaatccattcagctgaaatggggacaactgaacgtgtgttagacttgagccagggctcattttctgtgtgaaattggaagattttgatgccaccagggaatagctgtgtcctgattggtctcccgttggagaggccttgggtgtaactgccttgtcactctgccttctctcctcagagcacctcttcggttcgttttgggctcagagagcagcaagcaccgaggtattatttgcactttattgacaccatttccgattggctcagcgccagtgacaagtggctgtcagccctgcttcaggctgaggggaggctcctgcctcagactcaagactgcagtcctggctaagcctggcctctctcttaaagaggacactgccacaagttatgaaatgagcgtcagaagggaacgaaagacaggacacaccaagtgcaaagccccttgctgctggttaattcccacagctgccagatgtggccctgttggtccctgttttatggtctgtggctgagcagaacaggtagctgcaggtggctgcgcctggaaaggagctggtcagggttccctgaacctcattctggttgcacagggcagtttggttttgctgttgcagggagagtcctggtggtgggggagggactgcagtggctgaacccatgcctgcatgaaacccacgaatgcacccagcgggacgatcctgcatctgcgtaatgtgcacagggccagcctcttaatgctactagagctttctgctctttaaaacacgcataaaagcaagctcttgtcccggggtcatggcaagagaatttgctttcggcttgaatcttctgagctgatggactgtggtggcagtaacagggcaaatacttatccttacataagtaacacactttcaaatagtatgtttttgtggaaagaatgcgtactgtttgccataataggaagtaattactctaagtagcgtggaaagaggaactcttggcttatataagagatgtctgaatattcagggcagttccttgttgtatagactgtgtctactaatgttctatcatcattatcattaccatgtctacagaaaagaagaaatttatatgtaagaacacacacatgtgtgcatacaggaacccccttatgtgaatgccaattttaaaatttattgtttgcactttagatgcctgtgtctaatgtacttcctgtgcatctccacgtgtatatggagagctgggctgaagggatagaataatttcattttaaagtcacgttccttatccgttctgaactgtagtctattggcagtgagagctattaatcaaataatgacacaaacagatatgcataccaaaaactatgttaggaaccatgaatggaaggcagagagtatatgagaggactgccctagagtcagaggtcagagaaggctaccatgaggaagagacagctgaggtgagggaggagcagaggcaaataaggtgaagcaagggagaacatgccggtcttagagagcagcctgtgcaaagccccagaggcagagaaaggagcagagggttgaaggaaggccagagtgggtgcagtgcagacagcacgagaagccaggcaaggtggagctgggattgtgctggagcttacaggtaggggcgagagtcacaacactcagcgacagagacagggacgtaaagatgggaacaggagacactgggaactatgggtgtgggagggcgggaggagggcatgggtggaaaaactaactattgggtaccgtgttcactacctgggtgacaggatcatatgccctccaaacctcagtgtcatgcagtacattcatgtaacaaacctgcacaggtacccccgaatctaaactagaagttgaaattataaacaactgggacagcgtgcccctgggccagagctgtgtgtgtgcatgcatgtgtgtgctaaccagctgcaccagatgttaaccccgtagttgctgactgaggggaaggggtctgggggagggggacagtggccagagcagcagggatggggtacttaagagcctgcagcaggccgggcgcgatagctcatacctgtaatctcagcactttgggaggccgaggtgggcagatcacctgaggtcaagtgttcgagaccagcctggcctacatgatggaactatttagtctccactaaaataaaaaattagccgggcatgatggcaggcacctgtaattccagctacttgggaagctgagatgcaagagaatctcttgaacccaagaggcagaggttgtggtgagccgagatcgagccactgcactccagcttgggcaacagagcaagactctgtctcaaaaaaaaaaaaaaaaaaaagagcctgcggcagtggccactgacctggaggagtggagcgtttcagcatttaacacctgcacagctgtactgctgtgtcctggttgaatatcccccccttgtagaagccacatgaaggattccagtctttctcccgagcatagaggaaagtgaaccacagattcaagcacaggagtgacgtgatcagggttgtgctttaaagggtctcactggctaccgcatggaaaacaggcggagggcccagcggtgcagtgggggggggcctgtgtgtgcccagcagcgcaggagggacgtgtgggcatcttggatgagggtcatggctgtggagatggagcaaagccaagcaggcttgggtgatggattggatggggcactgaggggaagtagactcaagaaagactttccgagggctggcttccacggcaggtgggtggtggcaccatccactaaatgagggatgctgggagcagaccggtgtgtggaaacacgggggaggagtcaagagcagagctgttccagatcctggtaaggaggctctgaggaatccaagcagaaatatatagtaagcagttggatatttgagcctggaactcagataagaggtccagcccaaagatagatatttggaagtcattcagccttcgaggaagtcgagtgctgacgggggctgatgagagcagggaggaaaggcatgttgaatatactcccactcgcctgtgtggggtcattccacagcactcattaaacacccactctgtgccaggcctattctaggcactgaacaagacagacaaaatagtctgcgcgctcgtggcctgtgcatgctggtgaaggaaatagacaatagctaagaggatgggcacatacatgaagtcagctgatgggagacactggggaggaggaaggtcaaggtgactatttcggtggggtggttgggagggctctctagggagacgactttcaagaggtctggaagaagtaagggagagcgccatgtggtttctggggaacagtattcttgggagagcaggaaacacgtgcaaaggccctggggcaggagtaagagtggtttgcttgggggaacagtgaggctggagttgagtgatggaagggaaggtggtaggcaggggggttggaggagtgcctggggtcagatcaaagagggcttgcattggtgagggcttagattttgccataagggtgaagtcatttgaaggtgttacacaagagatgcttatgctgatggaggtttctaaacaattgccctcgctgctgtgtggaggatagactcagagcacagggacaagagcggcaagactggtgaggaggctggtgcgggggccaggtgggaccccggggtggctttgaataatggggagagaggagaggtggggaggccagaggacttgctgcccaggcttggagtgtcatcaccccagatgtgttggtctcagcacacattttgccggggctccttacgcagcctgggaatgggtcattcttccagctagagcagccacatagcaatgggttggtaggttccatctcagctcaacagccactgtgaagacagccttgatccccatagcttgaagccattcctgcctttgtgatgtgtcagtacctctcttaaggctcaagcctagctggtcctactatgtggcttggtaacatcgagcaggtcttccctctcctggtgggctccaagccgcggtgaggcaaaacccatgattggggactctgtttctccacagcgcctggcataggatgtgtcctatggtagatactctggcatttgtcttaataaatggccacataattgtgcacagacccatattagcttcacatgctcagtttccagaattattgttagattaatatcaaatcaaaattttttctcatggagactatagcaatacaaaaatactttctgggatgaagtaactgactatacacattgatgagtcaaccaaataaaataaaaccagaaaagagcagtgccggcctgtgtcccctgaattcctacaattgtcagattgacatggatgttccactgggggccgtgagctggaatcccgggggcaaaaagcctcactcttttagttttctgttctattccgatgatgctgacacttgctggttcatttggccttcctgatagcaaagaaagggcttgagactccaggagataattttccatgaaaaggagaagccttgtcatccacaactcagcgtaaggcagagttcaaagtgaagacttcccagagcagcccaggcactgttggtcctctttgcctgtctcatttttctccatagtgcttgttactgcgtgccttcatatgcatgtatgtgtctgcttatttttgtcttcactaaattgtaggcaccttaaggggagagggctttgctttcctcattgctctgtgtcaggatcctgcttaacctatagcacgtgctcataaacccagttgacagactgtgtggaaaaaaaaaaagcagcaatgttgtttgctatagctatgaatggtgaaagcttatatattttatacttagtccacgtaggaactagactaagcaccatcactttgtaaaagccttgtgcaatcgtgcatacttaggataatgagcctgcaataagcatggctcagatgctggcgttagccccacaggtcgagtatttggcaatatttgctgcagtgtccagaagctcgaccatctgaacgatcacaaaagcatacacgatttccagtgcgaaaacccagcccaggaaagcacgtgaaaccatgccagctccctggatgtgccctaaagttccacatgtgcattaggaagccctaatgtttatcttgaaggtaaagggttgcgggcatttggaataaatggagcacctataacaataatttctgctacagtgtagtactttctacagcagccaaattccaagtcttttgatcaggatttcttgtgctctggtgatggtgataattacgacctttccaagctatagaatcttagggcttagtggagctcacggcattcaatttccattttatagctcaggaaactgaggtctaaaagttacttctgaatatcatcttatgctgtatgactttggatttggggagttgggcttaagaagtccaagatgaggctgggcgtggtggctcacgcctgtaatcccagcactttgggaagccgaggcgggcagatcacctgaggtcaggagttcgagacgagcctgactaacatggagaaaccctgtctctactgaaaatacaaaattagccaagcgttgtggcgcatgcctgtaatcccagctactcaggaggctgaggcaagagaatcacttgaacctgggaggtggaggatgtggtgagctgagatcgcaccattgcactccagcctgggcaacaagggagaaactccttctcaaaaaaaaaaaagaagaagaagtccaagatgaggccaggcgcagtagctcatgcctgtaatcccagcactttgggaggccgaggcgggtggatcacctgaggtcatgagtttgagaccagcctgaccaacatggtgaaactccatctctactaaaaataaaaaattagtcgggcatggtggtgggtgcctacagtcctagctacttggtagtctgaggcaggagaatcacttgaacccgggaggcgaaggttgcagtgagccgagattgtgccactgcactccagcctgggcaacagagcaagactccatctcaaaaaaaaaaaaaaaaaaaagtccaagatgaaatttctctgctcattcatttattctgcaaacatttattgaccagttacaatgatccatgcaccatgctagagactagggctaaccaaaatgaataaattcgtgccctgttttcaaagaactcagaggcaggtaaaaggtccagcttgcagataaaagattacaaattcagtatcgtaagtgccatcctgaaggagtacaggagatgtttttgtccgtgtaatcattcattcaacaatttttttttttttgagatggagtcttgctctgtcgcccaggttggagggcagtggcaggatctctgttcactgcaagctccgcctcccaggttcatgccattctcctgcctcagccccccaagtagctgggactacaggtgcccgccaccacgcccggctaattttttgtatttttagcagagacgggatttcactgtgttagctgggatggtcttgatctcctgacctcgtgatctgcccgccttagcctcccaaagtgctgggattacaggcgtaagccaccgcgcctggcttcattcaacaaatattttttgagctgttctaatgttccaagagccagccagtcaaagatgagcaggtcctgggacctgcccttatgtcgtttcttgtctaagggtagtggctggcttgctaatgagtcagagaaaggttgtgaaggaaggatacaagtctccgagtacagaactgggaaacaggaattgctgtgagaaggaacagactgcaaaggctggagtgccaaagggcactggggcagggggcagttcggggaggttggggtacatgaaatgaaagagggtgaggatggtggtcaatccagctaaggaggttagagctagatctgtatagatctagaacctggcacttttctctgtcattgtctttttcttaggaactgttgacaggcatagaaaaatgtattaaactacatagttctctgatcctagctgcaccccgaaaacacacagaaagccttcctaaaatgatggtgttgtggtattaaacttctttagacttgctgccttggtgcagctctggaatagggatgaggaagaaagaacgtttcattggagccctcacctgggagaagagtgttctgtgttaaatagttaaaccagatatgcagctaggtgcccctatgcctggcacctggtacctgcgacaccgttaatgctgacgtcaccctgagagttggttagagcaggtgcttgaccagggaggctggggagactcagagaggtgaagagtctcagagcccaggactgagacacccagcccaagcctctgtactgactcagaggatggatttgacactgcgcagcaagcctgttattgctctgggtgatctgccccagactggtttcattttcccttcctctgcagccaaggaagagctaattgaccagttcagttacataaaaatcttcatttgtagtcacagcagggacattccatggaatcctagggactgggaaaagggtgactagcaccttcaggaacgatccggaatgtagtgcaaggaacacacactctctaaactccacattatggtttcattgctctaggaatttagaatatgaagactagacatgatcttcatagtgcttagagacaaagaaaaaagataggcctgtgtgtggcaggttccatgaaggtgcattgaattctgcaaaccttatgcaccaggctccatgctaggacctgattaccaaggtgagcaaaacacaggatctcaaagaattcaggcctttgggatagacaggcacaagcgcagataaatgcaattctgtgtgatgagggtcttgagagagttatcaaggtccgtggaacatggccaagaaagcaatccacttttagggggctagaaataaggtacagtgtggcaaagagaggggacaggtaaagtcacaggcaaaatgacactcggtctgggccttgaggaagatttgcctctctgcttgttagaggaaacgctgaaagcagatcccatggttgtgatgagactagaggaggaatgagaattggccacgattgtttgcattcgattgacttctttggtgtaaaccctttctgtccgttttgacaagccttggctctgattttaactcccttacgttctgcgaaaccactgttaacagtttatatgaatcttggcatattactttttctgtacatgcaaaacacatagcttaactcttttctgcaagctgttacgttgtcttattcttggaattatggaattcagacgaaactggaagctcagagcagttttgtcattgcaaagcagcataaattgaagcctgggaggtcatagataaggacagtttagaagcccagggttcctttctcctgaccccactgcccttcttctaaaggtctgggtcttttttttttttttttaaagaataccaagatctcgggcatagatgctctttctagtccataggagatattcttagatgctgaactgcatttcagagtcccattctctcattaactcgagctcacacttcctcctccaccttccccagggcccatcagcctctgcagttgatttgctgctgagatgcaggatttctcagagcacagggctgctgcgagttctgtacaatcaaaatagaaagaaggtgagctgaggttgattcatttccttgcagagctctaaaatcgttgtgcattcctttttcttaaggtaatgaaaaggattagagtgtttttcctcctcatgagtatccagcaaactgtgaatcctaagcgctacccaggcaggagggctaaagttagattgcaacaaagcaaacagagaaaatgctcagagccggttgcctccctttccatctgcgccacctctctctgagtttgtgctgtcctctcagtttcttctcttattctgtctttcctgtccctaggcaagagacagatttgcaaaggagatcaggtgtgattttccactagggttacggcagttgcttcagctctgcctggcttctgattccttagattccaagatcatatatttttagcagacctttcccaccaagcagtctctggggagccataaactatccgggttagaaagaggctgcaggtggtatggccccgcagaacgagaggcctgccctccagaagaggtctcccccatcagcgggtttccctgtgggctgagggctgttctcttagtgtgtttgattgcactctggggtttccatcctggaataatatcagaactccagtaaaggtcgtgcctcacagttcctttacaaataggacagatgcccagccactcagaaggctgaggcgggaggatggcttgagcccaggagttcaagaccagcctgagcaacatagtgagaccttgtcctacagaacaaatcaataatttaaaaattaaacattaaaaaacaaattagccaggcatggccctgcacctgtagtcccagctactcaggaggatcgcctgagcccaggagttcgaggtttgtggtgagctgtgatctcccctgtgaatagccatagtactccagcctgggcaacatagcaagaccccatctctaaaagaaagaaaggaaaaaccagaacagatagatgtaattataacttcatactggctgtgattcccaaaatgtgtagaagccccagcgggccacctgtcccctacttagaccccagaattacccccacaacatcactcctctcctccagcagcctctgcacctcaccaccactcctccttacctcccattaaaaaattgtttagtagttccgaatctatagaaaagttacaagaacgtacagagaattcccgcatctcccgtgtctgcattatctacgcccgttcttctacacttcctgtccctgttcatctgtctataatgtaggacatgtgacctgattcggcacatccccagacagtccagtgtacaccatccaaaagtaaggacactttcccacgtatccatcccacgtgcctgccaatctggaaatcaacactgatgcaacacaaccatccaatccacagactccattaggattttgctaactgtccctcctctgacaatttctccctctctctgtgcctccttccttcacatctccccgccccttcttctttctccctccgctccctttcctgctcccctccatcctttcctctctctgtctctctgtctctgtctgttttctcacgctgtctctgttcccctccacctttttctgtctctctttctctggttcagaaatctctccaggaagatattttgcatttagttgtcatgtctcatcagcctccttccatctggaataggccctcagcgtgcccatttctcatgtgtttgactgttttccatgctgtagtttgagcctcagctgtctgtctgatgctgcctcatggccatatggccatgctggacaggaataccatagaaatcatgctcccatcgggcgcggaggctcacgcctgtaatcccagcactttgggaggccgaggtgggcagatcacgaggtcaggagatcgagaccatcctggtgaacactgtgaaaccccgtctctactaaaaatataaaaaaattagctgggcgtggtggcgggcctgtagtcccagctacttgggaggctgaggcaggagaatggtgtgaacccgggaggcggagcttgcagtgagccgagattgcaccactgcactccagcctgggcaatagagcaagactctgtctcaaaaaaaaaaaaaaaaaagaaaagaaatcatgctccctccccactcctggggatgttaatcttgatcaccaagtaaagttggtgccagccacgtttttctactataagttcactgcttttccctttgtaattgatcagtattgtgttgagggagggaaatatttcagtctattaatgacattaatagcccattaatgacatctgcctgtatcagctactgctgtggtggctccagacagtgattcctcatttccatcatgtcttctacattttttagctggcgttctactaaaggataagctttttcttttccccattaatttattttttctttatttgtgtagagctgtttggactcatggatttgtctcctatggatttgtcttcgtttcaacctgatactcccatgacttattttaatggtcaagtctaagctgggccaataaaagtccttcccatcagttggcttcttcatcctttgacatgtcctcatcattccttgagcattttcctactttctggcacaaggtgccccaggctcattttgtacttgccctgccccacccctggctcagcacttctccaaagatccctggttcctgttagtggagacagcacttagacaccagggtccagcccccgatgagcccattgctccgggttgtcatatgtctgtgtgcatgcgtgtatgcatacatgagtctgctaactacgtctacagctgtctatgtatatatatatatatgaagaatcaatgagatcacaccaatatttctggttccagcccagtgctcggaattctttctagcctttcctctccccatgtttgtacagtccttcacacagcaggaggcctgaatgccactgatgcccgtcctccttaacatattcactgacttgtttgctcagtgtgatgacaacctcccaaccactccattagctgtcctctttctcagaccccagacacgctgctgcccatgccctgcagggcacctccctgttcactgccctctaaggccgacatctccagctgggtggggagggaaggagaaggatgagaagggaagatgggaaagcactccttcagctttgatttcgtttctgttttggttgaaaatttgatgtaggcgatttgaggaaagaaatcaaaacttatatagctctagtaatttttttgatgtgtctcagttcatttcctcttctagacaaactatcatgccgtcgctccttcccttcccatcatctgctctgcctcctgtggctccatggtctttgccttgctttcttccctgctctttctttcattctcatcagtttcaggatttggagtaagtatggcagtcactccagtccttcttttcctctctgtaaccccagtttaggctcttctctcctactctgctgcagggctgcagacctgcaaatgtaatatattctgttgtggtctcactccacaaacaaggaccaataatagagcaaagctagaggtcacacatgtacaagttggttgctatttgcggaattaagcttctgtgacatcgagtatagcacttgcttgtttataataactcaacagagaatccaaattgaataggaaagtgggatatgaaatatatcccactaacctaggatattaaatagaggagtccactatgtagacaacttcctccttatcacaggcaagatcttctgcctggatctttgctgcctgcatgggtaaaggtaaaagcatctaggcatttcttttctcatctttcattttattcactctggggtcctcagactccttggtgtctctgccactgctatcgggcctattctttctaggactgcggtgccttccatccccataatatcttcccctggccagtgctcccttgcctctgggcctggctcgaccaatcattggataatagatattgattgatgcaaagtttgtgtttcccgagtgttatatgaacatgttgcctaggttctctggaaacacagctcaaagaaagggagtgggggactgagcagtgaatttcaggaggtgtggggtggggaggtcctcagtcacgggatgcagctgaagctgcctgctccatagaggcagggccagccttgtgcacgggtgaaataaacagctgcgtggaaaggaggtgtgagggctgtgtgtcctcatgggaatgtaggcattcacttttgagatgttcttgcagttttgcagagacaccaaggcctttctatttcaaaccgttccccttctcttgacaggaagagttaaattccccgtgtctcctgtattcatacatttggaaatcaattagtgcaactggggcaatcagaagagctaaacagaggaataatttaacgagaacaaatgtctggaattgtgtattttgccaatggaatttctcacagttggtgcaagaaaatactccacattgaattaatcaggctgaatgtgacttttttcttcttcttcttaaaaatgttaaaagaaacatagcctagctgaggtctccttccccgcccatcacacagatcgcttttcagaacaatcctgtcagttgacattccacctgaaaaagagcaaaggcaggtgcacagctctaggtgtgtgtgcttggcatgaagatttttgccaaaaagagccttaaaaggttatctcctgtgttaggaccatgtggaaagagatcatatggggacagctggccttaagggctcagtacagggagtatgtaggatgcagaaggctgcagagagcatggctcctaccccgacaatgacaaaaagctcgataatttacaaagtgatcattttttcctgaacccatctcatgcctgcctgaggtagtaaggcagctgagtaaacagaatttcaaacagaggcaaagccctctaagaagcgggccacgtaaatcgcttcagctttggcagaggtcaggaaagagaggtgttcaccatacaagccaaaatctttttttttttttttcaggtaaggtctcactccaccactcaggctcaaggacagtggtgcaatcatagctcactgcagccttgaactgctgggctcaaggtatcctcccacctcagcctcccaaagtgctgggattaaaaaccatcacacccagccaccaaaatcttaaaagttcttgaaggccaagtgtgggccagtgtgtctggaacaggcttttctccacggggcccccatgagaagtattgggctacgtcaggagccagaggaggccccctcgacagccaggtgtgtaggaggtgacctgtgactgtgcaggcaggggtggagggaggaacggacacaaagctttcaccgcttctccagatctttccctcatgtgaagcaaaaacagaccctctcacctttatttttatttttgaaattgtggtaacatttattctgagaataaaacaggcctcccctcccctacctccatggggtgctgagaggagggaagcccagttctgggtggagtgggttggaagccccacccatctgtaaatgggactcccaggtccccatgggtgcatgaggtgaacaaggcaattgctcttccccacccacccagcatcctcacctgccctgtccccctcctggggaccagagatccctgcatggccagaagccagcccagcctacctgtaagagcaggcctgttaatccagtgctgtccaggtgtgggaggcagtgcctggccccaggctgaagcccacaggtctgccagttgggcctggtttgcgcctgtatcccaggggacatggttgagcaaagacctgtgtgtcagccccagaggcctgagctggcttatccagcactcactgcaccaactcaggaaccttaatttgaagtagacattgaggggtggtgattacatgaatgtgtatatagagtgcacgcatacagagatacaccaatccttagaccgtagacctaggggaggaatagaaacaaactgcctcagccaggggaggggtaggaaacattcctgccaatgacttgctgctgtagggaagataggagcagccaccttgggactcctaggggaggggctgtagattgttttgggcccgggattctacaccaataacaagcaggcaattgggcgtggtggctcacgcctgtaatcccagcactttgggaggccgagacgggtagactacctaagttcaggagttcgagaccagcctggccaacatggtgaaaccccgtctactaaaaatgcaaaaaattagccaggcgtggtggcagacgcctgtaatcccagctacttgggaggttgaggcaggtgaattgcttgaacttgggaggtggaggttgcagtgagccaagatcatgccactgcactccagcctgggcaatgagagtgaaactccatctaaaaaaaaaaaaaaaatcaaaaacaaacacaaaaaaaacaagcaggggtcgactactgctgggggaggagcaagaaactcacccaagaccagtgcaagtgagacaggttttgctgccacagagaagggggaaggattgctaaacatggaaaagaaatcccaccttagagggccagatgtacagagcctgcctaatactgaagctggagcacgacaaaagagaacatgcccattcctgccagcctaacatgttgtaataaggaagagcaggccactgctgggagaagagtaggagcatggagaattacctcatttaaggcccaggcatgcaggatggctggaagttgagggaggtcaagaacactcacacaaaaagcccctggcaccccagctccaactcaaagttcaagataaccgcagtctacctttgtaagaatgtgaaggctgtggtgcactgaaagtaacaacaaaactcaaactcaggtcaacccctgagattgactcagccttctcacctccatgctgacaacttcacagaagaagaggcatgttgatttccagccgtaaatactatttacctcagtctctactgctcttctatgcttgatgtctggcactcaactaaaaattatcacacaccaaaaaaaaaaaaaaaaagaaagaaaaaaacaatgaactattgtcgagagacaaagcaataaacagaatcagacctagagatgaccacaatgttggatgttggaagtattagatggactttaaaataactatgattaatatgttaaagtatctagtgggaaaagtagataacattcatgagtagatggaaattttcagcagagagatgaaaactataagaaaaagttcaatgaaatgctgaaaacaaaagacactttctcagaaatgaagaatttattcaacaggttcatcagtagactggacataactgaggagagaattaaagaacttgaggataagtaaatagaaataattcaaattgaaagaaaagagagaaaagagggggaaaaaacaaaccaaaacagagtagccaagagctatggaacaacatcaactggtctaaaacacatgtaattggagctccagaaggcagtatctgtaggaaaaagactctagcgaactggtgttttcctccagggaaagccatatggttaaaaaatggccacaagtagttattgcttttctccccagcttctaatttagtgaaatcatttactcttatattattctgcttcctttttgcttatcttctacaccctgttatttgagggaagaaatatgtgatttatccacacctccaatcccctttaacagcctgtctgccatttggcttcaagaaaagtggctgtgaaggtgagatggagtcgccgaaaagattcaaagcaagtctcagcaagctgccttttacttttagcaaccaagctaacttaaacttgatttagctaaagtaaaacatgattctcagttttgaagaggtggtaaattacagttcatctctgtccatacttacagctaagaacaaatagctcacataatttgcagtcctcctcctccttctcatttgagcaatgaaaaatctgcttaaagaaaaaggaagtattaaatatggtatttatccacaaaatgctcttttggatatcagaagtggtctcctgcataaactagttatgcatttaataagacagctgtacaagctcctttgtgtgtgtgtgcaggaggttcgttttcaggtgttcagcaacttccgctgctagatggtggtgacttgtggctgtcaccaccccttaggtaggtagacgcagccatctacgtactaagaccaattgctggaggagaggtgctgctggggtctggatgtttgtgcatctgttgtatccaaatgctttgggaaaggaagaggagggcacttgctgagagagctgggagcatattttagcttatgggtttagaatctaaacacttctcatcttgctgtttttaatgaacttgcaactctgtctttgtgcaggtgggcacctctgccttgaaaagtcctctgcgaagctttctgggtcttcttgacagaacaactcttttctcttctgtgccacctctacccctttacatgctgtttggggcttttttcacatgattttgcatttattttttatgcatccgtgttccctacaaaactgagttcttcaagggaaacagtttgtgtttgattcatttctagcacagggccagacacagacgaggttctccataaatatttgttgagttgggttaagtaattgctcagcgtttgatggcaacagtgtccacacctgtggctgagacaagtgcttcctcagccccgtccccatgtgttttttacaggcattgcattcccggaccatcttgcatctctctcattaactgtgcccagtggggtttgattcagtggccctgctgagaacagtggattcagatccccgcagtaatagacttggaagtgatttagggtgactatgttaaagacaaatctacaataaagtgagaaaacattttttaaaaatcataagaaggagatcgctgggccaggatctgggatggagggagagtgcagctccgcgagaggcaggtctactcaggcggccccttgcatggcgagggtcttactctctgccctttgcgagggaggcatgggacccaggaagagaagaaagggggttttctgcagatcagagtgatgaataaaatcctagagatcaattgccgaggtcacaatcagatccattcgttagctctaagcttcatggagaccagaaaagggaagatatgctttcatcatctgataaaaagaaacacatcgttttgggtttggttttgttttattttgttgagacagagtctctctctgtcacccaggctggaattcagtggtgtgatctctgcttgctgcaaccttggcctcccaggttcaaactgttctcctacctcagcctcctgagtagctgggactacagacgcgtgtcaccacacctggctaattgttgtatttttagtagagacagagtttctccatgctgtcccggctggtctcgaactcctgccctcaagtgatccggctgcttcagttcccaaagtgctgggattacagatgtgagccaccgtgcccagccagttatcacagtagtttttagcggggagaaaaccaaacctccttttttctgggaaatccaggttggtcctgtgtgtggctgtgccctggagacgctgcatggcctctgccaatcgtttgactactctgggccttgacttcctcagctgcagatgaaagggtggagttcagggacctctaatatccctttcgagtcctgcattctctggtcagacagtatatctagaatccctccggattgaaatcgtgacattggcctcaaacagcaggggccggccgtcccagagcattagcggcaagcattagctatttctttccaggcttgctggttttgtggctttgatgcattcaggacccacagatgctcatcagagcgactgcgctgcccaagtaagcactaaaaccccagccgtcagcaccgaggcaaggctggctgccactgcgagtcagcttcccgcagtaagcggccagcagcagctgccgggctgtcactccagccatgccgacagccacaaacaccaacccagttcccaagcaatcacagggcatccgctgtcagcactaggaagcttctagataaggctgccgctgggttggaagagcgcttgcagaaatgctgtgtgctgcctgaaaaagctcgccctgctctgagaaggagcagggactccttcctgcagacccatccagaaaagagttgcaagatgcagaagcaagagtggctccaggctctcagcgcactggtcactcgacaaattgctttgcagtgaatttgtcttgcaaatcaaggggaggggagttggtttctgcctgcccagtgctctctccccttctcctggattcccatctggccctcaagcactttctccctctctattacccagactggctctgacctagctttctctaataaactcattgacaccgggtgagaagaatccacacagctttggacccttcactgaatggtgtgcaaaatctgcaggaggaggaaacctaatggccagtggtcattttcaggcgtttgcatgaggaaatatttggtgaaccaccccctctcccctacacacacaccctggcaaggctggctgtgctgataggcaagggtgcagggctgccctgacctaaataggaggtaggtaatgttccctttgcagccccccttctcatttctctaacatccaaggcatctgttatatttgctgcatccaaggtccccacataaaagaagcgttggaccccttccattctcctatcatgactttgggtgactttcctctgctagttatggcaaagcaatttgcctaatctgtgaatgggctaatgcactcccactcccaggtagaatacttgtgtttgaacaagaacctcctgaaaatgatgccctgacacaatgggagagctggaattcgaggaacgcagggtggggctgcggagatatttggggacgtgagtcagggaccccgcacatcagacctgcagaaaccaagccctccgtctaggtggtgaggatctgtttcatgaactggagcctgaagtggctctgaggcctcccctggaaaggaacgcaatagaacagaattaatcaaaacgggaggccaggaggaggaggacaggaggggaaaattgctggcggggaaggaggaggacaggaacaaaataaaaaagcaggaggtggagtttgctcactgactaaaatcattttctgtacggagccaagatcgactcatccgttggaattgatattttgctccttcatattgtcagacttatttgtggctccgagtagcactccttgatgtcagcttttgccggaaagtttcaagacctttcagggcaaggatcagaagagcaggaagcatgagagtgatgaataaaacttgaacttggctgccttccataaagcacagtggcagcttcaccagatgcagctggaactttaattggttaaattttaattggctctgctcttgtgggctaagggttgggcaaggaaaatgtgttttgtttgtttgtttgtttgttttttgcttttcctaaagcttaactgtcaggcagccttctttggtcacctttgaaatggtgggatggcaaaggggctattttatgttttacattttatttttatttttgagacagggtctggccctgtcacccagtagcaggatctcagctcactgtagcctcaaactcctgggctcaggtgattctcccacctcagccccctgagtagctgggactataggcacacactaccacacctgtctacttctgtgggcttttttttttcttttgtagagctagggtttcatcatgttgcccaggctggtctcaaaatcctgggctcaagcaaccagcctgcttcagcctcccaaagcgctgcgactacaggtgtaagccactgtactgggccaaaggggctattttaatactgatttttctattgaggaaatcttacagctgggtggttggtggtattcatttctcatatgaccttgcttcagagtttaacatcttaccaaacatatgtctatttctacaagtatttaggatgcactggtgttaccactttgcttttcctggtcactgttgtgaaaattaaccaggggttgaagctacatcattttaattaagtgggctgcctaaagcctggcctcgacatgaatttcaaggtcaccatgggtgttgtgagagcttactgcctaattcacatctgggagtggcgggctagttcttgcccttcctttccatctctgctctgttgtgacctgaggcgtgaaggggaggctgggtggccctgccctgtgccccttccaacctctagacacactccactccttttctccagtgctgtgaacacctcagggctgggaaggggcctgggcccccactgggacatgcagaaagcaccatttgactaaccatgcccttcccgcctctctgctctttacagaatgggttgaatggcttgcatctggcttctaaggaaggccatgtgaaaatggtggttgaacttctgcacaaagaaatcattctagaaacgacaaccaaggtatgtctcacagggagtgggggagctttgcattgaaaattcaagtttgtgagtccttccttagaaaccagtccttcatgagagaactcaggcatgcatctgaatttctcttatccttccaatcactttttagttctctgaatccctgaagctgcctgaaacagaccccatttccagaaagattcagtgggcctttatcctcatcactaggttacgtatctaaaaatagagccctttcctgatggctttatactttctcagggtccttgactcgaactcagtgtccaagggctctggaagcgccaatcaggtgcctggagtcgaatcccagcagacatacttcacgctctgtgacctgggacgagttacttggccactgtgaagcctcagcttctttgtctgtaaaatggagataataatacttagttgcagggttggtatgaaaagtaagtgagatggcatacatcaaatgcctggatgtatttattggatggatgcatttactacttattggatgcatttattgattattggatatattaattgattactgattcctgtagtaaggaatcaataaatactagtgaccatgttgttactgaaggttgtagagaagaatccagatttctttcatttctccttctccagcaagtcttccttgttcagccccaaactgatttcctctcctcgctaacgatctggaacagcattctgtttcatgaggaggcgtttggcatggggcgacgccaggcatccacagtaacgtatttcactccatttcagtagattataaataccagtgactcaacttcaaaatcccagagtcatgaaattgatacatctatagattgcaaaataagtttcattttttacctgacatgcatcttatttatcaaacaagatgcagccagcaattaaaaataaaatgaaacagactgggcgcggtggctcacgcctgtaatcccagcactttgggaggctgaggcgggaggatcacttgaggtcaggagtttgagaccagcttggccaacatggtgaaaccccgtctctactaaaaatacaaaaattagccgggcgtggtggcgggcgcctgtaatcccagctactcaggagactgaggcaggggaatcgcttgaaccctgcctcaagcggaggtggaggttgcagtgagccatgactgcaccactgcactctagcctgggtgacagagtgaaactccatctcaaaaataaataaataaataaataaaacgaaacaaggctggacgtggtggctcatacctctaatcccagcactttgggaggccgaggaggggagatcatctgcggttaggagttcgaaaccagcccagccaacatggcgaaaccccatctttactaaacatacaaaaatcagccagtcgtggtggcacaggcctgtaatcccagctactcgggaagctgaggcaggagaatcgcttgaacccaggaggcggaggttgcggtgagccgagatcgcgccattgcactccagcctgggtgacagagacagactccctctcaaaaataaataaataaaatgaaacaaaaaatcatctccatttgctaactcaagtactgtctccccagttactgttttctcttctcttccctcctctgttcctttcccatgtttttcttctggagttctttccccctagcctcttattttccttttggtatatattacacgtggtctcacacacaacctcaatttcagttccatgcagcaaacagtttgccgcctctcaagcagagaacatagaagaacaatatgtagagaacagatataatttatggttatgaagtgaactaccaaaatattatgaaggtagaatcatctcttgaggtaaaattctgtaattttcatgtcatttcctgaatgtgaaaagatcttattgcacttatgggtaaaataaactgagttgctctttctgactggatacggggtatttttttcccaaattctatgtcaaattccaattgttcccaccctgcttttcgtgtggatgaagggtgagattattttctctgcacactcccacgtacctggctgtgagctgtgtgccatctgacctgccccgcgtgtgccggagcggcgcctgccctggcgtgccttcaagggctgcggaaacacgaggcttcagcgcttcgactgtttccgaatctcctccccaggttgtgattttgcaagtgaacacttggtgtgtcttttttatttttagaaattttctaagccaacgtggctttggaataccatccagagagagggggaaaaaaaggtggaactgaaaccgtgggctggggaagagtcacaacagattggggactgtgatggggctcccaggcagcagaaagatgaaaaaaaaaaaagaagaaaaagagtaaaaagccaaaaccaatttagattcctaaaatgtacttagaaattttaaaagcacaaaacaaacgcattctctccccatcctcctatctccagctcttagagactggagctcagcacctaagctgttaatgaatggggacagctttcatctccactggaaaaaagcctgctctctcacttggggtccctctcccccttccacttgcattcaatcagcacccatgcaaccatcctccctgctctgagctctgtgagcccctgaaaatagagaaattgggtgtttgtggagcaaaatatagctaagtaatttttcctgctcctttgaggccatgttctttcatggtgagggaggggcagagaaaatagaggctcacaaatcccttttcctgtgactcccacaacttaggccaggggccttcttgagcctcataatgtgtgtgtgtagataggggaaaggaggtccacttccagaattttccctgtgttcttattcctcacttatgctaccgttggctcagctggcccgaaccaagatccatagccaggtttccatcactgatgagctccccaaaacagggtgaccttcccctcctcgtggggtaaggaaagctctcatatcattggacttcaggcaggaagggtcagttggaaagaaacctttgacgtgagcctcttgatgtctccatggcctctgtgcctccatgctggcccaggccttctgtgcttatgcccaggaagcatgtggccagtgaatgaatgcacccaggatgcctccttcttttccatgggagcccagaagatgccacttggagctcagcgtcctggtgtctagaaaagtttctggtgccagcagtgctgctccatttggtacagcaggtgccaagcctctcaatggaggctctttggacttctatgaaaaattattaatgagcttccagactttcatatctggcatttattctccaatggatacctgaggaaaaacctttttcttcatcaaatagaacttgaggagaaatcaaaaagacaacttcaggaggcaacagatgggaagtgcctgcctttaaacaaaacaaaacataaacaggctttatgcctttaaaaaaaaaaaaaaaagaaagaaaagacagacagactgggtctcactgtttcccaggctggtcttgaactcctggactcaagcaatcctcccgccttggcctcccaaagtgccaggattaccaatgtgagctgctgcacccagccccaggctttatgcttgaattaccaggcagagtacaagaaacagaactgagctgcttcccagcccccagggcggcctcatggggctgcctccctgacccggggaagcggggtcagcagcggctggggggccacacggctaggccccaggctgctcccttccatctcagtgaggaagcttttcctccaggtgacaggagccactgggcaaggtcagagtccaaagtccctgcttgtcagttcttaagtttcttgaaatggattagttaatgattatgtagtttagtaaaaagaactacatactgtctaaactctaaaaatgaggttgtttgagatctctgctccttaagtagtgcagggacagatgggtccgaccatggacctattttctccactcgccctatttgacagaagcatggagtggaggctgcccgcccctgcccctcaactccctgaatgggggctcaggtgcagggcacccaggggagtccacccccagaggcagtgctgacattgtggtccaggacccccaggggctggcaggagcctggctggaaggctgtgggtatcccgggaacagatggaggctgctggtcctgtctgtgaattgttgtttaatatcaaaaaagaatccagacaagaaaaccggagaatgttaaactcatgttctcaggcccatgcctgtaataccagagtgctgagaggctaagacaggagaccagcctggacaacaaagtgagagcccatctctacaaaaaaatttaaaaattggctgggcacggtggcacacgccttagtccccacctacttgggaggctgaggtgggaggatcgcttgagcccaggagttggaggctgcagtgagttatgatggtgccactgtgctcctgcctgggtgttagagcgagacctccaattctaaaaacaaaataaaacaaaacaaaaactcactttctcagaacctgccttatttctcagtctctgctattggttcttatcttttacaaagtttaaaacaattacgtgcctggttttcctccagtgtttattctctccagtttttctctcctcttggatttggtgaacccttactcattacattttgcttactagtatgttgcatattctttgtatttttcttggccagattgtattccatttattaccccccatttattttctgatttttcttctcttccctacatacatcatagagttgatcttaccctttccttttctgtataatgctttcctcactctcctgcctcccatctctttgtccgctccactgcagcttgtggtctgtgggtatccctgggatggcgtcaaaggtatgggcctgagggacctgctggcctcctttcctggcgctcccaggcctctcagagggcttgttgccttgcagaattgcaggctgagcggagctgcaggtccgcggaaggccagctcgctgacaagccttccagtgtgtgtcctgagggacgccaacgcgctgtctgctggggacaggacgctgcacgcacacagcagattagatgttcagaagttgtgtgttggcggggggtgtttttttctttcagtattatttttcttttataaaaattttttatttttaattattatggatacataatagaaaaaaaggagttcctttgacatggccgcactctccttcaaccgcacatctcagtgtcacctgcccccttcctgcgccactccaatcacaccagccagtgctggtggtcttctttttaaatgtttttctttttatagattgagggggtatgagtgcagctttgttccatggatacattgtgtagtggtgaagcctgggctgttagtgtggccatcacccgaagagtgggcatcccatccaaaggataatttctcattgcccccacctcccaccctctgagtcttcagtgtctctccactctctgtatgtccacgtgtgcacattatgtagctcatacttacgagtgagaacatgcagtatttgactttctgcttctgagttgcttcatgtaagttactggcctccagttccagctgagttgctacggaagacctgatttccttcttttttatggctcttgcagcattgtttgtcatagagaacaggctggatcttcctccctgtactttcagtatgatttcaggatgtgcaatgggtcaagcacacacgtgtgtcctttctaccccttttggccatgaagaaagcccccgggtccctcaagcagcacctgtccacagacctttgctggtcccgtagcgggcccagtgggaaaccgcctctgttcccttcccccatgtgtttcagaaggggaacacggccctgcacatcgctgctctagccgggcaggatgaggtggtccgggagcttgtcaactatggagccaacgtcaacgcccagtcacaggtaatggctctctggtctggactagagggtgttgcctttccacaggtggttcctctttgctgctccctcgtgggtccattggcagccgtgttaacacacacactactgtggggcagggcctagatttctcaggagcatgtctctgagcagtggtgaaggtgtcctttattatttcgcatgcatagaccgcgtgtcctaagcatgacggggttgaattgttttggacctaagccaaatagtatgtccagttgtagcctaggtggagagagaaactgaggactgggggaatgaggtgtgcagtgcagcattgatgaaatcaatgaggagtatgtgagctgaagagactgacctacggtggcgaggggaggcacagcctctgtggccttttgtaataatcccaggacgccagtcaccatgacaatgagtttccttaggaggggtcaggtgggaggaaatggaatgaagagagcgctgtcctccaggtgagaggacgttgtgctggtgtaggcctttcttaaattgcgggtggatgctaatgatgtcctctcttggtttacagaaaggttttacacccctgtacatggcagcacaagagaaccacttggaagtggttaagtttttactggaaaatggagctaaccagaatgtagccacagaagtaagtaccttggaaaaatgtcgtcaccaccagaagtctcccaggtgtacaaccttgcttcaggtgacacctacctgggatgtggcttggggtgcatccatgtcatgatggatgaccttcaggtcgctgcactaatccagagtgctgtcaggttctgcaagggactaatgacaaagtcatgggtcttgaagaaggcccagacacgtaccaaagaaacgacgtcacacttgagggtgtccttcccgctgtggccaatacttgtgactggagggggcaggcgaagcatgcatgtgtatggttggcaagtttgcattgggccttaatgagaaaggctcttgccacaaaaccaccatgcacccttggacaagtctcattagctatggtcctgagtcttgtcattggtgaaatgatgaaattggactagatagagccaaggagtctcttgactcttaactttggatggctcaatgacatgactttgttgtcattccgttttatcagttcctgcggtcctgtgccctttagtatgtccacaactgagggaattaataatagtagctcatggccaagcgcagtggctcatgcctataatccaaccgctttgggaggctgaggtgggaggatcacttgaggccaggaattcaagaccagcctgggcaacacagcaagaccccgtctctacagaaaaagaaaattagctgggtgtggtggtgtgtgccttattcttagctacttgggaagctgaagtgggaggatcacttgagcccaagaggttaaggctgcagtgagccatgattgcaccaccatactccaacctgagtgacagagtgagaccctgtctcaaaaataaaataataataataataatagctcacaattgaattatcagggcctggtgtggactctggcctttggtcggtgttagtaatgttctgccttgtcaaggcactatcctggtaccagcagatggggtgagaaagagagccggcaaagaatctgagcagtcaaaagtttcttaaaacaagtcaaactggaagcaaattataaaggaaaactaaattaatgctaaagaaaaattcggcaggctctgtgagattgcagagaaaggaagtggaggcaggaagggcttcagggaggagatggcatttaggctaaacttggcggatgaagagggctttggtggaggtaggtccctcaggctggggctgctgggagcataagcccgaggggcaagggtgtgtcccgtgtgaagggcggctggcgtcagacgagtcagagcaaagcattttcctcctctggccaggacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaaggtgagggcgaggaggagggaggagccttgggccgcggacgcccgtgggctcagggggcaccgcgcacgcccagcgacttcccaggcaggagaaccgagcgtgcagggcgggcagtgcgcactgagcgccctcaccccaggacgcagaggggcccctggacagccccgctctaaatccctggcagatgcccagaaacgtgctcttggtgagcagcgggggtggttcctgttgctccaggtcatctggaaatgtgtccaggcgggcagggcgggtcaccctggaaccccaggaggcggccttcctgatgttccttcatctctcctccccggctgccccgtagtggagggaggaggcgtgcaggggctggggtgtggagaaagggggtccgggaccttgcacgcctgcgtgcacctgggcacgctctccggtgttcggaggcactgctgatctgctgtctgtaggctgaggctgctggttttcttttagtggaaatggatttactggagttattcaaagtcccctcctgcaccccgcccctcccctcttccaccggccccagatccaccgggttttgtctggaaaacacctgggtggggttaggcctgccttcaggctctggaacagaatgatgacaatggacggaggttgaggcaggaggatggtttgagcccaggaattggagaccagcctggacaacatagtgagaccctgcctctaaaacattttttttaaaattagctgggcatgatggtgttcgcctgtagtcccagctactggggaggctgcggtgggaagattgcttgagcccaggaggtcgaggctgaagtgagctgtgatcacatcacactgcactccagcctgggcaacacagtgagaccctgtctaaatgggaggaaaaaaagaccatagccccattacactttcattcatgaatgaaaatctctttgtcggtgatcactctgacgaacgggcccacagagtctgaggttaacatataattcgggttgctcagggcagacccccagcttttgaatacactgtgccataaagcctctcttgaccccctcaccaaatgttcccacccatcaaaatctcctttgtctgtaaagtcctgttgccccacctgagtttcctgcatcccagggctgattctgagatagaagtaaatcacatataacaagtttctccccctctgttgtgccccagacgggattcacgcccctgcacattgcggctcactacgagaacctcaacgtggcccagttgctcctcaacagaggagccagcgtcaatttcacaccacaggtaaccctggggcacgtgcgccctcactgtccgggggcttggggctggcagttgctcctgcctcggcaccatgggtttcatcccagtggcagaagtgcctgtgggttaaacagccctgctgtctggtcgggctccttgctggcaggtttctgatcatctaccccccagtttccacctgctttgtcttgagaaaaccctaaactccatttgcccatcctaaaaatgggaaacctggagggcagagagtgatttccatataactgactttcctgcagtctgttatgttgactctgggaggcatgggcttgggtggtgtggtgggatgacccatcctgttggcaggtcctttcaggttttaaaatgtcttaggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgagactccgtctcaaaaaaaaaaaaaaataaaaaataaaaaaaaataaaatatcttaggccagaaatgccctgacaacgctgttgcaggcctggggactgggggctggggacaaggggagcgggtgcacagcagctgcattccagggaaggatgacgcgccctgaccgtcctgcttcctcccttcagaacggcatcacgccactgcacatcgcctcccgcaggggcaacgtgatcatggtgcggctgctgctggatcggggagcccagatagaaaccaagaccaaggtgggtgccagcaggtgctgtagccaggcagggggagggaggtcccccctcacaagcctcacccagagcagcgggcccttggtgacctagttagggatgcaccaccagcctcccggagccgcctgcagcagtattctgggcagtgccgcgtgcagtgggaggcaatagtaaaactgtgctgaggtcgagctggtgcttgaggaaacgtcagcacttgcgtgggctgggatgatgccataggcagtcttctctccaaatggcctctgatagctgccttttgggctttctgtttttgactctgtcttttaaaggacgaattgacacctctccactgtgcagctcgaaatgggcacgtgcgaatctcagagatcctgctggaccacggggcaccaatccaagccaaaaccaaggtgtgtacttccttcctgtcaggcgcattttctagacagggctccaggtccaacagacctggcatcaaatcctatttctgtaaaacagagatgctaatactactagatgagatagcacctttgacatttattacaaggcctatcacgtaggagactctcagtgtagctctaatgcctaactagatcagggtcggcaaactttttatctaaaggaccaggtatgagacaattttaggctttgcaggccgtggtccctgttgcaatgattcaacactgccaacgtagcagaaaagcagccacaggcaatatgcaaactagggcccgtgttccaataaaacgttattgacaaacactggtggcagggcagatttgactcacaggttgtgtagttcgcctactactgctctagatcaatccctatgtctctcttcctagctccagaaaagacaggcactaagtactctgagaagtcttcagagcctgggccagactgaagcgaagttaaaaagaaaagaacacagttcttctcaggttccattacgggccagagaaaaggcccgttacgtggctctgacataaggactcgagtcttcaaggggtgaaagctgtcagccacactgctgcctgtgcctgctctgggccctctgccccgtgaattgagctgtgtcagagcagagcaaggcaaaagccaggcccactcacagctacccaggaggtttcccacgagcagttctgtcataaaatgatggcttagaccatacagtgaaagctgatttattcccgacacattatcatgttctgttctgtagagctgtcgttaatttgggtcatgattcatagtccccacactggttcttgggtgtgtctgtgtgtgctgttgcatgagggtgtcctctactaaagcagtttctcatttagccctccatccttggctgatttgccgtgtgactatgaacgtgtgtcttgccctctctgtgtttcagtttcctcatctggagagcccccaccctctctcctaggattattgggatgaccatgtgagataatgtcttcaaaagctatctaaaagtaaaactcctcagctaaatgaaagtagaattgctactatcagttaaattattagaaaattcccaacatttttccaggagtgctgtatttaaacataatacatggccagaagttaagattttttgttttattatccagatcattagaatggggctgaaaagaatgcttatgaaaattccttactgagaatatgtgacttttcaattgggaactatcgtacaacctttctgaaatgcaagtgtaactaactgagttagctcagtccaccttaacaaagaaccacatgctgagtggcttaaacaacagaaacttactgtctcacacttccagaagctggagggtcaagatcaaggtgtcagcagggttggttctttttttttttttttttttttttttttttgagatgaagtctcactcagtcacccaggctggagtgcagcagtgtgatctctactcactgcaacctccgcctcacaggttcaatcgattctcgtgcctcagcttcccgagtagctgggattgcaggcaaatgccaccacgcctggcctatttttgtatttttagtagagatggggattcaccatgttagccaggctggtctcgaactcctggcctcaagtgatctgcccacctttgcttcccaaagtgcgggaattacaggggtgagctacagtgcctggcagggttgattccttctgaggctgtgagggaacatcttttccaggtctctccccgagcttctggtggtttgggcacaatctttggtttccttggcttatagggcatcatgctgacctctgccttcatcttcatgtgacattttcctgctgtgcaggtgcccaaatctccctgtttctaaggacgccagtcatagattagaactcacactaatgacctcattttagcttattatatccccgaagatcctgtttccaaacaaggtcacattctgaggtcctgggggttaagactgcagcatgtgaattttgtgggacctaattcagcctgtaacactaacatctgctgtcatggaacctgatttgcatcttccttgatgaaaatcctctcatttccactttctaaaagctgaagtcccaggtcctgagctcctagcctttcttggcgcagctccagcctcctctccagcctgactccatgcttggaatcacctcaccccggactgtcgaactgcatggaggcccctgggttcccctagggtagctgcctctgtgatgttgcacttgctgctccctaggatgttcttcccctttggtcctcctggtgaacttccattcagctcctttcaagtcctagctcaggcctcacctcctccctcccagtgcccctccttcatcagggacgccatctgtttgtgcacaactctgtgctttgatcatcccacttcagggcgctgaaagacaacaccatgtctgtctacaagcttccttgggtcaggggttatgtctgttctcttctgtttccccagagcttaacccataccaggtgcacattaatcacttgatagatatgtgttgaattaatgtctaagtgaatgaatgagtctcctctctcttttatgttttttaaacaaattgctgtttgagaaatgagtatccttaacagaattttctttaactgaactgcatttgatagggacaaggaacagagggatttagatccaagttctattttatcataattcattcattcattcattcattcaaaatcacataatttagggaccatgatgtgtgttacatgcatgtatttggcactgtggggcatttaaggagaaatattaggctaagtcactgatcttaagaggcgtataagtaaagagaagagatacactcccctaaaaagttagctatggatataattgggcaaatatgagaataaggtctgagcgcatggtgcagataaggaaagcccacaggagtctagagtggtcagggaaggctttctggaagaggtgggtctgctggacatggctttgaaggtttggccaggtggaaaggagaatgtctgtggtcagagaccggcaggagcgtggaggccagggtgagccaagctccctccagagacttgtggaaacattgtgtagggaagaagtagggagtgacgttggaatcgtcctgaatctccatgctcggtccccagaagactttgtgattgcttgtgttttcctctttacccagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctggtgagtgggggtgctgctggagaaggtgcagagtggcagggcaggctgggggcaggagcagagaggcatggctgggcctgtgggaagggcggcaggtgcccggagctccccagattcgaggcctgagcagtggggtgtgacagcactggatggtgggggcctggtgtgcacccctcctgcaccctccactgcacacccacctgggtatcgacccctgccccggtgaccaggccgaggtcagggatgagtttgggcccaggagaccggactcaggaagcatcctgcatggtaggtatgcgggcttggggcatctctccagtggagccaggcctggagctgagtgattccttagaggctgcgtggctttctgagctgctttggggatgaatgagatggccagagctgagcatccttcgtccacagaggggcttgtagttctcatggcactcgtgtaaagggaagctcaggcccagagcaaatccctcctgtggttcctctgcctccttcccaggacaggggctcccagggagtctggggatccagcagggctgtagctttgcactaagcatgcctgtaaccacatctcctctctgcctcttcccaaggcagcagaactgaggggcaggatatcctccagggatggcagaggatggctcattcattcactcattcactcactcgctcaaaaaagctttcactgagcagtgcccacaggccacgtactgttataggggagttgggatttcccagcctcaggactgttgacatttggggtcgatatttgtggtcttgtgtgttgtaggatgtttagcagcgtccctggcctctacccactaagcactcatagctctccttccctagctgacaataaaaaatgtccccagacattgccacatgttttgggggtgaggtgcaaacgatacccccccaccaccacctcccgtgtttgagaaccactgccttaagtggataaaccactgaaaaaaacagacaaaaacaaatacacatttctgcccttcagagtttacattcagagtatatcacactttaaagcagaaatccatttcactaaaaatgatcagtggtttcagggaagagggaacatgatttgcttcacaaaagtactcttttattgtaaatttacccttagggggctttaaatggcaggatcttttagtgcatccaaaatatgaataaatttttaaaaaaggtttataaacaacatgttcaggaacatatctagtgcatcaagtgagagccacctgtctcttacatgatttgcattaattgacattataagactaatcaattggcattaattcgttgattggtctatgggcatctgctggtggcctgggcagcagctgccttttagagcagccaggtggtcttctgggcgttccttgggcccgtgtgtaagctcctgcttgtctgtctccctttgtgtgggctgcagaatggctttacccccttacacatcgcctgcaaaaagaaccacgtccgtgtcatggagctgctgctgaagacgggagcctcgatcgacgcggtcaccgaggtaggagagactgcagaggagcctgggggcaggcctgtggtctcccccgacccaccttctccaagagtcgctctttgtagctttgtatggctgcaggggtgtgtgtgtctgcaagtctggactgctggaaggaatgaatcaggggtgactaagacaagggaacatgagtcaagtctcatggagccttccaagatcagacacaatttttgcaagttgtaagagtgggcacgacttgcccacagtaatttttttctccaaccattttcttggaagcaaacccacctcatatagctcccttttcttggaaaatcatttgtgaaagcgttagatactgtcaggttctctcttcttcaggggagcggaaagactcccacttatcggactctgcctttgtctgtttcagtctggcctgacacctctccacgtggcctccttcatggggcaccttcccatcgtgaagaacctcctgcagcggggggcgtcgcccaacgtctccaacgtggtaagccctcaggcaggcaggggcttgctcccctagaccaagagctcagagggcagctttcaccagtgctcccagtcctactctctggggacagagctacgattcccagaacagccaatgcttcagactgggggaggacatccctgtgtactgacgctttctggattaaatttctcacacatccgtaaaccttggaggctttgttttggacaataattttggaacgtctgtaagtgttcactgggaatacatttacatttttgaatattcattagctctggggtttacttttaagtgtacctagaatacacagacacacacataaactcatatacacgcatgcacctgcacgtatgtgcacacacacacatacacacatacatgcgcatgcacacatgcacacataccaggctaaagagctgcctgctggggcaactccacctcttggacaaaaacccaccaagccactccagactgcacttcctagctctgtgtgtgccgttttggacagcaggcatgtatgaacagttctataattttgttattttatagaaagtggagaccccgctacacatggcagccagagccgggcacacggaagtggccaaatatttactccagaacaaagccaaagtcaatgccaaggccaaggtgagtagtgaaggcaggaagggaagggtttcagatgtgagcagttccagcactgtgcagagaacccatcctcattccaggcggggctgcagtgctgtggcctggggatcacttttcatcctgatcaggtcactctgagcgcccagattctgctttgcagggggtttgagaagaccagggatatttctgcatgagagccacatttctttaaaataaggaaagtccaaggtgcgtggctggcctgagtatgtcctgggctaacgatgacagttgccatgtaaggaggggggcaacgttttaaagaaagcattgccagcaaaaatcaggcaagaattacttgatctaaaactggagagttcccccttgctgtaaacacattttgcgggggttggaggagtagacagtgagaagagctgtggagtttgccagttgctcactcggccaacagcaggcttcctaaccacaggccacgatgggttctccttagagtcaggcctgtgatttgtgtttggggccctcgagggaagcctccagctgggccccatgagacctggcccaggcagcccgacagcagcattcagaaacaggaagtgggggggtgtgggtggaaaagtcctcattctctgtcagcagttgagactcccctgaccccagcacagagaaaatcaaactagagttcaagcagaaagacaagcgcatccactcagaaaggatgtgggagacggatgagcagccacactgcattgagtgccttttatgcaccaaacgcagaaaccatgtacattatcagcttgatcccagctgagccctagcaagtagacgttattattcccattttacagatgggagggctgggcctttgggaaataaggtagaaataacagctcacttgaagaactgttgtaaggattcagtaggatacagcatattggttcctgtaactcagagacttgattcgaatcctgactcttcatcttcttagctgtgtgaccttgagaaggtcacttgccctctctgggccctgccttgcttctctgtaagatgaaaagttggatttggtaacattagcgtttcttcttctttgttttcccttcggggtccaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaaggtacagcctcccgcctcgtggtctaaggaagcaacaggctcactcagccaggcctggagctcggaggggaattcctgcctggttctctttgtcacctcaatgatgctgcaagcagctggaagggtcgtcacactcagggctggccaccacctgcaagccgatgtgtctccatccttccccaaaacaggaagtcaaccacagcttctcacacacccagccagccttcatacatttatcatggcacaattattagtcgaaacctgctttgggcaagtcacaaacaggttctggggatatgaaaaggattaagactcataccctgccctcagctagccagcaatcaactaccactgtgaggtggttgagaccctcttgccagaggagtgtggaccgtaagtgcagggatgcctgccaagtcctgaggtcttcggcctcccagagggctcaaaaatggctgtgcctttgctttcattggcctctccatgccagcggaggtgcagcctcctttgctgtgggccctttctccagggaggacagccctggggccccaaggtcctgacagcctgtttctcctcagaaaggatttacccctctgcacgtggcggccaagtacgggaaggtgcgggtggcagagctgctgctggagcgggacgcacacccgaatgctgccggaaaagtgagtttgaaccctgccctcccctgcagctctcaggttagaggcaaggacagaggatggacatcagcacttgcagattccatctcttgcctgtgttgttcatcttttttttctttgagacagggtctcgctctgttgcccaggctggagtgcagtggtgccatcacaactcactacaattttgactcctgggctcaagccatcctcgagtgtcagtctcctgagtagctgggactacaagcagttgccaccgtgcccggctaacttaaaaaaacaattatagagacagggtctcactatgttgcccaggctggtctcgaactctgggctcaggtgatcttccctcttcagcctcccatagctctgggattacaggtgtgagccactgcacccggcctgtttatatttccatgggtagccatcgagagagaatggcctttggaaagactggcctttctgtcaaaggccttatccttttggaaagacccgatggccttctccgggcaagtgtattgatctcactgcccacgttcccccctgttcccacagggctctgggtcctgccgatgacattctgtcatgactccaagttaagactggcctgggaaagattttaaacaggattttactgtataaaataggtgctcccatgcctaaagggagtcctgggagaaagtccgtgggagtgacagccggcctcttttgtctttgtcccctgcagaatggcctgacccccctgcacgtggccgtccatcacaacaacctggacatcgtcaagctgctgcttccccggggcggctccccgcacagccctgcctgggtaaggcccgcccctctccccagctgcccctggagagcaggtcacctgctaccttccagtccctcagggaggggggtttccacagcagcccaagggttttgcgttctgttgctatttttacctcagaaatcacgcctcactttcccacatgttacctgccctgtaatcacgctattcagggcccaggagtgggatgggaagtgggtaacaattcccagccaggggttacctcgcagaggcagaacttgttttatacaacaaatgtgtccccaagcagttgcacgtcagctgggttttgtaaactgactgtcagaggtcagtgtggataaaaatccctggggagtggtgagcccgtttctagcattgctagattctgactccgtgggactgtgcagtgtggcctggaagcctcatttttaacctactctctgcatggttccaaggctggggccacagcgaccgtactttgagaaatcctcagggctgctggcgagcttgctggaacctggaaacaagagacctctttaaaatgagaatgatcatctccaaattcatttgtctctgagatcagacttttagatagtggcatttttgtagggaggctcacctgaatgtgagacacattggcccagcctcacaccagcttcggaggcgagctgctcagagcagcaggttccgtgacccttgagggaatcagaggagggagcagatgggttgcttctggaagaccccacggggttgggtagtacaaggataaagctggaaggaccatttttgggaacaggctgcctgctgtgggaaggcgaggctgtgtagggataggcaccgcgggactggtggccagcggggagaaggggagaggagagggagcggggccaggaagacaaaagccacacgcagtacccgcactctatggggcagccaggcgcacgggaaacaggataatttatgggagatccgtcatgtggcaggcatccaagtgctgcagagaaggagcctcggggtgggaccccatgtgactccagccaacacctgctggcttagggcctccgcagcccaggcagggagcgtcagtgccagtgcagggcttcggcgcgttctccctccctggacagacacgtgtccccatcttgcagcatcgctcttctacagacgccggctcccgacagctgtctcctcctgtccctgctgcagtgagtcccacgtcgctgtgcagagggagcacacggccccgctgcgatgtcgacttactcctgcctctaaaaataaaaacctggactcccctcctcctcactcccctacttatataaaaggaacgggagccaggttcattatatttaaagataactaaatccaagcacaaaccctgtacagatgggctttgtttccatggcaaaaaatagtttccaaagtagtctggcaattttgtagaatttcacatgcaaatctctctgcacccaaaccaaaccctcccctttctaattttgatgctaatgttgtttgaacatttgggcagagctccctccgtgtgcattccttaggatgagctcatttccttgggaaagaagagccttttgcgggcacacattcctccctcccctctccgtgactttccagcctagttgtccttgtccttgtcacctgcagaagttcatttgttcattttagttctggtttaggggaagctcagaggggcagtccgtgttctgagagtcacagtggcacttgtatctcaattttaaccagaggtttacctggtagcctgagccatgtccagggcaggcctacccttgggcaggacagggggctggccttgccagtgtggacatcgctgcttcccaggtggcctgggattcctgaggatacatccatgaacacactgcagattgctcaagtgatggacccttgtacattaaaagatggcctaatagggccgggcacggtggctcaagcctgtaatcccagcactttgggaggccgagacaggcagattgcttgaggtcaggagttcaagaccatcctggccaacatggtgaaaccccgtctctactaaaaatacaaaaattagccgggcatggcagcgtgcacctgtaatcccagctacttgggaggctgaggcaggagaatcgcttgaacccgggaggcagagattgcggcgagccaaggtctcaccactgcactccagcctgggcaagagagcgagactctgtctaaaaaaaaaaaagatggcctaataatcattgctctcatgtagttattaatggaaaaaccaaactccataaagtcttttggaggtttactctgagccaacgtgataaccatggccctgggcaacacagcatcaagaggtcctgagaaagtgtgtctgaggcggcttacagtttggttttttatatttagagaggcaggagttacaggcaaagacgtaaatcaatacatggaaggtatatattgacaaaaatacctagaaagtcccagaggttataggcagattccgagattctttaatttgcaattggttaaaggagtaaagctttatctaaaagtttggaatcagcagaaaagcatgaagttgagagaagggtctgttcaccagggtcctgggccgagtgacctccagggggcatgtgactcagcccttgcctactgtggccttgggtcctgttgataatttggtgtcttgtcacaaagagtccctttggttagtcttatgatctcttttaacatgaatgccggtcagttgcgcctaaactccgaaagggagtgggtatagcaaggcgtgtccaacctcccttccttcgtggctgggaattcagtttttaaggtttttctgggatctctttggcctagatgggatctgtgtggggcttagggttttatttttcatttacatagtgaaaatcttctctgggccagcgctgactggtgctccgtgtctaatcgtggggaggcttagctctgttttgagccgaccctgcatctcaggctggatctgcggcatcgcaccccattcctttgctctcttttaatacagtgcaaaaatcatgttgtttaattaaacttattataatccaaatgccgatcttgttacatgaacacaacctacgaagaacaatttaatgttttctcataacataatcaaattaaaaaggaagaatactagaaaggattatctcatgtcattcttcaaagaaaatgatttttcaatttaattcaattccttgggtaagtctcaacttttcgtttcaccacaaaagccacctatgggcccaccttgctgagctttccctgtacccagggctttgactgccttggccagcccctttctttccctttcctcttcctgaccagtgatcctggcagaatcagaaatgttggtttccacagtaagagagtggctggcagggagaactcagtcctcagccagaggaatgctggccgaggtggggaaatctcgtgccctgagacagatcccacgttgggcagccatctgctatgggcctgggtgggcgcatgtccaggacgtcctccagcctggcattgcccttaaccctgagtgccctagggccttgctactgaaagtgtgatccctggactagcattgtcagcatcatctgggggcttgctagaaatgcacaatctcgggccctccctagcgcctctgaatcagacactgcattttaacaaggtcccaagggatttgtgtacacatcagagtttgagaaccactgttctagctggaattacctgggctgtgcaatcagaagttcaaggttgggttatctgttgttctgcttactacgtgacattagataaggtgcttaaccttacagagaattggcctctttctccacacaataggataataaaaatgcctgccctagtgaccttatgtggttttaatgaagcgcaaaaaaaatgcaggtgaaagtggttttcggcagtgatgagcaaaggtgcccacctgggaactgtctcttgcctgcagggagataaggagtgtgctccagaatgtaaacccatgcgctgcttccttcactgagacagtcttgctatcaataataataataaaaacaaaaattggctgaataaacagtgcacagtgacatcattgatttacttttgaggcaagcttcttcatctcattgtgcaattataatgtcttgcaaaccagtgcactgcaaaaccatgacacacaggtgcattactttttaaaatttttatgtgtagagacagggtcttactctgctccaggccatagtgcagtggtacgatcagagctcactgcagcctccaactccttagctcaagccatcttcccacctcagcttcctgagtagctacagcatgcaccaccatgcccagttaatttttcactttttttgtagagatagggtctagctatgttgcccaggctggtctcaaactcctggcctcaagtgatcctcacacctcagcctcccaaagtgttgggaatacaggcatgaacactgtgccctgccaactttttatatcttaattttggaacataccttcacgtatagtatcacgtttgatccacctaacaacttcgagaaatgaacaagatagatgctattatccacttttcatgacttaaaagatacagaaggaagtctaggtcatggaacatcttgccctgggtcacacaggtagttaacagtggagtgaggactgtcccacatcctcaagtcccttgccaggtgcatgtcccttaaaccaccctgcctaatgccggcaaggcccagagggcagcacttggcccagttgcactgggaaagaaaaggggctgatgtttctttttctttatgaaatatttggggtttttggctcttattgcaggaagcaagaaatgagaatctttcatttccttacccagccttcctgttattctcttcctgtccagcagtttgtcaaagcataacagaaaacagatggtgaaaaaagatggacatatagaggctatgcaagcctgaggagctgtctccaaatcaaatggattttgtttgtttgtttgtttgtttacctaaattgctcctgggtgatgccagccctgctcactgggtgtccagccggccaagaaccagactcagcccctgcttgtgtgttgatattgtcagctcagcattcctgtaaccaggctctgggcggcttcttctgtttcagaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaaggtaggcatggtgtcttcggatctgccctggagtgctggataacaacgtgtggtgtcttcatattgagcatctatgtgtgcccaggttctgagttaggggtgtgtgtgtgtaatccttggaacagccctgcgtacatttcaccttcattttataaatgaataaacagagtcagaaaggttgcttattcccaaggtggcaggattctgagcctttctgatgccaaagcctttgccgatctttctaaacagattgacctaaggatctgcagaaagatcaatattaaaatccataataaactttcccaaatataggccggtgcctaccttcaggagtgcattctgtcatttgggactaaatattctatgttccgtgggggaaagatatttttaaaaacactgacctatacactaggagttctcactccagcaacaataggtgtgtgaggataaagccttctaaaattgcgcacacatctggggaggaagcgcgcgtgagcagttttctgggtgaagcattcataatgtttctcagcttctcaaaggaatgtgtgacccaaaaaaaaagactaaaaatcacttcttttttaaataacagttttatcgaaatataattcacctagaagtcaccctttcaaactctacaattcaatgttttttagtatttttacagaattcagcagcctatgatctaactctagaacactttcatcactccgaaaggaaacctcgtacccgttagcagtcacttctcatttcccccagagcccccggtccctcacaactgcaaatctttcagtctctaggaatttgcctgttctggacatttcatatacgtggaaccatgcaatgtgaagaaccacttctttgatgataaattcacatagcacacattcagaaaggcaagcattttcagggcaacttaagatttcttaaaaacctatagattttgtacaaaatctggcacattttgtacaaaatctggcacattttttacaaatttgaacaattgacccccaatgagcgaaccattctggtaggaccattatattcattatatctcatggcattctgggttccttcactgccccacttaatgtgagctttgcaaggagaccgtaaggtgactggaaacccactctgtcatccgcacgccgccctcacgaggcagattattggtgttagctcaagaatgaggcagagcgcccgcctgagaggctgacacagtcactcctcaaccgagggctgttctcattggagccacccccgcctgcctgcaggaggggcccacctgctttggctgcagcagtgtgtggtggggcatcatgactgcccacaagcctctgggcagcctgcggggtgtgcagaaggcagaggagggcaagtggagtcctgtagaggggacacggtctgtgcctgcagagaaatccgttttgttggtcccacgctagcaaagtgtattgaggcaaagtccaggggagagaagacttttctgacattttcatgtgggtgcccacatatcaaacaacatctctgataccttactgccttcctgacgaagctgtgatgccacctgcaagaatatggtccgttcaatcctggcgggatgctctgccctcttgaccgtgccagcactggctgtgcagtgataacagtatggtacattatttatttatttatttaagatggagtcttgctctgtcacctaggctgaagtgcagtagtgcaatcttggctcactgcaacctctgcctcccaggttcaagtgattctcctgcctcagccacccaagtagctgggattacaggcatgagccaccacgccctgcttatttttgtatttttagtaaagatggaggtctcaccatgttggccaggctggtctcgaactcctgacctcaggtgatccacctgcctcggccttccaaagtgctgggatgacaggcatgagccgccgcgcccagccatttaaacagcactgtgtgcctctcaatgtgcttcacctgtgctttctccagcgctcctcaccttgcccctgagatggatccatgataacccctattgtctagattaggaaaccaaggctacagggctctgaaattcaccatggaaatggggcattctttactgggaagtccataaagcaccaacgatgggaaagtgccataaagttcatctagatcagaagtcagcaaactatgggcccgtgggccaaatctggtccaccacttgtttgtgtaaataaagttttattgaaacacagccatgcccattcatttaaatgttagtcatatagagacatggccaaaaatattgatgatctggcccttaacagcaaaagttgccaacccctggtctagtgtaaccaccttactttttagataaggacattggggcccagaacaggaagagctttgcctggagccaaataactagttggtgactgcaaagttagcttcagctcccagacctcagagctctttacttgtggcctggaattctttacttgatagaaggtgatgaacgtctttttctttgcagagcggactcactcccctccatctggtagcacaagaaggccacgttccagtggcagatgtgctgatcaaacacggcgtcatggtggacgccaccacccgggtaaggcaggcagccggaacttcagtctgtgtggactccttgctcacacttcagaattgaatcttccacagagctttgaaaccccaaagacccagtgggacattcttctctgccacttcctagggctggcagtggagtttgaaaacactactcctaattacctgactttcccattggggatttttttaaagtttgctagacctttgagcctctgcagtgagaaagtggggcgaatgtttaatcatgactctaagacctgtctaacatgagtagttagcatgtcaaaatgtcaagtttccccagatccacacaaaagcttagctccttttcttccagcacttggttaaatccagttcaactttctttgaacttctggtgtgtgcaaggagctatgtgaatggaatctgccgtcgaggtgtctgcagtttggtgtggaggtgattgctagggacaggaaggaagagcataatttgatatttactcttaagagaggagctgggagcacagagtgcagagagggtgttttcagttggtgcgaggaggtgggcttcatggaagaagccacattttgtttcttttccccacaagggaaccatattaaaaggaagggacagtgacagtaccaggagctcccgccccctccagagtagcacagaaatgccggcaacaatgttatgctgaagtcaccctgagaaaagtctggaaattgtgttttgtctccaactgcctgcagcttccacagcaatctgcttaaaatccacgaatgttctggatctttgaggcttcacttgcgggccccgtttagtcttttggggtcctgcacagagagaccctgtcctgtgggttagaatggccttgaggatccaaaagccatcccattatggggaggatctgtgcttgggtggtctctggaatctggcaccagcttcccgggacacttgggaccaaggagctcagagggccttggcctgtcggcccaaaattcaggaaggcattaccacaaaattcagcaggacagactccttgaacagcccagactcacatgagcgaatgtcccaagcccttgcatttcaataagcaatgaccagttctcataaattccattacaccacagtcacttggacagccttttgggggtttttcaatgggatttcagctttctaatggaaaaaacctgttgtcattggagtgaccatgactccacatccccatctgccctcatctcagcacccttcccaggcctgaaggctgtttcttccttcttgaaatagctcccctgggattctgtgatgctggtctctcaaggtttccctcctcttttctgcctctgcctcactccttcggccccacttttcaccctccactttattctgggggacctcactcacctccaaagctctcagatctcccatgcactgacgaccccagcatagccctcttctcgcggttcagtgtccattttccagttgcccgcttgacgtctccccttgggtctcccacaagcatctcagcctggtggtctctgcccagcagcagccattcagcttgtcaatgtcagccttcaaggggctccctgtccgttctctctttgaatcagctgctttgggaaggatttcatgtgatgcccagctcaggacagctccggtcactccttctcatctgcttttcagatgggctacactcccctccatgtggccagtcactatggaaacatcaagctggtgaagtttctgctgcagcaccaggcagatgtcaatgccaagaccaaggtacaggggtgccccagccccgactcctgcactgacccttctccatgccacatcagggtaaagccagagctgctctgggagcactagggttttgaccatggaccctgaaggaagaaagggggaaaatgcatttcattaatgtcccacttcgaagatgggcaggcactatcatgtgtaggcaggtctctgtctagtggctggctaaccctgcctaaatgtctgctcactttgcagctaggatacagccccctgcaccaggcagcccagcagggacacacagacatcgtgactctgcttctgaaaaacggtgcttccccaaacgaggtcagctcggtgagtacactctctctcctgagtttagaaaactgctccccatggcagcagccctgtgtgaactcccctaaccgtagaggttaatgcacgtgtctagggcctggacggggccgcagcaccctaaagccacagctaccttgggtaccctggggatggggtgctgtgatcagttcctctttctggtgaattgatcgttttccttttaagcaccatttaccctcctcttttatgtttattaaaacattcttaagtgtgagtgcagtggcttacacctgtaatcacagcactttgggaggctaaggtgggaggattgcttgagggcaggagttcaagaccagcgtgggcaacatagtgagtgcctgaatctacaaaaaaaaatttttttaattatgtgggtgtggtgatacgtattagctgtagtcccagctaattgggaggctgaagtgggaggatagcctgagtccgggaggtcaaggctgcagtgagctgtgattgcgcccctgcagttcagtgtccattttccagttgcccacttgacatccagcctggaagacagagcaagaccttgtctcttaaaaaaaaaaaagtatatatatatatatatatatatatatatatatatatatatatatacacacacacacacacacacacatatacatatatatatatgcacacacacacatacataccacatatataaatacttgttgaaacccattctaaaatatgtgaaactgttttcagtatggtacaactgaacataattaaatgtcctgggtggttcctgatctttcagggctcaaggttatctttagtgacatcagcaatcatcgttcggtgtgagcttcttcatctgaccatgtggaagttctgtgaaattatctccgtgtctgcttctatctctgaaataatgtggacccttggctgggtgcagtggctcatgcctgtaatcccagcaccttgggaagccaaggcaggtggatcacttgaggtcaggagttcgagaccagcctggccaacactccagggcaaaaccctgtctctactaaaaatacaaaaaaaaaaattagctgagtgaggtgacaggcacctgtagtcccagctactcgggaggctgaggcacaagaaccacttgactccaggaggcagaggttacagtgagcctagatcacgccactgcactccagcttgggtgacagagtgaactctgtctcacacacacacacaaaagtggactcgattgtagatggggttgcagaaattgcaactgcagctgggcttgaatctgaacggagcccaaggcacatcctagaagtagagaagtcaaaagaaaaatcaagcctcagtatccatttatgatcacgtagctcttcctctttgaatcaaagtagaaaatatgcccttgctgtatttctggtgatttgtgatttccgagtattctgattagagttcattgaagtatatggattaattcaactattttaataccccatcactgacacccaagaacagactttgggagcagcaagcagccttcctctgtcctcatcttcctaaaattgcatctggcaacttcctgacctccttcccagtgggttcccacttagcagagcctgacttctccttgggagatttcctctgctgggttgcaaggccccacacttgacgctgcagatcgaaagcaccgctgccctccctcctcccacacccgtctctgtgggtgctgctgctaacacacatctaggcacacacacgtgcagggatctctttctgggccccacggtgacgtctgtccactcaggtcctcctgaacaactagaaggtgaactcgatctgtgtctagggagccagccccgcctcctagactccatcccctgtctgactgcacccgggctgctctttccccaggatggaaccacacctctggccatagccaagcgcttgggctacatttctgtcaccgacgtgctcaaggtcgtcacggatgaaaccagtttcgtggtatgtctgcctctcccccgcacccaccccagacacactcagcctggcgcacaggcgtgcctggggttactctggaagtggggtgcgttctggggctccgggacgcgggtcggaggcgccgcgcccgacgggtgggagcttgtcctccttccagcggggctgtgctgccacctagcggcccgaggactaggggcgggaccagctttccgggcagcagtggagtggatggggtttggggagatgggaagccagttttcccgggtcccgtccccgtggttcctgcccggcagcttccaggctgagcgcctcctccgtctgtttttcttcatttgtgggaaaccccacaggcatgaccagggaaccgctgggctggtaaaaaatgtgtgcggctctagtttgggttgaattatctgctttttctcgttttagttagtcagtgataagcatcgaatgagtttccctgagacagttgatgagatcctggatgtctcggaagatgaaggtaacgttggggtaaagagctcaggctggtggggacagaggggctccgggcaccctccaagggggcttcctgccacctgccggctttgtccccttacaacacgcccaagcactatagatggacactgaaactggggagacctggtttttataactgttgtctactatcaaaaatactgctctattaatacttaggtgagggaacattgactaaatttaaaatcccatgaagtttcaaaaacacatgtatgtttgcatagattatggatgtgtatgaaatcggagcgtggttctactgagatcaagtctccgcaccatgaggaactgtaataaaattctgcctggttctttctttgtgctttgaacgaatactaagtggattattcaaaatctgtgagcatgccttttaagctgcacttctgaccacatagtgggtcaataggttttgggttatttctgtgattatgaaattactatagtctggctgggtgcctgggttcatgcctgtaatcccagaactttgggcagccgaggttggaggattgcttgaggctaggagttcaagaccagcctgggcaatatagggagacccccgtctctccaaaaaattagaactaaaaattagcagggtgtggtggtgcacatctgtagtcccagctactccagaggctgaggtgggaggattgcttgagtccaggagcttgaggctgcagtgagctgtaatcaccccactgcactccagccagggtgacagagcaagaccctgtctctaaaagaaaaagaaagaaattactatagtatcagcttgtatgaactacagaatgcttctagtatttttcctacccccagcaaaccttatttcatcactaattagatggggatgttgagtagtaggatcctcaactctgaggatgttgaatagtggggtgggctggatcagctcagtggtcccttccatctggataatttcatggttgtataactttgtcaactagagaagcagagcttctggtgctcctttggataatatatgcctctcgctttaactgccttcaatgtggtccttctttcaattctgctctcctttgctttccaggaactgctcatataactataatgggtatgaaatgctttctgtttactgtggtcttttctcactagagtgcatttcaccctaagcaaccctgatgctcactaatccattcctgctttccatcttcctctgacagctaataagctggagccaggagctcagctaaaccagggaattcacacccatgagacccatgcctggcgggcacctcctgcctgtccatctttgtgtctgtgcccatgccaccgtgtttatgatcataaccgcatgagctgttgttcttccattccatcagctccagatcacaagccatggtgctcactcctgggtggcaatgaatgacccctcaaggtcgagggccggggctccagctccagttgaagctaggagagagaaacaaagaggcagtcagaggtgtaggcagccgattgacccgtagtttgaaactctttgtgataggctttggaagtaatgaggttttggctgccattgttacaaaaaattctccagccctttgaaatgagtgggtccagttccactgtaatttattcttctgttggtgtggagtggaaaagagcagtagcagttccttctttggtgccattgcacagctaaaagggctgttttgaattggaactaagcgaacaaagttctttctggctgtgtctttggcctcctgcaaagcctcaggcatctaagatgtcaggagctggctgccctgctctctatcccagagctggaggaccaggactgggcaaagacattgctcccagtctccttgcagcatcaagaccttccccactcctcaggagcaagcccccagaggcggagcgggaacagagcttttttaaaaaaagagggactcttcttcctctaccccgtcgctcacttgagctcttgctgtttcaggggaagaactcatcagcttcaaggctgagaggcgggattccagggatgttgatgaagagaaggagctgctggattttgtgccgaagctagaccaagtgtgagcagtgctcccgggagggtccccgggggtgccgagatgcaaccctgtggctcagagcagggattccagagggaggaaggacacagcaggccaggcgctgggctcgctgcccgcagagagagacggtttgcaccttaggatgagctagctctgcaccctagccactagggcaggcggaggcctccctcacaccgtgctgcctggacgcctctctgctcctcttccaggctcccctcctctcccacccaggctcccatcctctcccaggctcccctcattcacagccttatatccacaccccctctccctcttatccacactcaacttctcatccaaaagttgaagaagatggccgggtgcggtggctcacacctgtaatcccagtactttgggagactgaggcaggaggatcacctgaggtcaggagttcgtgaccagcctgaccaacatggtgaaaccctgtccctactaaaaatacaaaaaaaatagctgagcgtggcagcacgcatctgtagtcccagctactcgggaggctgaggcaggagaattgcttgaacccgggaggcggaggttgtagtgagccaagatcgcgccactgcactccagcctgggcaacaagagcgaaactccatctcaaaaaaaaaaaattgttgaggaagattcacattagaaactattgccaggctaagctcgaactcttgactgtatacctctgcccctgaggtatgttaggtacaagccaggggagatccgggtctgcctgcctggaccacatttctcatttccccctgtgactgctgtgagttatctcactgtggggcacagtgtacacagggacattttgcaaagcaatctaatatcaacgactttgtagaaacactgagccctaggtgttttctgaaaagatggaagtgtcccatgaacaagcagggagtgaaaccactgggccatttactccatttgaatttgctggacatctgttagaaagaaatacagagctgtaaccctgaccataagcaacttacggactcatttggtgggatcgaaatgcacaccaagtggtcatgtagcaacacagaaagatatattgttagccagagcgaggattctgtcaacaggttctaaaggtagagaaaggggcgacaagtgcaggttggagtcattggggaggacttcatggaggaggaggcggtccttccaccaggttgtgaagcgcagtcaggctccggagtggaaagccggagggagaggcttggaggcaagaggaagaggagctgtgtgcacatgtggatcagccctgtgatgttctggtgttcttggcacgcagggtggaatctccagccatccccaggattccctgtgccatgcctgagacagtggtgatcaggtcagaagagcaggagcaggtgagaagctccttctctgtggtttccccacatggagggcatgaaaaccctgggacagtgattgttgaggggtggcctgtacgtagcgcaataggcactaatagctcacatgccactcactgtccaactggcattccacgcttggacgcctcataatggtgcaacattggtggcgctgggtgggcggtgtctgggagagatggtcagatggggccctttcctgtggtggcgcagtccttggatgcagcccaggacagcagcagtgagaaaccagtgggtccttgaccagcccactgtcttcaactcttggcctagggtaggaactccagccagcagatgtttactggattcctgctgtgcaccccggacaggctcaggcaggagggctggacacctgcctcctgggagccggggcccaaccagaaagagtggactcggacgcatgaacccagttagcacagaaccaggagggagagcgggggagtgctccactgtgtggtgtgagtgctcacagagtgcagagcagggaggccctaaccagccccaaggtggctgggagcatctgtggaggaggtgagacgtggggagtggagaggattagatcaacaagggcgatggacaaggacgttctggaccgggggaaaagcaaacgtgaagatctagagagcagcaaggctaggttcaggtgctgctggctgtgccagggcagcctggcatccctgtagttgcagcgttaccctaaggcaagtccccgttgcacaggtgaggaggcaggaagccccacaagggcaggagtctgttgtgttcacctcgtgggctccaaatgtccacagggcaggtagtccgcccacagctaactggcgaggcggtcacggtgctgggatgcagtgcccaccctagaggaagttggcctgctgagggcagggctccccatgggcagagctggagagaagggggcgggtctgcagcaggtgcagcgggcctggggcctggagccagactgaacagtgaggactggctccacccattccaaggctctgtcccagggtcttgagccaaggagaggcatggaggtgggaggaagctcgtgcttccttttagacctcaggacggccttgtctgacagggcggtggggtcccgtgggagcactttctccacgtggcacctggtttctagcggcaaggttcttccaagcctccacgccctggcacggcatccagctggcccgggaggaggtgggacaggaggaccctttctctctcctcaggcatctaaagagtatgatgaggactccctcatccccagcagcccggccaccgagacctcagacaacatcagcccggtggccagcccggtgcatacagggtgagtggcgggcgcagggctcggggactcctgtctccatctccgagaggggatgcagaagcccaacgtgcatctgccccactcctaggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgaggtgagcttgcgcgggcagcccgtgttctcccctgtccctgtgccacggaggccacgccatttccatctgtcctgatggggaaacagaactgggtgcccctcccctttccctgacttttcctgacacacgaaggtgtccatagccctgagagggcttacaactctcagatctcaggtcgggcacgatagctcacgcctgtaatctcagtgctttgggaggctgaggtgagagcatcgcttgaggccaggagttcgagaccagcctggaaaacatagcaagaccccgtcgttgtaaaaaataaaaagcaaaaccaaaaaaacaactcttaaatattgtgtgacactagagacaaggccactctgaagcctgagggtctgaccttttatgcactgagagttcccagtaagacggcctccctggccgtttcccctgaggacgagggaagtacccggctccagaggcctgtgctccactcccttgaagcagcctgggctcctcctggagctttgctgcccctcaggcaccatgggtgtgatgtggggacaggcctgaccaggaggccctgccttctacctctgtccgccctcctggcccctcagagcggtcaccaccatttgcaaagcagcaagttttctcgttgacgtttctttgtcctcaaagtgtccctctgaaggaaatgtcattatggccagttgatagatgaggtcacccgtctagggatgtcaggtggatttttggaatcaggtgcaaggacaggatctttaggtcgtaggagcagagcccgcatgaaatgagactggtcctgccctcactgtcactgcaggcctggcggggagcaagcggggccatgggaagccctggggaacctccccatgggtctggtccacttagagacctgcctgcaggtggggcctccacgtggctgcggaagtgccttatccatctgggtgggagccggcagccccatccctccctgtgccctgcctgccttgtatgagcacctccccaccaccactgtgtccttgcctcagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaaggtaggggcgggggatcccagggctgggtcccctccttgcggaagaggggtttgagttgcaccttaaaggtggtctttgagggccacctgaagtttgggaagccccaagaggctgagaatggcctggtgtggacaagccctgggtccccaggatgtgtgagaggatgctcagcggctgcctgcagccgcatctgctctgctgggcctctgggcctgggcacttcttctggccacttcttctggccactatgccgcccggcacctggggagggtgtgtgcactgggtcttggggacaaggagactctggggcccctggaagtcctgaacctgtgcctgatgtgaccggggtggtggcctgtgtgtgtgattccagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggtgacagccctcctccccgccaggtcctgggggtggactgaactccaggcctccgggaaggccaccctcttccccaggacatccccacacttttgtctggtgctttgaaatgccacagtggagatctgagtttaaagctcaaaggagagttaagtgggaaggggtgaggtggaagctccctgataagttgcagaacccctggtaacccatcaagctgcacggcccagtctgtgcagcatgcaggaaccgcatgacctccgggagttgactgtggtgctagcaaagatgcaccagccctgggagtaagaagcagaggagaaggggagaaagggctcaggaaggcaagctccaccgtgtcggttctgtggtccaacagcagggcgggaccccgtgcactgacggccactctcaccaggcatggagctgcctcccgtctgattagcccctctcctgcttgggcctgagtgtcctgcctctgtcatttcacaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggtgagaggggcccctgcctcgcttctgttctcggctgctgcagtgcgtctggaacacagtaggggggtgactcgagaaggcgaggccagcaatccccttagtttttgttgacttccccgggagtgaggtgctcttccaagagatggaaggatgatgtatctgcataaaagtccatgcccatgtggtgactcacgcctgtaatcccagcactttgggatgccaaggcgggtggatcgcctgaggtcaagagttcgagacatggagaaaccccgtctctactaaaaatacaaaacttagccaggcatggtggcatgcacctgtaagcccagctactccagaggctgaggcaggagaattgcttgaacctgggaggtggaggttgcagtgagccgagatcattccactacactgcagcctgggcaacaagcatgaaacgccatctcaaaaaaaaaaaaaaaaaaaaaaaaagtccatgcccctggggaagaactctccaagccctaggaggaggggcatgcaggttgctaggaggaagagcagcggggtgagggtagggtgcccagggctgcagacaaagtgagcttcacccagtctcaccttgcacaccacggccttagcattttagtaagctccatgcttacatcctgaagactgtccccagccccatttctgccgctgttacaggaggaacagaccaagcccagtgggaagacataacaggaaccaccaaacttgtatatgccaacgagtgcgccaacttcaccaccaatgtctctgccaggtgagacgaggccagcccagcccagtattgtgtgggccgtcctcaggctctatgctgccgtccaggcctgaggctgaggctccctcactgtcccctccatgtggaagcctccgtgaccacaggtgtggcaatagtagccatggtatggctcacgggctgctcccgtctggatggaaaggatgctctctgttgggcacttgggaacacataactcgccctactttttaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtaacagggctgggccctgcaccgcctctgggacaaaccgtcctgccgttttctccagaacaccattaccaggtgcaggcaggcagtcctccctctgtagacgaggggctccacagctgtctgtctttgagacccctcttgagaagcatcttagagaagcttcaggaaaggagagagatgccaccatgcacatctcagaggaggctgcaggcttttggtccagtgatctatgaaaagagttggcatttgccgaaggtcttgtgcaccagggactattaaaagtgctggccatgccgggcgcagtggctcacgcctttcatctcaacactttgaaaggccaaggcgggcagatcacctgaggtcaggagttcgagaccagcctggccaacatggtgaaaccctgtctctactaaaaatacaaaaattagccgggcatgatggcacgtgcctgtaatcccagctactcgggtggctgagataggagaatcacttgaacccgggaggcagaggttgcagtgagccgagatcgcactgttgccctccagcctgggtgacagagcaagactctgtttaaaaaaaaaaaaaaaagtgctagccagctgagtatggtggtgggggcaggaaacaaaacaaaaaacaaacaaataaaagtgctggccaggctcagaggctcacgcctataatcccaacactttggaaggctgaggcaggaggatcgctttgagcccaggagtttgagaccagtctggacaacgtagtgagacaccatctctattaaataaataactaaaagtgcttttcttgcatattctcatttaattctcatatttatgggtacctttattatcccttatttgtgtattaagaaactgaggctgagaggttaagtaacttgccaatggtcacacagctaagtgagtggtggagatgggatttatccaggtcatctctggccccagagtctacattataacctgctgtgctagggtttcagtagcacccaggtgaggaggcagaggaaagggctcgacagataatgtgaagagtgaaggcatgggggctaggtctgaaccagttaccgatcctaagagacccacttgggttaagatgtgtagtaagccagcagtgatctaatcctcagaatctgcactgagttttcctggggaaggctgagggccccagagaacaagtgcaggactataaccttggttctaatcctgtcttaggcactaacgaggcaaaccggtttttctctttcagcctcaattttttcaactgtcaaatgagttagtgataacttctcagttgaaagctcacccataacaatgagtgagattaaaacagagcaagtgctttccagctcttgtcatgaacaaagcatctttggacagacataaaaacagaaccttggttttatttttagaaacaggatctcagtctgttgcccaggctggagtgcagttgtgacatcatagcccactgcagccttaaactcctggcctccagtgatcctcctgcctcagcatcccaagtagctgggactacaggcacatgccaccacacctggctagtttttttaaaaaaatttgtaaagatgaggatctcctatgttgcccaggctggtctcaaactcctgaacttaagcaatcttcccactttggccttctaaagtggagggattacaggcgtgagccaccatgcccagcccagaaccagggtttgttgttgttgttgttgttttcagaagctatgttatgatattcaagtgaagttttggaatacttgatagcaattcccatcaacatctcagggatatttgaagatccctacatattacaaaatctgttgaagtcgggaagcatgcctcattgatcacaattttggaaataaagcctttcccaaaacaaacagtggatttctcagcacacacccgcatgcctcttgctgaggcagggtgtgtcttggagagggaaggaccgaaggtggaaggagggacatctgggcccttctctccctgacaagctgtatctgcttttcctctcctgcaggtgttggaaggaatgtccctgtttgcagaactctctgggaacctggtgcctgtgaagaaagctgcccagcagcggagcttccacttccagtcatttcgggagaaccgtctggccatgcctgtaaaggtgccggcaccctctggctgagttctcctctgggtctagaaagttggggaggcagaattccctaaaccagacagccgggtggcctagaaaagggcccctgaattctcctttgtgtgattgagtttaggtgagggacagcagtcgagagccgggagggtccctgtcgtttctgcgcaaggcgatgaagtacgaggacacccagcacattctctgccacctgaacatcaccatgcccccctgcgccaaggtgagctggcacctgccgaggagccttggcccgagacggcttccctgtaggaggtccccaaacagaccccaggtccagcacttccaaggggcttcttcctggtggaagcttagagtcccccgaggcatgcaaaggtgctgagctctcctccacatgctcatgttgtggcctggcggggagaccatgccctggccctctctgcaatttgcagtgcagtgctggtcatgggacaggaagaacaaatgttggtatcagatggtgatgggcacattcacgctgtggaccctgggctccctaggtgtgaaagtgacaaggggccctaagggcatctgcctcggtgtccctggcccgaggcctctgaggttcacaccaaggagagctgctaaggtctcccagcccctgcacggcttctctcaggccgctttttcatctacctgcttatcttcccagggtgctaggccctcacagaagggaagcctggtgtcctcagccactgcaaacacccagggttttgagctcagcaaaggagtcttggccacgtatgttcatttgtcgatacctgtaagagtatcccagtcaccacctctgctggggactttggagggatcatacgtctccagaccgtctctgtggttttcgttgctgttgttttgctgctgttgttgttttaatcattagccttccatgctaaactaggaaagaagcaaggttacattcataagtccatggctcaatctctcttttctttttgggcatgagatgagggtgaaccaacttctttttcaaaagaggattttcaggctgggcgcagaggctcatgcctgtaaccccagtgctttgggaggctggggcaagggattgcttgagcccaggagttcaagactagcctgggcaacatagtgagatcctgtctgtacaaaaaaaaaaaaatgaaaaattagctgggcatggtggcatgcacctgtagtcctggcactcgagaggctgaggcagaaggatcacttgaggccgggagtttgaggctgcagtggagccatgatcgtgccatcgcactgcactccagcttcagagacagagtgagaccctggctcttaaaaaaaaagagagagagaatatttttctgcagccttgggcaaatgttcggatgcttttccacagggctgtgatgttaaggccttaaggcagtacagaaacgggtctttcaagcagaaagaaatccaaaaagaaaaacaatcattttaagttcaaccccagctccatcgcatattaactgggtgatcttgggcaaggaactttgtctctctatgcctcagtttacgtattgatgaaatgggagtaatacagcacccacctcttaggttgccgtgaacattaaatagggcctcacaggtgatggggtgacgtgggcttgccgttattacgactgtgattaataacgcatgtgcgcttcttcagcttcccttcactcccactcctcccatgtgttactctttgtgttaagtccctgaagaaacggactgattgtttaccaggactggggtcagccttccacacccctgcagcataggagctcagatcactttctctgggaaggtggggagagtccaaaacccaaagcaccctttcttcttctgcagggaagtggagccgaagataggagaaggaccccgacgcccctggccctgcgatacagcattctcagtgagtccacaccaggtacggcctctgtgtgatgatgcatgcttgctcccttcccaagaagggtgggcgtgagctcatctccccgcagccctgtgagggttctgctgaggtgccgctcgctcagccagttccaaaagcagctgcagagctgactcgggtcttcccctgatcttgcagagagtctagacaatcaccccagtgcacacggaagccacatccatcacaggccgtgtcctcaggcctgtcaactgtgtcctgccctggctactaaatgaaatctaatgcttctccccaggttctctcagtgggacagagcaggcagagatgaagatggctgttatctcagagcacctcggtctcagctgggcaggtgagtggggaattgggggcagaaaagcactttgtccatctcacctaccctcttcccctgtaatgagcaatgaatgaggcatttctaaccctccttttatcacccgtgggttatctgatttgtgattgtctgagctgggtctgctgcccaagccacaccattggctgcccatgaagggggagccccctgcctccatctctgtctgactttcctttctaagaaagactcagcttttgagtttacaggagaccttgaaaaggagggaaggaaagggcaagtctcaacatatttcgctatggtctgtggctgtggctggatctcacagaagtcctgccaaccatcagggtagatcttattttaagggagacaggtgggcaaataaagtgaaggctcagaatgtgctgtgcccaaccacagaccctagaactggattctccctgtgtaaccacagcaggtccattgcccaatgtgagtggcaagtcaagacacacggagacacggggttgcagcggtgaaagaggcttaatcccaggaccaccaaacaaggagggaggaggaaacctcaaatccgtctccccaaggaggagttcagggctcgggctgttaagggctttggagtggctggagtgtgtaggtggttgattggttggagagtgcagggtggagtcatggacagggagagcaagaagctacgttctcgtgctgatccctgccttcaaagtggttgctggaattgggaatctgaaaaccatcttaagggatccttaaacagaagcctaatgtcagaaaccctgtctttaggaacaatgggggtgcgagtggtcagtatccagcactgtgtggctttgagcaacaaagaagaggacccaagcgcagcttggtgaatgcttaattataaccgtatttctgtccagagcccggtgctcaattcttgttgacactgagatggcttccccttcccctccttattttttgttagcttttatatgagtggactcccttcattcacttcccctggagaacactttagacacactcagaaaccttttggcaatgacttgtggaaaggccgtgtgacaaactcagaagttcagtcacggctccttcttttaatcatgactgctggctgctcagggggcgtgtgtgtgcatgtgtgtatgcacgtgtatgtgttgtgagtgtgtgcacgtttgtgttgtatgtgcgtgttctgattctcaccatcactttctccccagtcttcttcatccttgaaattagactctaatgctattttccttctaaagcaataacaataaaaataatgggggattttggctaacagtctgcattattgccttgcatttagatgggaacttgtattttcattttaaatgtaaataaagcctctccctgaagacgcataagctcaggagtccatttctgttctcattggttcttggcagtagggcatggcgtggcccaggcagtgctggggtgagaatcggcaggtacggctgcctcctggctcagggacttgctggctctgtgaccttgcagaagttgctgaccttgctgagagttcatgtcatctcatattggaagttacgaaaggaagaaaggacatttgatcattcattcattcaggacctatttaacaaacacccctcccattcttccattttctggggacataaaggtataggtgctggcatttcataaggaatttcttgataagaaggaagaccaaacccacagggaggctgcctcagagctccctgtgctccccactgggtccccccacgccccagtgcccacccagcctgtgtgctggaggccccctgctgttggtgagctggaggctcacatctgctgttggttctttgcttgcagagttggcccgggagctgcagttcagtgtggaagacatcaacaggatccgagtggaaaatcccaactccctgttggagcagagtgtggccttgctgaacctctgggtcatccgtgaaggccaaaacgcaaacagtcagtaccgtcccactgaggaagcctgtcctaggacctcctccccaccaaactagttcttccttcaaattccattcatgacactggcctctggagtcagtctgtctctgtctctctcacacacactcacgcaccactcgcatcaggaggtcttccaggcagtcctgccagaaggcatgaccagagaagcttggcctcagcctttctcacatccttggaataagataaaaattgcaaggcctggcacagtggctcatgcctgtagtccccacactttgggaggccaaggtgggagggtggcttgagcctaggagttcgagaacagactgtgtaacatagtcctttcaaaattagccaggtgtggtggcacacacctgtagtcccaactactctggaggctgaggcaggaggatcacttgagcctgggaggtcaaggctgagtgagctacagttgcactgctgcactccagcctgggcaacaagcaaaatcctgactctaaaaaaaataacataaaaattgcatcaggactcctagatgacaacatctgtgcagggtgtatgactcatctttgaggtcttcctgttgaatttcccaagcaaatgagtattgtcctctcaggacacagtctgggtgagctggaccccagtctgaaccagttctcattctcccaggagcttcctccaacctggagggagctttgcctcattctcttttcagctcctcctcaaccagtttcccagactcaaaaacactaagtggaaattgagtgtttacatttgcatctcaaatcatctggcaaggaccaagaatttcaaaaggacagaatctaatcattctcatccttattttcttgtagtgctcctcttagcttacaaaataataataaaaaaacagtctttctagacttttaaattggccactgtggtgggcacggtggctcatgcctataatcccagcactttgggaggccaaggcaggtagatcacttgaagtcaggagttcgagaccagcctggccaacatggcaaaaccttgtctctactaaaagtacaaaaattagcagggcgtggtggcatgcacctgtaatcccagctactcgggaggctgaggaacgagaattgcttgagcctgggaggtggacagtgagccgagattgccccattgcactccagcctgggtgacagagtgagaccaataaataaaataatttattttttttttggtaacagagaccaataaataaaataactgcgcactgttagcatttggaaaagatctgctgaagtgtaaaaagtattctccccagaggaagtttgttttgactctaataaaagagggtgcctccaccttctgaaaaaaattatctcctttctccatcttcatcctggccccattttctgagcccatgtgatcctcgctcaccggcctggagtaacgtgcatctctcttctgcgcccacagtggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggtgagtgtcacctggaccagatggggactgagccggagccctgccctacaggcatcagcaccaataaccccttcccacaatacgtcatccctcaaagcccgctctgcctcccattggtgggaggtctggtttgtcagcaacaagttcctcctttccggggaagcagaggcgaaggagagagagatggctgctcctgtgcaggtgggcatcgcctccgccttagcctttgcagccctgcagaatggcccccaggcccttgccatcagcaactgcgtccccacagggcgtggtgtatgagaaaaagctgagtcagaggcctccagctagagactgcccctacacagctgcagactttccggtagctctttgcaaggcgtgggccctctttggggtgtcagtgtccccatctgtaaaacagtcagtggttgggaagcagagggcatggagattcctggcccaaggtctagtgcagtttaactggacggtgttttacaaatcctgctgtggccacttctagggactgagcagtttgctcttcctggagccgggtctctctgctttttcctctcccccttttctatcatctcatctccttcccctcattctttgttgatgtgactcagcatggcagggatcccccgtgagatccagcccaaggagaggatgtacaggaggctgtgacctctgcccccaagcccctgccactcctgggccaggccccctcgcaacaccttcctcgcccgccccctctctggccagcgggcacataaacagcgaggccccactctccggccaggaggtctgggttctaggcccttccttcctgccaactccctgcatgactgagccctctccccttctgtaaaatcagcaagttggattggatccctaaaattccttacagaccttgaaacaaaatttccatgtctgtgacgtggcttcctcaggtggctgacgcgtcaccctggatgcctgcatggtgatgtgtatgctcctcaagctccttgtcttaggggccatccccgccacgcccaggctgagggtgggcacctgtgactgggtacacagtttgggggcgcggctgagggcgagtcccaggtgggcctgggcacggagcccctaccaggggaccctgctcgctgagccctccctgtcccctgctctgcatcctgtgtctcctgaagtgtgccatcttgcatcctgggagcagggcccatctgctgatcacgtcccattgcctctcttctgcctctgacctcatcttgacctctgtgcactcacgctatcgtgctgcctgtctccactgtctccactgtccccatttcggcaggcgcagagccggccacgtccacatgcatgtcatggcccccagccctgtctccccacgcatctcatggccatgtcctgggtgtacttgtgtgtgtgcgtatgtgtgtgcatgtgtgcgtgcatgtgtgtgtgtgtgcacgtgttcatgtgtgtgcgtgtgcatacatgtgtgtgtgtgtccgtgggtgttgctgtgtggtgctgcctgctgcgtgtgcccggcccactccccaggtccacccccttggggattccagcctcccctcaggggacctggccagagctttacaggagctcagtgggctgagggcggttgagggaagccacaaacctggggaaattctagtgacaaagctcctctcccttcccatgtgtcgagacttctttgacacccagcgcatacttttggtcaagtcagaggggcacgcttttgatttcctgtgccctgattaagcacctacaggacaatgggccaccagagccacatgagtgtgaatattcacagttacagacctgggcatctgtgagcatctccccgggccacagacccctagctcccaccaggccttgaggcattcttgcccgagtggttctcaattcctgtgtgggactgggcctgtgcactccatgtctgctgaaagggctctgcttcagggggtcagcccatttggcaaatatttttcaagtatcaaccacatgccaggcactgtgctaggcaggagagagatacctgttctcaaccagacaaaacaaaacaaaactctgcctttgtggagcttttccctcctgtgaggagagccacgcggggaattgtatcacacaccagcagttaacgtgcatggtgcaggagaaacagaccggagtcggggccagggggactcatggtgcaagggaagcgggtggcactcgaggacttgccagagatgaggtgggagccatgcgtcggcactgaggtggaagatttcagagcagggagtgtgaagggggctttcctgatgcgttcacaggacggggctggaggcgggggcaaagggacagtgggagagagggcaggtgtgggggctggaggggtgacacggagcccacccatagactgtcatgaggacattgggtttgacttggagtaagctggaaagccatcagagggttctggccaaagagtggcatgattgcccttaagtctttgagggagccctctcccgagtagttgatttcagatggtcacagtcgaatgttctgtgcttcctggctgctctgtgcagcctcagcagtccctgacaccctctctggcaggtccccggtagacccagctctgtgccccagcagactcatgcaccgatgccctgctttgtccagaatcagcttctttatatttttcctgccttcttccttgccccagaaagtctggccctcatctgggtgcccttgtgttctggagagaaggtggcaggacagtcagaggtctaaggggggtgggggggcactacaggctctgcagcttctctgctcttccctgggcagggctcgtgatggcctgacctggtgcccaaccagcccaatgcactgatgcccacagtcggaccttggctcctctgtgcttttcctggtccctctgcatgtctgagcctccttctgaggccctgggactctgggtagtgataggcagctctgtgagcacgacataagtgggtggtgtccaggaattagaagcctgaggctgtctctcccttcatagctctgctcaccaccagtgccttaattggccagagcagaggggctcaggccaaaaggccagcgtgcttctcccacataggagaggacggcccaggccctgggaataaacatgaagaaagcatggcctatagatccaaaataaaatagcatgtttctgaaaataaaacagacttcccttatgagaggagaaatgatcatctcacacccgtgtgagttccatttgacctgataaatcagacacaaactaatgtctacttggaaataaaacttgttttatttccctcaattcttcacaactgtggctagtgaagtgtggccttgtctagggtgaggctgtctgatgacccctgttgcccatttgctgctgacgttaagctagcaggacgattattacctctgggtcagcacagaaccagggcagtgacctggaatgagcagggaccacttgactgtatgctgccccaaaccaatatgtgtggctgccttttacctgacttctccaacatgtagccccaagaggaggcctctagactgagggaggggctggtgacccaggtgtggtggggctgcatgagactaccagagagacagacattctggaactcaccctgggggatccagtggatctgcctatggtctggtccaccccagacctgtgagatgttcctcatgaggatgcacttgtgcttctgcaagtattgctgcagcttcacagtgactcccaccagcaccagcaatacagctagctacctgtggccttggatctcagccagcatggctgggagagggagcagctgggcatgtaccctaaatgctgttaccagggaaggactcccagagtgaagacaagtagggacttcctgcagaggtggtacatgtgctctctgtatccatactttttttttttttttttgagatagagtttcacccttgttgccctggctggagtgcaatggtgcgatctcagctcactgcaacctctctgcctcccgggttcaagtgattctcctgcctcagcctctcgagtagctgggactacaggtgcccgccaccatacccagataatttttatattttagtagagacggggatctcaccatgttggccaggctggtctcaaactcctgacctcaggtgatccacctgcctcagcctccctaagtgctgggattataggcatgagccactgtgcccggccccttacatctttatttgggtgaaattccactaaagcaaatgccgtggaagtctcaaggtgggaaactcacaaaaggaatccatgaatgagcctcaagtgttctgtggcgcaaagctgccctctcccagttctcaagtctcatcgcaattccaaggagtgatggaatgttcatccagccaaatccaaggagctgtgtcaggtgcgatgtgtgccacttctggccaagacaggataacagggactgaatataccctcctgcttgaaactactgcagaccaaaaaatggacacactatatgagacaacagttttcaagacattggatatcaaataacaaaggacactgatccacaaagcatgggaaataaatgaagtgagccctacagctgtctagtttaccattttgaaagtccaggaaggccgggcgcggtggctcacgcttgtaatcccagcactttgggagaccgaggtgggcggatcacgaggtcaggagatcgagaccatcctggctaaacacggtgaaaccccgtctctactaaaaatacaaaaaaaattagccgggcgtgatggtgggcgcctgtagtcccagctactcgggaggctgaggcaggagaatggcgtgaacccgggaggcggagcttgcagtgagccgagattgcgccactgcactcccgcctgggccacagagtgagactccgtctcaaaaaaaaaaaaaaaaaaaaaagaaagtccaggaagaccaagacagctggagttctcaagacagagcaccagagaggagacagttgcacagatagaacactctggagtcccccacaagtttcagatgagtattagccagctattcccaattgatctctcacggcctttgttcaggggacaaagaaggatctcatctcacaaatagggaaaaattaacccccaaagctccagtcctccctgataaaatttgaaagcaaaatgcaaaaggatcaaactgcttccaagtaacttaactgcgtaacagaacaaagctcaagcatacacggatacaaaaacatccagcactccacaaggtaaaattcgcaatgtccagcatccaattaaaagtaatcagacacacaaagaggcaggaaaacaggatccataatgcggagaaaaatcgatccattgaaactgacccagagttgacaaagatgttagaattagcagacaaaggactgggcatggtggctcatgcctgtaatcccagcattttgggaggccgaggtgggcggatcacctgaggtcaggagtttgagaccagcctggccaacatggtgaaaccctgtctctactaaaaatacaaaaaaattagctgggtgaggtggcaggcgcctataatcccagctactcaggaggctgaggcaggacaatcacttgaactcaggaggcggaggtggcagtgagccgagatagtgtcattgcattccagcctaggcaacaaaagcgagactctgtctcaaaacaaacaaacaaacaaaaaaagaattagcaaagatactaaaacggtgattgtaactgtatttcaggtattcaaaaaagctaagtagagacatggaagatattttttaaaggcccaagccaatcttctagagatgaatgtgtaggatcaatacactggatgggattagacattagacactgcagaagaaaagattagtgaacttgacaatacagcaagagaaactccaaacatttttcttttctttctgttttggagaaacacaaagtgagctatggggcaatttcaagtgacctaatatgtgaaattacagttcccaacagaaaagaaggaagaaaaagtattgtaagaaatttggggctgggcacagtggcttatgtctgtaaccccagcacttttggaggcccaggtgggcggatcacttgaggtcagaagttcgagaccagcctggccaacatagtgaaaccctgtctccactaaaaaaattacaaaagttagccaggcatgctggtgcatgactgtagtcccagctacttgagaggctgaggcaggagaatcgcttgaacccaggaggtggaggttgcagtggaccgagattacattactgcattccagtctgggtgacagagttctcaacgcaaaaaaaaagaaaaagaaaaaaaaagaaatatggacagaaacttgccaaatttgataaaaatcatgaagacatagatccaacaagtttgatgaactgcatgcacaggaaacacgtgagcaactctatcagggcacattattagcagactggtcaaaaccagtggtgaagagaaaaatcttaaaagcaatcagagggaaaaaaatgtgttatgtacaagggaaccaaaataagattcacctcagatttcttattagaaacaacacaagccaaggccgggtgcagtggttcacgcttgtaatcctggcactttgggaggtcgaggtgggtggatcacttgagatcaggagttcgagaccagcctgggcaacagggtgaaactccatctctacaaaaaatacaaaaattagccgtgtatggtggtgcgtgcctgtacttttagctactcagaaggctgaggcaggagaatcgcttgagcccaggaggcagaggttgcagtgaaccaagattgcaccattgcactccagcctgggcaacgggagtgaaatcctgtctcaaaaaaaaaaaacaaagaaaaaaggaaaaaaagaaacaacagaagccagaacatggtgtggcatctttaaagtatgccacatctttaaagaagaaagaaataacatctccaaagtaacctagacttctatacctagcacacgtaacttcaaaaatgaaagcaaaataaagacttttctaccttaagaaattagaaaaagaagagtaaattaaacccaaaatcatagaataaaggaaataataaagatcagagtggaaatcagtgacacagaaagcagaaaaacttggagaaacttaatgaaaccaaaagctggtgatttgaaaagatcaataacattgataaacctctagccagactgattatgaaaaaagagaagacctgcagattaccaatatcaggaataaggaatatatactacctatagaatatctacagattctataggtagtaaaaggacaataaagggatattatgacaattttgtgccagtaaattggaaaacaggtgaaatcaacaaattccttgaaagacacaaactatcaaagctcacttaggaagaaatagatatagccccatataaatgaaagacattaaatgtatggtttggaacattcctacaaagaaaagtccatgcccagacggcttcactggtgaattctaccaaacatttaaggaagaaacaacttgtttagaaaattgaaaatgagaaaatacttctcaattaagtttatgaggccagcattaccctgatattgggaagaaagacaattaacaagaaaactgcaaaccaatatcatttatgaacatttatgcaaaaaatctaaactgaaatgaacttggattattaccttgtatacaaaaatcaactctaaatgggtcatagattaaatgtaatatctacaactataaaacttctagaagaaaacataagaaaaaaaccttaaagatcttggttaaggcaaagatttctcagatacaacaccaaaagcacaatccataaaagaacaaattgacaagttgggcttcatcaaaatcaaaacttctgctcttcaaaatacactgttaagaaaatgaaaagacgagctacagactgggagaaaatattggcaaataatcatctgctatagtattggaatatacaaagaactctcaaaacttaataataagaaaacaactcagtttttagattgagcaatagattcgaacagacttttcacccagaatatatacacatggcaaataagcacatgaaaatatgctcaacatcattagtgattagggaaatacaaattaaaactataaggaggtaccaccacatacctaaaagaatggttaaaattaaaaaggctggccatatcaagtgttggtgaggatatgggggaactggaactctcatacaccactggtgggaatgcaaaatggtacaaccacttgatcatttctgacaaagttaaacatatacctactgtacaatcaagtcattccattcctagctatttacccaagagaaaagaaagcattatgtccatacagactagcatctttacttgtaatagccacaaactggaagcagcccaaatgtccattggcaggtaaataaatttacaaaccgtgatatatccttccaaagggctatggcttagcaacagaaataaattattgatacatgcatcagcatggatgaaacccaaattgactacgttgagtgaaagaagccaggctttaaaaaaagagagagtgcatactgtatgaatccgtttatgtaaaatcctgggaaatgcaaactgatgtgtagtggcaaaaagcagatcggggtcacctgggaatggtttggggttggcagagggggaaagggcagggagagattacaaagaagcttgaggagacctttctggggtgacaaatgtcctttttcttctttgaggtgatggcttcatgggggtacacatgtgtcacaacgtatcaatttacccccttttaaagatacacatttattgaatgtcaaacatacctcaacaaagctatttttaatagagattaatggcaaagtctatggaaaagaccaaacttactagctgtatggccttccgcaagttgctaaacctgtagtttcctaatctataaagtaggaattatattattttcctcatgtggttgttgtggcaattaaaaacatgttagatatgttttgcactaaaaatacgctcagtggccgggctcagtgactcaaccctgtaatcccagcactttgggaggctgaggcaagcgaatcacttgaggtcagcagttcgagaccagcctggccaacagggtgaaaccccatctctactaaaaatacaaaaattggccaggcgtcatggcgcatacctgtaatcccagctactcccagtggagaggctaaggcaggagaatcacttgaacctagaaggcagaggttacagtgaactgagattgcattactgcactccagcctgggcgacagagcaagactctgctttaaaaaacaacaaaatgctcagtaactgatgtaaataatataaaatgctcgcaagagtaataagaaaaataatcatcagttgaccccaaaatgtcctgcttttgtatatgtggagggttttctatgaagggtttgaaggccatggccctggtcagctatataattcctcaagtcacagtttcatgtacagtgacttggagttcagttcatggtaagatgtgacccacccatttcacctactcttcccactccttcctccttgttcttcctagtttggccagagctaaaaggggtttccctcagtctctgccgctgtgcagcccttctcccaaccaccccaccttcacgggctcatcctccccgctcatttgggacctggaaccaagtaggcttgcagggaagaaaacttccctgggagattaagagaatgcatgcggagtacacagcatggctccgggcacgttgaacacacaggtacatgttagcaattgcagttccactgaatgtgcctgaggtctttctgttccagctgctgggtcctctcacacacctggagagctcttcagtggtcatggggctagtggaggcccaatcctgttgtaggaaagggtggggcgaggaaggcaggcatcagccctgtcctcatgggtttgcatttctgagaaccgccttagcgagggaccctaggacagcctcagagatgggagggagcaacaggagctgaagctgggaaaatgccatgagacaagaagctgtcccatctgtgagtgtgtgggtgagagagagtgtgtgagtgtgtgtgtgtgcatgtgtgtttggggtttgtcatccccattcccatagcacagtgcctggcatgtaatcggacctctcttattttggttgaacagtgagtggatgagaataaatggagctagtgatgtaaaagcaggggagcaggtgatcaggagctgaggccccgagcggaggctgaggccccgagcggaggctgagggggcaagaaaggagcccgcctggcttgaatcaaagcacagcccgggggcagttgcatgtgagtaggagtgggggtaggggctgaatggcagaatggagcatttgaactaggtttgaactctaggctgggggtgtctggacatctctcgatggcaggaaggtccctagagactgcaaggggcagccctgcccattcccagggtcccccttcagctctgtgggctttccagctgctgtaagcacgtacttgcttcctgatttcctagacaggccaagcccattggagaatcttgtcttctagtctcttctcccacccacagaggcacctgctctgaaggggcatcagagtcctctttttcctgtcaatgcacgggtcatgcactcagggcctgagcgagctggctcccatcccaccaggtcggtgctgacctgcagctgggacaagcagctcagggctcttggacacagggttttggggcgggcagacctggtgcctcttggtgccttctgaccttgccccttttgagccctaagagccctcccctgtagcactttagatcgtgcagagtttctggaaccaataggcaacttgaggaaagtgatgcctggccacaccagaaggttgtttcccatttgaccaccacagtgaggtctatgggtgtttagtgtaccctgataggcccctcaagggcagcctggttactacccctggttctgggtggcctttccttccctttaaggtacatccctgagaacctaagagctaagctaaagtgaagttttgagtagaggagcaacgtctacttctgcccagccatggagaagtggagctttcatgggatcagagacagattggagcacaagtcctttggataaaggcttctttatctagtgctctgaactggataagaaagtccaatctcctcttcgccatccagcagggcgctcccccatctctgcctcacaccctggctgcccccacccaattcagagccttgcttctcttgcctggatgcccaggcagcagccacaaggcctgagcattgggcctggagcttggaaagcccccaacccaccccgaatgtgcatgcatctctgtggccgcacccgcatgtgtgtgttcgtgcgtgtgcgtggacctgcacgtgaatgcgtgggacaggaatcactgctggagcatgttgccctctgtctgcccatccaggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacaggtaagagcttgactgcgggagcagggtccctttttgtcttctgggctcctgggtaagattatgcctggcagtgaggacagaggtgtcgatgccaaccctgaccctgggttctaattgcacaggagcacatacattcagtctggcagatgccatatataagagcataggtgccatctgcaaaagccagtgcctccccaagaccccaccaggtatgcccggcaggagagaccccgaggagcactgggagagcacacatagggacatatgggcgccgggagggctcacttagggacattagggcaccgggagagctcacttagagacatgagggcactgggagggctcacttagggacattagggtgcctggagtgctcacttagggacatgagggcactgggagggctcacttagggacattagggcactgggagggctcacttaggacatcggggcaccgggaggactcagggacatcggggcgctgggagggctcacttaggacatcggggcaccgggaggactcacttagggacattagggtgcctggagtgctcacttagggacattagggcactgggagggctcacttagggacattagggcactgggagggcttacttaggacatcggggcgccgggaagactcacttagggacatcggggcgccgggagggctcacttagggacatcggggtgctgggagggctcacttagggacatcggggtgccgggaggtctcacttagggacatcggggtgccgggagagctcacttagggacattagggtacctggagtgctcacttagagccattagtgcacgggaagggctcacttagggacattagagcaccaggatggctcacttaaaagagcaatcatgaggctggggaagaccgtgggtcagctgctgctggagctggcgttcggagctcctctccccttgcgtgcttccggttgaaggccatatttagttgaagaccatatttagaagcaccagtacccagggaagttatttgtgtgcagtcacacagcctgcatgtgacggagctgataatggcgccctccccacttaccccctttgaaggaggggctggtgggcttaactggggcaggacggagctttcagctgtagagcagtgggtgctctcttccccacgcttcccgcactgagaagcccccgccctgtgccgcagcagaaaagcagcgtcggcaggtcaggagaaggtgatgcatttcccagacactgcaagtctgcggccgaggaccggctcaccttggagctctcatcgtcccatctgggccagggcctacaccatgcccctccgctgagtgcagggaaggatgccaagacaagccaggcccttgccattgtagaaagagatgagacagacatgagatggggctcacgttgtcctcctgggctagcacaggaagcggatgacagaggaatcccctttcctccaggtcaccttggcttgctgagttttccctaaagtaaggacatggttcttgtgcccccaggcagctgttccaggcccccaccccaaggagctcaggactggtcaggtaaaggaaagctgttctcatgtcctttccccacctgtgtgacccctcagtcccacctgtgtgacccctcagtcccaccctgaggcccaggctagtggggccattccacaggatccatgcagcctggccccaataccctaacaggaagggaaaggaagtcgtttggaagttgagacagcaaagatttaattttttttcctacacaaatctttggattcatggggaggattgaacagatggagcttaggctggtttaaagtgaaatagtggccttcccgggagagagacaccttcctgggacggccattccttcaacaagcatttattgagcacctgcaggggctgcatgctggcccctgcattaccgcagcagtgttgctaactgggttcatgaacgcctgggctctaggcctattttgtcacttcctggtgctgtgaccttggtcagccttctcatggggacagatgaatttcatccacttactcaacaatatttattgagtgcctactgtgtgccaggcaccaataaagagtgcctgggtgccagcattgaatgaaacagaaaaaagtctctacctgcaagaagcgtggttctagcagggaaactaactagaaacaagataaagtaaataaaattagaagtcattaaaacagaaattctagataatacgtgctaaaaagaaaaatcaagcagagaaggaggacaggaggtaggcgtgtgtgtggaaagaaggctgactggaattacagatgggtggccaggggaggcctgcatgagtgccagctgagagacttcaaggaattgagggtgagggtgaggacatctcagggaggatgccccacagaaggcctagccctttgaaggagaccgtgcctggcacgtgccctaacagagtaaccaagcccatgaagctagggagggaatggtgagcagggtaagctgcacctgccttgagaggaggctggcgcaacctggcagagaagcaggaggtgtgtcgggaggaaagggccgtgggcttgtgggctgggacggcagcggtggccgtgctgagaggtgggcgggtgcagggcatatttcagaagcatctgctaacaaatacaatgtggggtaagagaggaagagaggggtcaaggagggcagtggtgtcctcgacctgcccactgcaaggatgaagataccagggatggcagcagggatggggtgggacaggctaggggagaagattttgagtgtggattggatcgcactgtcctggagatgccaagtagagatccaaagtagacctgtgagccagaacccatctctacaaaattttttaaatagctggacgtggtggcgtgtgcctgcagtcccagctactcaagtggctgaggcaggaggatcgcctgagcccaggagtgcagagctgcagtgagctgtgattgtaccactgcactgcagcccgggagacagaatgaagccctgtctcagaaaacaacaacaaagtaaagatgtggaggaggcagcggggtgcacacagctgtaggtctaggaggagagccaagctggagacacacatccaggcacgctgagtgtagagatgggctttggaaccatgggatgaatgagcttgcttaggaagtggatgtggacagcggtgaggtctgagaactgcaccccggggtgctcctatgttcagaagtcaggaaagctaggaggaacaagcagaggacatggaacaacagcggccagagaggaagggggagacgccaggctagcaccttccaggagccatgggagaatgtgtcttgagggggagagaatgaccaccttgtcagatgaggactgctgagtgggaagggcctggagagcagaaggaggtggtggcagagtttgaggatgtgggatgagagtgtggaggccccagtgtttggaccattagggtgagccaagtgctctgggagccccaagggcaagctgttcacccacagggagggaccagtggcctttccacctggacagcattagatgggccacgtgtacccctctgaaccacagcagtgaggtgagcaatgtgctcatgcgcccctgacctttggagggatgggaggacggtctgtgtccttgatgagccagagctctgggtggggagagtgtctaaaaggaatgagactgatgggtgaccaggtgtcttttctctctccccggccggccatctgctgcttcttctggaccccagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggtgagagcccgaggggagctgcgtgctgctgttccttcccagcatcggaaggggccgggactccagggctgcctctcaggcactcaagccctgagctaagcatatccccttcctttaacacttgtggtggtgcttccgtttctctagaagtcaagggcaaggcctgcctttctgcctcctggatccctgctaaggcgcctgtacctgttgggcagctgctgatcagagtggctgagcaacttgctcaagatcacagtttcagaagtgggctctaagctgggtctggctgactccaaagttgtggcttttgttggttttcttgttctgtcgcgttttagaaagggctaggaaccgagcactgggcgttgggcttactctcctcctatggtgacctgggtgacgtgcccaaggcgctctcttcccagcacctcagggtcctcactggtaaaggagggagtgattggaatgtcgccaaagttacttggctctggaattctgtggctattcacgtggactctggatggcggtcaccaagtagaagaggggccctgggatagagagaagtctcctctcctgctcctgatttcccaggcctctccctctcctggccctccctcctttcttccacttccccggattcccttcgagtttgttgaactttattttgttcgattcaatcccccttccccattcccaggccccatgatgatctactcgtggccaatcttgtttcatctgcaccccccactttctcccactgactattatttggaagcatatcctggccatcgtattaatgggtgtcttttccatttgtgttcttataaaacatgcaccactgttctccacatgcgtgtgtttagtatgtacatgaacgacatgttctgtctctgttttcacgcctcatccaggcatggtgcttcctcctctcctctccttcctctctttctttccttgtctcccttctttcctacctgaaccttagactccaggactagggtggctctggaaggaaggccctgagctgccagccatagaactgctaggaattcagtcaggttttatttagaatgctcccctgccaagtatgtgccccgggcagggccagcgcctgtgtgcactcctcaccacaggcggcccgtccgtttcttccatcaggccctcctgggcgcctagttctcctgctcccagagcacacatgatcttaactgggtctcttctcctgaatccctggggaaagagaaagacgcctacagcacttttttccactgcccctctgtggtcagcctttggtgaggggaactggaagggccttctagatcacacatccaactccctcaattataaatgagggcactgtggaccagaggagccaagggctttctccagggtcacacagtggaccaatgtcagggaccaggagggtccagatccctcagttcccaagccctacatcctcacgtccagcatgcacgtgcaaggccagcatgcccagcccggaactggagacgccgatcagagggcctggcaggctgctgccggtgcccatctcacaggccccgagggctgataaggatgcccttgaaggtgattgatggtttgcaaagcacccacttattagtatttccactggacctctgaaaacagtgatggagatagagagattgcatgtaacttgggacttgggaggtggcctgaaatgactgtgacccagctgatttctctgaggacttaggaggaaatatctgaagttggactcttcttgactgggccaaaaccagatgcttccccggcttctttgcacatacttttccccgtgctttcttgttgaaataagcagcattgtggagtgagaggcatttggaatgtgactcctccgtttacttactcctccacctaggcagaatactttgcttctgtttcctttgtgtaaaatgggaagacgatagaacctccttggttaggactgtggtgaggtgtcagtgaattaatgcgaaatccacatagaaccatgcactatcacaagcgtttgccattatcattcatagtgttagcattcataagcggcatgattgtcccagcagccttgagaaagggtggggagagcactttaatccgtgcttcacagatgaggaaactgaggcacagagaaggtccccagccttcccaagaccccacagtaggtgagttgcagggttagtctgctgtgtcccagatctgtgttctttctgccatgctgcattgccactcagagaggaacaacctgatctagaaagtgaaattttttccagccgcagctgctgcggctacatttgtgaatcagctctgtaaatacaagtttaatacgcgttgttcctgctcagtgggcgttgatagcccagccctggaagagcctttaagaacaggccttaaatagacacaccagctccatgcttcagttttgggaggctgtaccccataaaggaagggtgcaagggcctgtgggctgacaggaattacagaccggcttccaggtggccccaccacctgtgctgggcccctgctgggctcacttgactgtccctgagcccatcactcacccttttggagcaatttttgaaacagaccgctaagtacccagggtattagctggtctcatccctaccatgccggggaacagcatttggatcaccgcagtagcagcccaaggagacacacaagtagctgctttctcggactgtattattttctgaaagtaagaaactttccctgggcagaactctttctagttcccatggggatgggcaggataggcgagaggccgagcccccacttccaggtctctgggcagggcggggttaggcagcagcgggtgtcactcacacagtgactttcacttgtgctttcagtgctcaggacatgggcacctgccggcttccttctagcccggttggacagctccggcagctggtttggggaggtaaaattataggagcgtgatgtcacccgggccactcagggcagagcctggctgctgggcagaagggcacttgggccgggctgcttcagccgagagggccattcggtgtcctgcccacagagagagaaacagtgagagaccaagagagcaaaccagagagatagggagggggaatgcaaggggtccctgggggactcaggagtcccagtggagaatgagaggcaggccccccgtggtggccggggccctggctgccagaggaccgggctggtgaggaggcgaggatgtggactttcgtcacccagctgttggtcacgctggtgctgctgagcttcttcctggtcagctgtcagaacgtgatgcacattgtcagggggtccctgtgctttgtgctaaagcacatccaccaggagctggacaaggagctgggggagagcgagggcctcagtgacgacgaggagaccatctccaccagggtggtccggcggcgggtcttcctgaaggtaaccgcctggcaggaggccggcagggctggtggtgtgggcgccggaggccggggctgaggggacgctgctgtggggagctccggacccagagttgggagacgccggaggaaaaggaccaggaggcccccagggatcatgttccaccctgggagccagagtgtgtgtgcgcccaccagaacctgccctctggtgcccagtgcattgtgacagtgacattaaacactcagctttgggtctcgggaggctgcgctcatcctgtttctttctttgtttctttcttctttctctctcttctcttctcttttttcttttgtttttagagatgaagtcttgctgtttagtccaggctggagtgcagtggcatgctcatggctcactgtaacctgggcttactgtaaattcctgggctcaagtgatcctcctgcctcagccttctgagtagctggtactacaggcacacaccaccatgcctggctattttaaaaaaatttttgtagagatgggggctcgctatgttgcccaaattggtcttgaactcctgggctcaagtggtcctccggccttggcctcccaaagtgctgggatagcaggcgtgagccaccatgggattgcacccggatcgtcctgtttctgtcaccaactggctctggggtttcaagcaagtcacattctgggtgatgctgcctgtcgaagggcttttctatactgcaaagtgctgtaaaaataggaaacaggtgcctcacttcctctctcagggcctcctccgtcagacttgcataattgcccccattttgcaggttcccagggggtgttgtgagggccaagtgcacaattgtgagctcgaccgttcgtcttcaggcctcccagaccctcaggggcgccgcccacgccctgggagccctggcatggctcctgctacatgctgagccgggtttcctgctgggggagttattgggccatggctattgtggctactgctgtttcatttcctcgtcctccacccttcctcccagactcccactcaccaatcttgcattttctccctttctctaattccaggggaatgagtttcagaatattccaggggagcaggtgacagaggagcaattcacggatgagcagggcaacattgtcaccaagaaggtgggtgcagagtgttcccctctgtgctggggagaggcaggtgggctagaagctaaaaggtggtagaagccagtggcttctccctgctgccctcacagcaggtgagcacagccaggctggctgcccccgtgctcaggagggatggagggcccaggagctgggagctttggtcatctgcagtccagtcatggtgtcctcacaaccgctttgtctgagtcaacctgaatagcttctgctgctcttttccagaagggccagcccccaggaaacatcccagacctagtcccatgatgcctaaccctgaaaacagctgttaaacaagcagtttgagcatccctggcctaccatgggcctcctcaaataaaaagaatgtgggccgggtgtgctggctcacacctgtgatcccagcactttgggaggccaaggcaggaggatcgcttgagcccagacatttagaccagcctgggcaatatggcaagactccatctctaaaaaaaattttaaaaaataaataaatacacacacacacacacacacacacacagagagagagagagagagagagacacacacacacacaaaattagccaggcatggtggcgcatgcctgtagtcacagctactcaggaagctgaggcagaaggatcacttaaacccagcagttcaagtctgcataagctatgattgagccactgcactccagcctgggtgacagagtgagaccccatcacaataattaaataattaaaaggaagtgaaaatgcattggattggtagcagatattaactcagagacatgaccttgcctgtcaagtgtggggcacggtgctagctatgggtaaaatagaggaggagctgaggcaggatctcgaatgtgcttctgcttaggcgcagctctcatcacccttgagcaaggctccttgtgcgtctgtcttgcctcctgcactgtgagctgcttgcaggcagggacagtgtctcactgatgtttcacctcccactcagagcacacggcagatacagagtaaagggtttgaagatttggacaggtgaatacgggaatgggtgggtgaaaaagagatgccctctgcccttaggctcatgggagtagaatggggaagagcacaaactcccatccatatcaaaaagcaaaacagaaggctgtgggctcgagggggaggtcacacccagtcacaccttggtcatgaaatgacactgccaaggccccttcagggctgtctagcagagggttttccattaagcaatggggcaaaggctgtccctcttcttggcctctcaaggaggggctcctaggacaaaagctacctccccctcggagctcattcctgggaactgctgttctgaagctctgtcttgagggcttgaccagcccccccgcctttttttttttgacacagagtgttgctctgtcaaccaggctggagtgcagtgatgcaatctcagctcactgcaacctccatccaccaggttcaagtgattctcctgccacagcctcctgagtagctgggattacaggcacctgccaccacaccgggctaatttttgtatttttagtagagacagggtttcaccatgttggccaggctggtctcaaactcctgacctcagatgatctgcacgtcagcctcccaaagtgctgagattacagacatgagcccccgagcccggcctgaccagccctttcctccttcccttcctttcctagatcattcgcaaggtggttcgacagatagacttgtccagcgccgatgccgcccaggagcacgaggaggtgactgtagaggggcccctggaggatcccagtgagctggaggtcgatattgattactttatgaaacactccaaggtactgaggcgcccgcggccctgggggacccagcgccatcactgctgccttgctctgccgggccgtctgcatgacacctccctccactcacctctttatgagctctctctccagtctctcttctccctggtgggcagtgtgtctgccacctccgtgtggcctcctttcgatcttctgcctgtgttctgcccgtctttgcgatctgtcctgctttctgtctctgctgctgtctgcaggtggagctgagagggagtggcctacagccggacctgatagagggcaggaagggggcgcagatagtgaagcgggccagcctgaaaagggggaaacagtgaccccgagccgctctccttggagtagcctctcgggaggtaacgctgcccttctcatcccctctgcatggcctggtcttcagtggagtggctgctccctgtctcaccctatcccctcccagccaccccagcatgatgtgggacaaacaacttgttgttgtgtctcgaggcagagattctcacttcccaaccctgctaacagttggctctgaaccccagcttcctcatcaaggaaacagagttaataatatccacttatcagggaccgcacggttttgtaagaatgccttttgggccgggcacagtggctcatgtctgtaatcccagcattttgtgaggtcgaggcaaaaggattgctttaggccaggagttcaagaccagcctgggcaacagagcaagaccccatcacaaaaaaaagaaaaaaaaaagccagaaagaaaaaaatgctctttgaaaagtaaaagcactctgtaaatctaagtggtaatattatcttggaaaccaagcaatggggatctagaaagcagtggacagggcattgaagaggacaggagagttggtctgggctgtgatgcttcaacataagagctccaagactgaggactggactgtctcttgaacctggagcccagctacagttctcaccaggccaaggcttagcttctctttggtgttttgtgaaacacgttgctcccttgctttctaggaaagggctgagccgacaggcctaaggggtggacgacgtgctttctgcaagtcaggagaccgtcagggttggggccggggcctgggctgtggtgcatgtgtgtgagcatggggcagtgtggccacagagcaggggcatgccgtgccgtgccgtgccatgaggaagggacatgaagacgctgtgcgaccatctccagcaggtgtgtgtggtgctgggggcttcagcggccggctctgatctccatcctccctggggcatcctgtactgagctgccccgaggcccttcatgctgcccagctcggggcagctcagtacaggatacctcggggtgggagtcagcaggaggtgagggggcatggtggccccagtgcagcactaaccaggccgttaccattcacaccccagggcctgactctgggaccgagcagcaaggaggctctagctttctgcattcggcaaaaatcagggcccgctgcctcctgagccaccaaaagtgctgactctgggcttcccaatatatctcagcacttgggcaaaaaagaggactggcagatccagttataggataaaattagacctgacacctcagcagcttaaggaggtcaccgtgttaacccctgcactgccaggggtcccactaggctgctggtttagaagactctgagtagctgctgttgggtcctggaaagaacccaaagatgcaaataatgtttaaaagcagcaaagggaaaggaaaagtacacttttctgacttatttttcttatggtagcagtggcggctgtggctttaaatttctctttggctcaggctctatggatgctcctgagtgggagagaggcagcccgaaagccaggctagggggaaggagggagccttgaatttcattttaatttgccgtaagtgatctgcaatgtggctgaagccccccaacctcaggtgattaaggaccggaccacactagcatgggtgtcagaaacacggagcagcctggctctgggacagcacttggccctctgtcagtgacaggcacagggacaagtgtgagggtggcaggggggtggggcggtggggcgagagcagtggtgagggagaggcggagaaaagctcctgccaaagtcccagagggttaggggacagcattaaatgccctaccctcccaaccagggcaaaggctacagagaagacggttgagggcccaaaggcttcctaatttactatccgcatccccgacaagcatgtacagtcgatcctcatcattcacggattctgcatttgcgaattcgtccactcgctaacatttatctgtagccccaaagctggcactcaccgtgctttggctcattcatggacacacacacaagggcagaaagtttgagtcgcccaacacgtgcaatcccagctgaggatgaacaatgccacactctgcctctgtgcctcatactataaataagtgtcctccttgcagcttgtgtagtgccacatttttcacatttttggtttcattgtttagaatggcccctgagggcagtgctgaagtgctgtctggtgcgaagtgcaagaaggctgggatgttccttaaggagggaatggacatcagataagctctgctcagggatgagttagagtgcttgtggtggtgaagtcagtgttaatgagtcaaccctatatattacataaggcgtcttgaaacagaaacgcatttaacacaaagttatgtattcatcagttgaccaaaatattgtggccagaggctcatgggagcctaaccttgtatttcccttaggagcagtggttcagtatttgctaattccgtgttcacagcgactatttatttatttatttatttatttatttatttatttatattttgagagggagtctcgctctgtcgcccaggctggagtgcagtggcactatctcggctcactgcaacctccatctcccgggttcaagtgatcttcctgcctcagcctcctgagtagctgggattacaggcatgtgccaccacccttggctaatttttgtatttttagtagagacggggtttcaccatgttggtcaggctcgtctcgagctcctcacctcaagcaacccgccctcctcagcctcccaaagtgctgggattacaggcatgagccactgtgcacagcctcaaacagcgactaatttatagaacagagctatggcaaatggctgtatttgtttcagagagtgaaagctggagcttgtgagtctagaatcaaggcctcctcctgcttccaggttgtatggccttaagtcatttaaccgccctaagcttcagtctcctcaagggaggatgaaaatgtccctttcgaatgtgctacacttcaagaaaaaggtttagaaataataatggtaactgtgagcactgatgtgaagagagtaaataagaacatatatgctctgggactcaaacaattgcaggtcttgtttgtagtgtgactcggagcaagtcaaatgacttccctaagcctcaggttccttagccataaactagcaataatgccagcatttcccttgtaggatggttatgatggttgctgagtttatgtttgtgaaagggctgtctagggccgggcatagtgactcatgcctgtaatcccagcactttgggaggctgaggcaggaggataatttgagatgagcctgggcaatgtggtaggaccctgtctctacaaaaaaagtttaaaaattagctggacatggtggcatacacctgtagttccagtttcttgggaaactgaggtgggaggatcgcttgagcccaggagttcaaggctgcagtgagctatgattataccactgcacgctagcctgggcaacagggcaagactctgtctctaaatgaaataaaaataaagaatgaaagagactcttttctaagcttttgaaaggtgaggggacccaggagaagaggccagaacaatgcaggagtcctgggcagagtgaggtggcctaggtcctcatctcacccctgctcttgccactgtgcctctagagtctcagtttaccaagggatgaaatgggcagtcatgccagcatgatctctgaggtctgaactttctcttctgctcagtgcctgggcggtaaagtagatgggagatcctagcctgtctttcccaggctgcatattccatgatggtctcttatttgaggagcacttcttggggcaggcaccgtggggagcaccaggaggctgttcttgccctcagtgtttctaatctagtcagggaaatatgcagacatcaaaaagcacagatggacagagacggtaacatttctagagagccaagtaattgtttgcattcatacaatgctaagcacctatgtgtcttagcttttttaaacatcacacctctctaatgggtaggccctattactgccctcattttacagcagagaaaactgactcacagagcaggtaaggcacttgaccgaggtcaggcagcatgggacttgaacccgggtggtctggctccagagttcatgctcttacccactcgactctgccatctcctgaacagaaaaggcagcttttttcttttttgtattttgtatttttacaaaatacaaaagggagagcttccagagtggagaggggcctgctccaggaaggatcaggaaggttttgtggggtggaggtgttgagggcggcaggcagaacctctgcagaaaagagaatggaaggcagccttgacagaagcgtgaccgaaggcagagaacaggagggtagagcgtgttcagaggcttagaggagacagtcagacttggccgatgtgatggcccagcagtgatgaaagcatcttccctctacggtggcagcactgtccacccactgcagcagcagttcctggctttacagttctacagcagcccctggcaaggaacctggcaccaccctcccatccctggggaaccacccaagagctgagttctccctactcccttccaacactcctccccaaccccttcacctggaggacccaaaacagctctatgtctggggatggctccacctccgaatgagctcctgcctccctgtgtcacttcccaccctgcccaagagattgtcacctcctccttattgaagcatcctcctttccccagtggtcccagggcccctgcagatagaacatgagtggctggtcttgaaaacatggagttttcaccccaggttggaggctggaggccccatgggggcaggagaggtttctcactgcgaatcccaggctgaagaatgtgggcttagttcctccagcaaagctgctcttttccagcctaagactcaatacaggaggaggagaggaggatgcatctgcttttcagagatctctgtccatctgaggggcatggggagagcagccagaggcagcggtcaggaagtgctgtgggccagagctgaaggggagctgtcacccttgaggcatgagctcccaaggccagggagcacatccgctccatccctgggttcccaaggctggcgcatggcggacatcagtgcatgttggcagagctgaactgagaaagtgaaggcctcacctagcctcacctagccccttcttggcacaagccctggctcaagaaaaatggctcttcctaagtacaaggatctgctgggggatgtctccccaggtgaccacgtaggcacgggggcctctgcccctctccaagggcacagagcacagtgctctccttggcccatacagagaggcatcctggaacacttgcacactcagaaggaattcatgaggcctgggtggcggctctgaggaacagcctctgcatagggagcaagagaaggagggcggcatctcaggaagtcgggctgcaagtgcagcaccctcagcacatcgccctgcctggggagactgcttttcctgagtcagattcggcctgagctgccagcacaaaactctgtgtgtggggtttttgctggacgttgcacttttgcattctaagtgactccttctctctttgtgtctcccaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacaccactcgcctccactgaatctacacacagattttactgtgacttctgaagctgtatagactctgctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaaccaatagaaacatttagcagtacgtacagagcctgacagcgcagctcctgaggacttctgcggctgcaggagaaggagctgtggcctgtctttcagtgaaagaggaaggaaaggagtagggctagtgaatgtatctgccaggtcttagaagtcaggaccacccagggtctcccagagtgaacttggtgctctaagtccaggcagcctgcaggctggggaccctgggtgcaggtgccaggctcgaggctgttccctgtcctgcctcagtgcctcccctctgcccagcccctgtggcctcttggagaggcgagccagggggctccccggaccgcatggccggtgagagtagagtcggaggcggagagcctggacgcccagaggccggggccaggctctgggtcaaggcaggaaggagacagacagctggcagttcctcgcctcggtgccatcagggaggagccttaagttccactagagcctccggcccagggaggccagaatcagcacaatcccggccccgccctcgcggcgggcgcccccagggccaggagagagagacagggctggctcctctcgcccctggagccgcggtgtggacggcccggccccgtccgccccgccgctctgcgggagtgtcctcgggacacacttaaaccttccaagtagcacagaagccccctccacgtcagaggccccctggccgcggggcctgtgagcggagaggggccctgcttcccacacaaatccgccccggtgcacccccggccaggcaggccccggggcggcctaggcgccttgtcggccgggggtggggctgcttttgcttcctttagaggggcgggcagggagaggaagctctagctccgggcctgagtttccccgaggctgcgtcggaggagctgcagggcgagcccggacggctgccgtctccgccagaggccaccccggcccggcctccagggcgcagaggcgcccccctccatcctcccccatcccgggggccacggcaggggggccgcacagcgcggctgggaccgattcggtgacggcccaaggaagctgggcgcagggctcgcctctcccgcctcgatcctgcaccttcctctcccaggtcgctgctgcagccaacccagtagcccccttagcgcccccgcggaccccgcagctccagactccgctttggcacctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgt

SEQ ID NO: 14882 - DNA, 146307 bp, Human; identical to SEQ ID NO: 14881

SEQ ID NO: 14883 - DNA, 146307 bp, Human; identical to SEQ ID NO: 14881

SEQ ID NO: 14884 - DNA, 146307 bp, Human; identical to SEQ ID NO: 14881

SEQ ID NO: 14885 - DNA, 146307 bp, Human; identical to SEQ ID NO: 14881

SEQ ID NO: 14886 - DNA, 146307 bp, Human; identical to SEQ ID NO: 14881

SEQ ID NO: 14887 - DNA, 146307 bp, Human; identical to SEQ ID NO: 14881

SEQ ID NO: 14888 - DNA, 146307 bp, Human; identical to SEQ ID NO: 14881

SEQ ID NO: 14889 - DNA, 7255 bp, Human
tcatcactgtatacctacctaccccaccccctccccagctcagtgcctggctcacagtaggctttcagttaccctctgcagatcagtgaaagctaggtgagtgcccggagtgaagaaaagttggcaggtttcccactgataccagctgctgttggtttctgaacactcaaagccgcaaataccttagggctgggggcaatgaacccaaggctgaattccaagttcagaagcagcgaagtctgaatttagaacctaggaacttaaactgctgcaggtccaacttcaagccccagttttagacagaggcttgggaaagatctgacttctaacccggttccccctcccctcctcccctcgatgcttctcacaggaaagtacacctggtcctgccaaatcgcactcttatatcctggcatcctatccaggctctgcgaggatggaaactgcgaggcaggggagggaagcgggctgtttggccaccacctccctagtgctgcaggcgaccctgtcacactaactcctggcagcccagtgaggtggacggcaccggccccacctgcagatgagggaaatgaagctcggaggagttccgtgatttgcttgcttcacactgtggtagcctggccacgaaagaaccaggattcccgacttcgggattctttccaccacacactttcgtccctaaggggtggggggcggggggagaataaaataaccgcggaaaaggaaccacttacatgtgtctagcgcttcctagaggctacccaggatatgcgcccaccacccggccgggagtgcagagatttgaagtccaggttctaccccgggctccgagtactactgcgtgactttatgcgagtgtccgccgccttctgggcttgttttcccggaagcaactcggcgcggatggagtgtgtgtgtgcgcgcgcgcgcgcgttatgttgtgcgtgttgtgttaagcgtgtgcgtgttgtccgggggcgggagggggagtagactaacaccggggttccccgagtttcggatcgcctacacgcttgttcccatctggaccctgttacccaccaattgcgcccactataaaaactgcccctccgaggcaaagctgtgaacccccgcgccctttcccccacggtcccggaggatgaagtggggtgcaacggagactcagctgagcgtccagtttcgggcaatacaaatctctcggcttctacgagcagccagacgaccccgcggaccgtcgctcctgaacttgaccgagacgcaaacttcggagtgttctcaacgtggggggcccactctcgggagaccgcccctaaacttaagtccccttaggctcgcccccacctgggacttcacagagccaccttaagggcggtattcccgcccccccggaagtgcgggggggtggcagcgtacttggattctcagcctccagccccgcgcggtggcggccgccggtggatgacttccgggccccacaagtggggaaacaacaaccacccctcgcccgcacccctggcccaaaacaactggccaggttccctggcctcccgggtccctgcatcccccgcatccccgtccgcagccgtgaacttgagcccccctccatcagaggttgcgagcgtccgcccgctcgcggcagccaccgtcactagacagtcaaaccccaagacgtcagcccacaatgcaccgggcgggccgggaaaaacggcccggggaggggaccggggaagagagggccgagaggcgtgcggcaggggggagggtaggagaaagaagggcccgactgtaggagggcagcggagcattacctcatcccgtgagcctccgcgggcccagagaagaatcttctagggtggagtctccatggtgacgggcgggcccgcccccctgagagcgacgcgagccaatgggaaggccttggggtgacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagcgaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcccgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccagagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgtattcaaataccaataacagatcttgaattgcttccctttactacttttttcttcccaagttatatactgaagtttttatttttagttgctgaggttaacattgctgcaatctgaagtgatttgaaaattaagaagcaaagaatttaggaagagtcaaactagaagttgtgatctgaatgaaacagtctcccaatttcattaattctttccctctttctccatctctatctctctctctactacctcacccccaaataaacccctatgcctatggaaactaacagtttagcattttgggtctgtctgtagcttatttcttaatttgtttctaaaataatcaaccttgtttaaatatagaataagtctcaaaagatagtaatctaatactatggaaaagattcacaagagaaaacatgaactagtactaactcaatgattacatgcgtaaatcaaacctcagctctggggaaatgggaaacttgaattctgcctacagatataacttaggagatcaacaaggcagtgcttaacaagggaacaattttttgcttggttgcttttcataccaagagccagtgtgattatcaggcagcaaaagcaatttgatatccaggaatatttcacaaaccactaattgagtcagggctgtttgctcattagcagtgttctagtacccagtaggtctgggagtgctaatatcctgcctgtggctgtaaatccaaatacacaaagagtttctccttaggagtatatctaggagtggaagagattggacaggcttgttagcttcggatcctttgtaataacacttcttgaacaaagggttactgggagcagagcccagtttgccaaactgaatttgccgatgtcagcaacccggaaggtgagatgattttgaccatatgtagaaatagcagagggacaataaagcattttggggtggggctctgtggaagctaaacaagagccaactagaaaaaataagcaggctggggaattaattacctgcaaaggtagactaagcccagacaacagtacagcacagaaaagccacaccactccccagtttgctttagatttcagtgttaaaaaaaaaaaaagtctgaaactcaggcctatccccatgcttgattgtttcaattaacattctaaatgtatattcttgaaattctaaccattctaaccaaaaggggtagaaaaaagtaattgtggtagaggaaattaacccatgatctctggtaaattttggagacaaaagattaactgcttataaacacttaatggttaagcttattatgggccttcaatgagttaatctttgaattaaggtaacactaatagttggagaagatgaagctggtgacacatcgtcattaatcctcttaattttttttacacatatatatatgttacatatataaaataattcaatcaaggacatttaaccctctctgtctatcaagacagagggttcatgaactcagtgaaaatgcccagaaagttgtgtttgtgtgtctgtacacactcttctgaggagagaaatttttgcttttattcgaccctcccagagttccatgactcaaaaaaaagggttaataaaccatgaactgaccagctacatgcccactatcagaaacatatcattgtatggatctaaatcccatgctctttcaccccttcatgtttctgcttgcatgtatttgcctggaatacctttccttctagttcaactgataaatcctacccattcttcaagtcttggcgtaagtgacaccttctctgtaaagcttcccttagtaactccatcttcaaaaggaatgaataattccctaatgagcatgataacattttatcaaaaatcctatgatagcacatacaaaaatgtattatgaacctctgtgtctcctggtcagaaccctatcttcttcatcaatggactcccaaacttttaatgtagcgcctggcatatagtagatgttcataaaataaatgtttgatgactgaacgaacaagtg

SEQ ID NO: 14890 - DNA, 93364 bp, Human
  misc_feature (1)...(93364): n = A,T,C or G
tcattcccctgaatactctgcaaattgtacacattgagcacctactgtaccccaacactgtttcaagaatcagggatatcgcagtgaatgagacagacaaaaatagctgccttgtggagctgccattctagtggggaagacagacaatatgcaaataagtgagtagtataagaggaaaaactttgggaggctgagtcgggaggattacttgacaccattacttgacaccaggagttcaagactgcctgggtaacatagtgaaaacttctctttacaaaaaaaaaaaaaaaattagccagccatagtggtgcacgcctgtggtctcagctactcaggaggctgagacaggaggatcacttgagcccagaagttcaaggctgcagtaagccctgattatgccactgcactccagcatgggcaacagagcaagaacttttctcaaaaaaaaaaaaaagaaaaagaaaataaaaaagaaaaaacagaggagaaaagcagtagggagatgtcaatttttgtgtttgtattgtggtgacagggagagggacttcagttttaaatagggaaggctatttcactgaaaaggttactttaaagtcaagaccagaggaaagtgagggagtggccaagcagatacctggaggaagagctttccaggtagagagaagtacaactgcagaggtctgatgtagatgtgtgccttctcttttcttttttgtttatcttttggaagagacagtcttgttatgttgcccaagctggtcttgaactcctgggcacatgcaaagtgaaagcagagaaagagtggacttaccccagaggcggatggttctgcagtgtgcaaggccatttcagaatacacatagagaaaacaggagaataggtggtgagggttttggggaaagagccaattttggttgaaaaagtaggggaaaccccagacattgtaccatctcagggttgagactgcttgcctagcttttgagattttttttttccccagacccctcaactcctgagatcttatcgggaagctgctgatcaccagttttaggtgtttttatctattgggagactgcctttctctggtctggctgcaaccaattattattttagagagacagcttaacctgacaaccacgtcatggttgcctcacattgctggtcggggagtggcccctctcctgccctgctcaggtctgactacttactgtaacaattgcaaggtttttggatggaacaattgaaagaatggagcttgcatgaaccaaaataagaaaagactatgagagggcattgttgaagatggaggcaaaaattctgagtggatcctgatgtgttcggatggggctggtgcttgggaggctgctctgtgcttacaagaagagttctacccggtccatctttatcacatcttctctaatactaagttcagagaggctttagctcattttccattttcttgggctgtctcctctgccagacaaagtgcctatttctcctgtctctatcaccgagccacacaattgctgtagtcatttgcagtctactagaacgataacacatattggcatcagacagatcttggttcaaaacctcgctccaccagtttctgtgttgagctagaccaagtgacatgatatactgagtctcagttccttatttgtaaaatggtgataataatttttggttaagtaattaaagtaaggataaatgatgcctttcgaagaaggacacaactggaatggccagtttaccccttgtcccctcttcggtggcattatttattctggagtaaggagggatggctgagggaatctgtctgtgggtccaacatggcgccgtcctgctccttgtatgagcctcaaagatggggacaaccatttgggggcagacatgtttgtagcacgagatccaggctcagtcccgaggcagccggaacgtgacgcaaggttgaggcggggctcctcccccgcaccctggcgtcgagcgtctcgtgacaggtacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcggtaagcagcgggcccagcccggccggcggcctggccccatcccccccctcagcccctcggtcgccagggcctcgcgtcctccctgtcctcctgggcaggctccagtcccagccctggccacgcgggcacacccggcatcgctcaggcccccggagcaggccaagaccccacccggcttggagaggtcggaggtcgtcgggcgtgacctctggccgggttgcccgccccggccacccgtctcggacgctctgtttactgttggcctggatctcagagacccgagagggttccttgacttgggcggccctgcgccgcggcaggacgcgctggccagtggagttccttagcgcggcgagcaggagggtgtcagagcccacgccgcccgccgccgtgcccacccggcgggcatgggtcacaggcgctgggggccgagccgcgttcccatccggttcttcagttgaacagcctgaccctgttagtgggagttccctgacggcaactgagtcaaggcagtgagtcaggtcacgtgcgctgggctcgcctcgacacttgtgtacattgaggcgcctctggcgctgggagacagggagctttttgtcctaggcatgttacggtaaatcctgagagaagtttttcaacttaatcgaggaaagatggtagttggatgtagagttgtgtttccattccgaccgtgtttggggcctctttctgcattcattttaggcttgatacctaatggggtcataaggggaatattgagaatattgacagcaaatatttgagcgtttattgtatgctaggcagcgtggcaagaccttttaacagatcattatgtttagttctttgaacaaccctctgaagtaccactgttgtgcccacttaacacagtgggaagttgaacagagaggctaagccatttggccaaggtcacacagctaataagttacgaagcagagatgcaagcccaggcagtcagactccagagcactgtattaaatttctaggttgtactgctttcacgtacccctgaagcttgctggtttatcttttgctacctggtatctgtacctcagtgcctcccaccacctcctttctttctattgatgtcatttgaaagtctttctggtagcatcagttctcccttaaagccataagaaatgccgtttgcgacttatcacacatattgtggtgtagtgtcaccgaattaggagctcttgaataccggcagggtacttaactgaggtttgaaaaattttgcaggtaggcctggcaaacctgcctagtgaacctttcttacaaccttagttgatggctgtccagccggctggttcttccctattcaaaatactgcatctttggtttcctaaagaacggactcttgtctctttcttgtgacttaagcagctgatgaagcacatgatttctcatccatggatgaataaagtctcctcttagtgtgtttctctcttcaaacttgggaaggtttgttcagatttgagtttaaggactggaaggtgagttaggagtacttcttctgaagaagggaccggctaagttaaagcttagcgttcacaatcctgttgtattcatatttgtcttttttttttttaactttgctacctagcctaaaatatttaagtgagtaataagtactgtggctttatataatgtttgagtttagagtaatgataggcacctttttattcattcattaagtattttgagtatccattgagtatcagcaatgtatcaggcattgtgggacattgactcagggagataggcgtggttcctgtcctcaaggaatttttaaaaggtgaatgatcttggccagaaattctgttgtggaataatttggcggtagaacttgaggctttttggaaagagttatttctcatctctgctggtgaatcagtagtaacccaaaggatggtgttcttctggctaactttaaggctttgttaattttaacaacagcatttgtatggtttgctcttcagagagtgtagaagataatattacagtttctaattaatcacatcttttaaagagtaaccttcaacactcaacttgtttctccttttgctctagtggcatttattttattttatttatattttgagacggagtttccctcttgttgcccaggctagagtgcaatagcgcgatgtcggctcactgcaacctctgcctcccgggttcaagccattctcctgcctcagcctcccgagtggctggaattacaggcatgcgccaccatgcccagctaatcttgtatttttagtagagacaggttttctccatgttggtcaggctggtctcgaactgcctacctcaggtgatccgcctgtctcggcctccgaaaagtgctgggattacaggcatgagccactgcgcccggccgactctggtagcatttttttgttcactcaagaggtagtccatgtcactactgtaattaccttgcactgccatgtctttgagcaaaggtacatttggcatgctggatttttttcttcagctggcaagaaagtttaatgtagcactgatagtgtactggccatagtttcagtaccattctacatagaaaagctgtgttaccctatctcccacaactttctagattcccttctttaagggaagatttggattttacatttgtggtagaactgcataagtaaacagagggtggaatgtagaagatagtctaaaaatagttttattagtatatccttctaggtagttagcaaccacttggggcaattttttttaaaatttttttttagtgccaactgtgtctaagctcaccaaccctgtaatcagagaacaactctttatagtaaagtgtggctttgaatcagttttctgaccccactgccaagtgaagccaaaaaattttggttatttgattagcttttaatatgtcttcagctgggcacggtggctcacgcctgtaatcccagcactttgggaggccgaggcaggtggatcatgaggtcaggagatcgagaccatcctggctaacacagtgaaaccccatctctactaaaaatacaaaaaattagccgggcgtggtggcgggcgcctgtagtcccagctactcgtgaggctgaggcaggagaatggcgtgaacccaggaggcagggcttgcagtgagcagagatcatgccgctgcactccagcctgggcgacagagcgagacttcttctcaaaaaaaaaaaaaaaaaaagtcttcaaagggatcttcactaataacgtttttgctcttactttggcattagactttgtaaacaaagatgtagcaaacacagaccacgcaaatatgacagttgtcttatgcacattcctctctggcatttgacacaaatattttagtttttcctatgataaagtatttatctccccattcatttaattcaacaaatacagctgagatagatttgaccagatgttggacttggagctgtaggcaggcttttcctggggaggtaaggattagaagtcctcctgaataaggctaaacagaggttccccttggcattaaatgtcttcttctgaaggcgactgaaactcgagaaatgaactccccgcctccccccttattttttggctattggcttgctgttgatgattcttacctctcatgtaaggaaggctaccattgtattctcaggcatccattcctttgtgttaccacatgcttatctgttaatattatctaatagttctctatgcttctctgtctgcagtttgctgcagaaacatttttgcaatatgctgatcttttcagttatttgctcttaaatcttctattctgtttttccccacactccatatggcattaaagacagaaaaatagtttgtgttttaaaactttttttttttttttagacggaatctcgctttgtagcccaggctggagtgcagtggtgccatctcagctcactgcaagctccaccttccagattcatgccattctcctgcctcagcctcccgagtagctgggactacaggcacccaccaccacgcccggctaatttttgtatttttagtagagacggggtttcaccgtgttagccagattggtcttgatctcctgacctcgtgatccacccgcctcggcctcccaaagtgctggaattacaggcgtgagccaccatgcccagcctaaaacttatttttaaaacatttcttaatggtggtggtcactgcgatttgtgaatcagaggtaaaagtgatgtggcgagtgaaatcaaaacaagttttttagcagtgtctgttaccagtttcaattttagtatcccaggctgtgattacaaaaacatatttaagaatagctacttgcaaaatatctccttgtgggaggaagaaagcttgggagttggttccaatgctgacctacagcattggccttgttcatttgcttgaagatgcagtacttaactcatggggcctggagtctctgttttggtgatggcatcactgctgagaaatttaagtttgcctgattctgttgtccacttctggtgtcctgggactgtctacagttgggaccaagcaaatccaagggagcctatttaaggggagcctgggacaagggcagtttaggaattctccagccttgcttgtctcttagttggtccttcttgtgtggctgctgccagataaaggaaaggaagttctctcttctccctcagcctttcctttccagctttgcttcatactgctgggcattaaccatctcagatcaggagtcctttaaaagttacttagtgaagtaaatagttacatcattgatttccaatattggtatgtaagtgtaataaaaagttggtttccattgaataagctttgtagtttgagttatttgagagtgcataattacaaagctgctatgaattaaccttaaataaccaagcatagactttatgaaaaatagtgtcccttatatgtggtattcagtcagcctaccaacagttcttctgttcacttacagatatgaggatccctgagataactgcgggtcatttaaaacccactcttaaatcctctgacctgcaccatgttaatggttgttaaaaaagcgataacattttgtagaaaccttcctacacatttgcctttaaatgctttttaatgtttctgtggtatttgtagtttacatgtgatttcatttggtgctcacaactgttgtgtgtatctgcctgaaatagctgaggctgtatgctcaggtggctcagctggaatgtcagtctaggtctgctaactcagttcagtgctctttctgatgtaccatcctgcctttccattatatgctagtgccctaaagaccacgacatttcaccccttgtaaaagtgtatctttcggccgggggcgatggctcacacctgtaatcccagcactttgggaggccgaggagggtggatcacagggtcaagagatagagaccatcctggccaacgtggtgaaaccccgtctatactaaaaatataaaaattagctgggcatagtggcatgcactgtagtcccagctattcaggaggctgaggtagtagaatcgcttgaactggggaggcggagcttgcagtgagccgggatcgtgccattgcactccagcctggcgacagagcaagattccatctcaaaaaaaaaaaaaagtgtctctttcttccactaccttttttttttttctctctctgagacagagtcaagctctgtcgccaggctggagtgcagtagcatgatctcggctcactgcaacctccgcctctcgggttcaagcaattctcctgcctcagcctcctgagtagctggggctacaggtgcacgtcaccatgcccagctaatttttgtatttttagtatagatggggtttcaccatgttggccaggatggtctcaatcccttgaccctgtgatccgcccgccttggcctcccaaggtgctgggattacaggcgtgaaccaccacgcctggcccactaccttttatttaaaatgatacgtcttttttgctgattattaaactattcagttaaaaaaaaaaagctaggaaaattcagaaatataaagaaggaaaatttgtgattcactaccccgaggaagaccaaagtgttaactggttattttcttcctttgaatgtatactttcataccttcctttaatgagattgaactcttggccaggcatggtggtcagtactttgggaggagtaatcccagcactttgggagggtaaggcaggaggattgcttgagcccaggagttcaagaccaccttcagcaacaaagtaagactccatctctacaaagaaaagaaaaaattaggtgggtgtggtggtacacttgtggttccagatggtgggaggctgagacgggaggatcacttgattccaggagtttaaggctgcagtggtttgtgttcgtggcactgcactccagcctgggtggcagagcaagaccctgtctcaagaaaaaagaaattgaactctccccaaaaatgatgtgagaatttaactgtggaggagaccagatactcttgggtgatgtgacctgtgatacttctcctagtagacactgaatgatgagaagctggggatcataggaatagctgtatttttcaaatgtttgttggtaacgagtgaggaacctgatgcatccagctccagagtaaggtttatttgccatggtaacactggataagtacattgttgcctgtatttccaagtaatttatcatttctgtattttagtaaacatacatatatacagaaaagtgcacaaataagtggacggcttagagaatttttataaacccagaggccctcttagtctcctttaagtcattatcatcgatgccctgatgcttgcgtagtgagtcttctgatttctagaactgtagactaattttgcctgatttggattttgtgtaaatggaatcatacactgtgtattcttgcgtatctggtttctttgactcagtgttgtttgtgagactttgtgttgttgtgtacagttgtaactggagtttccattgctcagtagtattatgtgatatatcataatgtatttaagtaaaaagactgagttttagggtatgtgtctgtattcatttgctagggctgccgtaacaagtatcacagatagagtggcttaaacagaaatttattttctcaattctgaaggttagaaatctgaggtcaagctgtcgggaggattagtttcttctgaagcctctccttggtttgtaaatgactgtcttctcttccctgtatcttcacaggatctttcctctgtattggctgtgtcctattctccttttcttttaggacaccagtcgtattggattgaggcccacccttatgacctcacttaacctcagttacttctttaaaggccctgtctgcaaataagtcacattctgatatattggggattagaatttcaacttaaaaattttaggtggacacagttcacttcataagagtatctattctgctctagtagatatggccagttttcaaaagttgtaccagcgtattcttccaccagcagtatataagaagtccaaatattccacatccttgctagcacttgtaactttttctctctaattttagttccctctggtagaaagccatttctttatggcaccatggtacagcttgtttactcaccagtgtaggggaacctcaagggactggggaaggttatcctggagtaaaacgtgtcagtttgagactacctcttgtaaatgctacttaaatccattggggttaaaagcagaggttcggccaggcacagtggctcatgcctgtaatcccagcactttgggagaccgaggtgggcggatcacttgaggccaggagttcaagaccagcctggccaacatagcgaaaccctgtgtctactgaaaatacaaaaaattagccaggcgtggtggtgggcacttgtaattccagctacttgggaggctgagacatgacaatcgctcgaacctgggaggtggatgttgcatgagaatcgcttgaacctgggaggtggagctgagatttcaccactgcactctagcctgggcgacagaatgagaccctacctcaaaaaaaaaaaaaaaaaaaaaaaggaaagaaaagaaagaaaggaaaacaccgcttcagtccagtgaatgagcagttagtcttccatagttgcccatagcttacttttatagtctggactccattcctggtggtggaattggcctgtgaaagagtaatctgtggggtgtagatctaaccatagtagatggtgctttcattccaactctcttttttggtcagacacttgagcccttagaatatcacattctatcgtacatatgctagaaataggtctgttttgcatattctgactgacccttcagatattagtgggcctttcaccaccagccttttggctgcgtgatcttcagctttgtgtatccattatagaccttagtttgattgaaataatattacatgactttgcctgtcttccaactctaagccacttgaggacaaggatgaatcattattctagaatggatcttgaaatattactaagcttttgtttaaattttttccagttctagcttttcagagtaagttaccgtttatagcatgtaagttatgcttctgggtcagtggttaatatatgtgggtttcctgaatgatgaactatgtgttctgtgttcatttaacaggtttttcttctctactataagaaaacactgttggcccctgtggagaattattcaggaataattgtaaatacagggcagatgagagttacttagtttagagttgttcaatgcctggggtggtgaggggcatgttgagtggatttttaaataaattggtaggcaggtgagagttgggaaaccattatagttggaaagaatggcataagtcaatgaatggatgtagggattgcagtagctctaatttgggaatgactgtatgtatggaaaccagatcctggtagggagggcaggcactgcaatcccttgttagaggatttaagttcaaccaagtggcacttcactctgtaatgctggaatagacacagcataatcctgtcacttgaacctcacaattaagtcagatagtaccccagttatgggtgaggaatggctttgatgttgtaatttgtctaaagaaaccatacattaagagcttagtgggctaggattgaaatactacaagagttgtgcttaaactttcagagagttgcttcttcagaagtggctttaatgaaaagttaaacatgggagctggttaggggaggtgggatagaggaagagagcagttagtttggttttcctctttagccagcccattgtgggctcctcttagcaatttatgggcagtctgttttactggttaaatgcctgagataatctagggttgatatcaaactatcgaagatagttcttatgtaactgttttactagctatctgctttccagtttgccttaccaaaaagaaaaaaaggcaggaatcatcctggtctctcgttagagactaaacttttggcttagtacctgggttcagaaagcttgatgacagtggtgcatcgtattgaagaatctattgatccaggagtgaagtcctcttcacaagaattgccttccaagacactcttctttgtgtaagttgcctttgccttttccctcccagcaggaatgcagtactcagagcaaagtacataaacaatgtctttacatttcatagaggttgttaccttgtttaaacttcacaatttaagcagcatttgatttgtctctttttttttttttagatgaggaaatggactaaaaggtcatgctcagtatcttggagccactgtgtgttagtgagactgggactagcatccagtattccaagttgacagataattctttaataatggcagaagaataatagcatcttctgcggaagaacagcctttgtacattttatcattcagttttatttaaatgtttttaaaagagggatttcagactagtctgtttcttttgaaacatagattttcaggtggtgaatcttcaagcactatcagacagaataagctaggttatgctgtagtaaccaataacctcaaagtggtcaaaaagagcatgggttttctagaggctctgcatcattcttactccaaccaaaggagcagccgtgataggagtattgatggctgtcttggcaaagggaaaaagaactgttggaggcagttaaattccagcacgtacagtttaaatccagcacatacagataaatttaaatactgttaaataaagttatttaacagtatttaaatttaaaaaaatttaaatacagttgaatacagttaaattccagcacaggaatgacacattatttcatgtcacttctgcttagggttcattggccaaaatgagtcacaccacacaaggaatcaagtgtgatcctacatgtgtggacttggaaggcacggagttggaaatatttgggaaatagcactagtatcatacttggcttataatatgtaatagctattgggggaaatagctctcatttgcagaatctctttctacaaatcagctggtaatttaaatgctaaaaagagcttagttatagatactgtgttgcccgtctttactcactaatcaccttccgatcctaagaaatttatttatttatttattttttgagatgaagtctccctctgtcacccaggctggagtgcagtggcgcgatcttggctcactgcaagctccaccttccgggttcacgcccttctcctgcctcagcttcccgagtagctaggactacaggcgcccgccaccacacacctggctaattttttgtatatttagtagagacggggtgtcactgtgttagccaggatggtctcgatctcctgaccttgtgatccgcctccctcagcctcccaaagtgctgagattacaggcgtgagccaccgctcccggccttttttttttttttttttttgagatggagtctcgctctgtcacccaggctggagtacagtgacagtgcaaccccagctcactgcagcctctgcctcccaggctcaagcgatcctcccacctcagcctcccaagtagctgggactacaggtgtgcaccaccatgccccagctaattttttatatttttgatagagatgggatttcaccatgttgcccaggctggtctcgaactcctgagctccagcaatctgcttgcctcagcctcccaaggtgctgggattacatgtgtgagccacctatctttctgtctctcttttttttttttttgagacagggtctcactctgtcactcaggctacagtacagtggtgccatcatggctcaccgcagccacgccctccccaggcttaggtgatcctctcatctcaacttccccagtagctgggactacaggcacatgccaccacatctggctatttttttgtagttttttttttttttttttttttttttttttttaagagatagagtttcaccgtgttgcctaggcttgtctcaaactctaggcctcaagtgatcctcctattttggcctcccaaagtgctaggattacaggaatgaatcaccatgcccagctctgccctgtctttagaaaccccactccccttttttttaaggatttgttcttgtttttattttatattttaatgttttgagacaaggtctcactgttgcccaggctggagtatagtggcctgaacacagctcactgcagccttgacctcttgagctcaagtcatcctcctacctcagcctcctgagtagctgggcttacagttgtgtgccactacgcccagttaattttgtttttttgatagcgacagggtcttggccatattgcccagctggtcccaaacttctgggctcaagtagctcgcccaccctggcttcccaaggtgctaggattacagatgtgagccactactcgtcaagaaccctatgtttttccattattcttgtttgaggctctccacaaatggtctccagcttgccttcctggctttgttttttttgataaagacacatattcctctgagttgctttattcaccttttccttaccacactttgttccctacttcctttatcttgattcctgtcaattccccttcatctctgttttctagctccagtactctgttggcatcctgcctgactcaggtaccagtccacttttaaagcttttcttgaccacttacgtctatagtgttctttttactgaatccctggggcttgccacagattatcttatagttgtggattttgtatatgtatctttcctaccttaggagggggccttaagggtaagtcccagactgatttacctgtttttccccaaatgttaaccatttgaaagaaagaactaaatggatatttctcaaatggcttttgatagatacatgtacaatacatctgttgtcatacctggttggaaaaaaaaatgcctgtaaattcttcacattgtttgaaatcagtgtgtcagaagctgtaggattgtagaagctttcttaagcaaggccatagtatggctgtcaaatctgttactaagctttagtctccatttctgaaaaacgagagtaatgtgtaatccttaagatcctttcgtattttgacattctctgactcttggacatactgctgtggcttttgcaacatcctaactggttagttgacaccatcagaaactttaaggaccctgttagccattgagtatatggagctttgcccattcgtttctgagaggcaagaggcactggtaggcagttagatttttctttaaaatgtgtactcgtttctaaattacagaagcagtataaaagtcttaaagcgggccgggagtggtggctcacgcctgtaatctcagcagtttggaaggctgaggtgggcggatcacctgaggtcaggagttcaagaccaccagcctgactaacatggtgaaaccccgtctccaccaaaaatacaaaaagtagctgggtgtggtggtgcgctcctgtaatcccagctactcaggagggtaaggcaggagaattgcttgaacctgagaggcagaggttgcagtgagccaagatcgcgccactgcactccagccttgccaacagagcaagacttcatctcaaaaaaaaaaaaaagtcttaaagtgaacagtttttttctgtcattctggataatttgatggctataattcaaaacgtttattttttataaaatttaaatgagatcataaaatacatactcttctgctattagctttttaaaaatttaaccatatagtcagcttttcttataagtacatactatttttaatgactgtataatattgatcataatttaacaatcctctaaatgaacatttcagttatttccagctctttaagaaaagtatttaatagggccgggcgcagtggttcacgcctgtaatcccagcactttgggaggccaaggcgggtggatcacttgaggtcagttgaagaccagcgtgaccaacatggtaaaaccctgtctctactaaaaatacaaaattagccgggcatggtggcacatgcctgtaatcccagctacttgggaggctgaggcaggagaattgcttgaacctggtaggcagaggttgcagtgagccgagattgtgccattgcactccagcctagacaacaagagcgaaactccatctcaaaaaaaacaaaaacaaagaaaagggctgggcacggtggctcccgcctgcaatcaatcccatcactttgggaggccgccgagatgggtggatcacgaggtcaggagatcaagaccatcctgaccaacatggtgaaatcccgtctctactaaaacaaatacaacaattagctgggtgtggtggcgtgcacttgtaatcccagctactctggaggctgaggcaggagaatcgcttgaacctgggaggcagagatggccgtgagccgagatggcgccactgcactccagcctggcaacagagaaagaaaagtatttaatatttatattttcctacttatctaatcatttccttaagatttagtgagtatacatacttaaaatttggttttcattgccatatagccttcaggaaggttgtatactttacattttgtagtttgagaatttcatttatatacttgtcaattgtcagttttcttaatccttgccagtttaatgaatgggaaaaatttaaatgatgtctcattgttgagggcttgtgttttggccaggcctggtgggtcactcatgcctgtaatgccagcattttaggaggccaaggtgggaggatcggttgagcccaggagttcaagaccagcctaggcaacatggtaagaccctgtctttacaaaaagttaaaaaaaaaaaaaatagctgggtgtggtggcacatacttgtagtcacacctacttgggagattcaggggaggatcacttgagcccaggaggttgaggctacaggaagccatgataattccactgtactccagcctaggtgacagagggagatgtctcaaaaaaaaaaaaaaaaaaaaaaagacttgtgtttctttgtttgatagattaaactagaaaaatactaactacttttttatattcacttaaattttgtagaaatttaagtatatataattgtataataaatgtagaaaaaatattaactacatttttttatatatacttaaaattttttttaactttcactttctgcttttgtatatttatagtcttttgtgaattggcttttgttctctaaagcccatgtgaggttcttgtacctcacctctctcccagtttataaactttatatggcaagaattttgatccttttcgtgttgcaaacattattcctggcttgtatctcttggtcttgtttggctgatggcatgtttttgtaacatagagacttttctgtagtcacatctgtcaattcattttctgtgtttcatattatgcttaggcctttcccacccccaggacaataaaaacaatgttttcttctagtaattctagcacttagccaggtataatatgtcggaatcttttcccaaatgtatagttttcccagtattttattgtattatcttttctctttgactagaaattttttttatcacacagtatatttcctacttccatgtctttttttatttttattttaaatagatttatttacgaaatagagatggtgtctcactatgttgcctaggctggtctcgaactcctgcactcaagcaatcctcccacctccacttcccaaagtgctgggattacaggcatgagccaccatgcctggctgtgtcttttgttttttaactcttctgtttcattctttgtctgtgggacagtactgctgtcttatttgcgtctgttttgttttatacgtatatacacagatacatacacgcatacatatacatacacacaaacattttttttttccttggagacagggcattgctctgtcacccaggctggagtatagtagtgcgatcatgactcatcgactcattgcagccttggcctcccaggctcaggcgatcctcccacctcagccttctgagtagctagtatgtccggaattggtgggttcttggtctcactgacttcaagaatgaagccgcagaccctagcggtgagtgttacagttcttaaagatagcgtgtccagagtttcttccttctgatgttcggacatgttcagagtttattccttctggtgggttcgtggtctcgctggcttcaggagtgaagctgcagacctccacggtgagtgttacagctcttaaggtggcacgtctggagttgttcgttcctcccgtctagagttgtttattccccccggtgggttcgtgatctcgctggcttcaggagtgaagctgcagaccttctcagtgagtgttatagctcataaaggcagtgcagacccaaagagtgagcagcagcaagatttactgcaaagagcgaaagaacaaagcttccacagtgtggaaggggacccgagcgggttgcccatgctggctcgggcagcctgcttttattcccttatctgatcccagccacatcctgctgattggcccattttacagagagctgattggtctgttttgacaggatgctgattggtgtgtttataatccctgatctagacacagagtgctgattggtgtgtttacaatcctctagctagacgtaaaagttctccaagtccccactagattagctagacacagagcactgattggtgcatttagaaaccttgagctagacacagagtgctgattggtgcgtttacaaaccttgagctagatacagagtgctgattggtgtatttacaatcctttagctagacataaaggttctccaagtccccactagattagctagacacagagtgctgattggtgtatttacaatcctctagctagacataaaagttcttcaagtccccactcgactcaggagcccagctggcttcgcctagcggatcccgtgccagggccacgggcggagctgcccagcagtcccatgctgcgcacctgcactcctcagcccttgggctgccgatgggaccaggcgctgcagagcagggggcggtgcccgtcggggaggctcgggcttcacgggagcccaccgcaggagggctcgggcatggcgggctgcaggtccagagccctgccccacggggaggcagctgaggcctggtgagaattcgaatgtggcacaggtgggctggcggtgctgggggacccggtgccccctccacatctgctggcctgggtgctaagcccctcactgccccaggccggtggcgccagccggccactccgagtgtggggccctccaagcccacacccacccggaactcccgctggtccgcgagtgccgcgcgcagccccagtttcccgcccatgcctctccctccacaactccctgcaagcagagggagccggctccagccttggccagcccagagaggggctcccacagtacagcagcaggctgaaggggtcctcaagcatggccagagcagacgccgaggccgaggaggtgctgagagcgagcaagggccaccagcatgttgtcacctctcactgggaccacaggtgtgtaccaccatgcctgactaattttttttgtagagatggggtctcagcttggacattggaattgctagccaaagacattagagcaactgtcagcaatatgctcagtggactaaaggaaccacagatgaagaactgaaggagagcagaaatacagtctctgaacaaaatcaagaaagaggctgggtgcagtggctcatgcctgtaacgccagcactttgggaggccaagatgggaggattgcttgagcctatacgttcaatatcagcctattcaacatgacaaaataatttctctctctctttttttttttttttctgagacagtctcgctctgtctcccaggctggagtgtagtggcatgatttcggctcactgcaacctccatctcctgggttcaagcgattctcctcctcagcctcccgagtagctgggtttataggcgcccaccaccacacccagctaacttgtgtatttttagtaaagacggggtttcaccatgttggccaggctggtattgaattcctgacctcagatgatccacctgccttgacctcccaaagtgttgggattacaggtgtgagccaccgcacctggccaaattcttgctcttaaaaaaaaaaaaaaattggcacatgcctgtagtccagctacttgggaggctagagtgggaggatcacttgagccctgcggttggaggctgcattgagttatggtcacatcactgcactccactgggtgacagagtgagacccagtctcaaaaagatagaaactataaaaaggaactatacagaaattctggagcataaaagtacaataactgagatgaaaactttattagaggggttcaccaatagatttgggcagacagaaaggcccatacctgggtcagccctcttagagggactgatccatttgggagacatttgaaatttattctcttagatattttgaaatatgatacattattatttgaaatatgatgcattattatcgactacattccactgtaataaaaagaaaacatcacagtggaaaggccacactccttcattatccagttgggaacctcagcagcacagccaagtgatctgctaagctgctttggggaccacacctgtgccacttgtatagctcccagcacagcctggttcacaagaattccttatcctattgtggaccttttggcccaattaacacaggcccacaggatttaaagttgccattggtccttgtgaaaagctaaccaggtaatgtcagtgtgaggtcacatacaatgtgtgtgtttctgccctgcatttggctcagagccacttgtaataattttttgctgttgaggtttccttgatacttctctgaagtcactttttctttttttctttttctttttttttttttttgagacagattctcgctctgttgcccaggctggagtttagtggtgcgatctcggctcactgcaagctctgcctcctgggttcacaccattctcctgcctcagcatcccgagtagctgggactacaggcatccgccaccacacctggctaatttttttgtatttttagtagagacagggtttcactgtgttagccaggatggtctcaatctcctgacctcatgatccacccgtctcggcctcccaaagtgctgggattataggcgtgagctgccgcgcccggctgaagtcactttttcattaaatttttctggttaacttcaagtactgcgtgtctacctgttgcctaaactagggtatgcactgccccaattctgcagggagggtgcaaaacagcaaaattagatgtgacccatctttctggagtttcagttgtactgtaaaatttggaagaaacagtagtttattaagaatcatctttttttttgttttggagacagagttttgctttgttgcccaggctggagtgcagtggcatgatctcagctcactgcagcctctgcctccctggttcaagcagttctcccaccgcagcctcctgagtagctgggattacaggtgcgcgcaccaccatgcccaactaatttttgtatttttagtagagacggggtttcgccatgttggccaggctggtctcgaattcctgacctcaagtgatccacatgcctcagcctcccaaagtgctgggattaccggcctgagccaccaggcccgggtgagcaccatcttattaagaaaagacacagaagagcagggaaggggagaagtgttccaggaaacacagtccaggctctgacattgctccaggtgggatggagggactcaccccttactttgaataggatgcttttgaaggccacaggggtgccagttgtcctcttgacttgaatcccatgcagagactttgttggcagtttgcacacatccatcctctgctggttgagtcctctgagctgagtgtgctggtcacacagcaatgtgggcttcttgaccagcgccccctggcacctatttaagtccatgcttggctgacctgccatgctgtattgtcaggatccatggagctcgggatcttgttgctttctattctaaatgcaaggagacatttgaaatagactcggatattctgaaatgtccaaatatttattattgactgtagtcaccctgctgtgcagtagattagaaagttattcctcctgtccgaaacattgtaccctttgataaacaaccctccattatttctctctcccaccaccccagcctctgttcaccatcagtctactctctacttctgtgggttcaactgtttatttttagcttttaaatttttctttgatttttagagacagagtcttgctgtgttacccaggctagagtgcagtggctcaatcatagctcactgcagccttggactcctgggttcaagtgatccttctgcctcagcctctcaatgagctgggacaataggcctacactgtcacacctgtttacttttattttttgtagagatgcggtctcactgtattgaccgggttggggttcaacatttttatttattttttttatttttttattttttattttttattttgtttttggagatggagtctcgctctgtctcccaggctggagtgcagtggcgcaatcttggctcactgcaagctccgcctcccaggttcatgccatactcctgcctcagcctcccgagtagctgggactacaggcacatgccaccacgcccagctaattttttgtattttttagtagagacggggtttcaccatgttagccagggtggtctcgatctcttaacctcgtgatccacccgccttggcctcccgaagtgctgggattacaggtgtgagccacccggcccggccggggttcaactttttaagattcaacacattggtgatatcacgtggtaattgtttttctgaggtgatagatatatgttagttagcttaacttaatcattccatattgtatacatatatctaaacatcacatggtacccataaatgtatacaattatgatttggtaattaaaaatcatattaactgaaacataataggctgggtgcggtggttcacatacctgtaatcccagcactttgggaggccgaagggcaaagatcactgaggccaggagtttaatcagcctgagcaacatagcaatactctatctctacaaaaaaataggcttgttggtgtatatctgtagccctagctacttgtgaggatcaggcaagagtattgcttgagcccagaagtttgagattacagtgagctatgatcctgccactgtactccagcctgggtgacagaacaagaccctgtctcttaaaaaataatcggccgggcgcagtggctcacgcctgtaatcccagcactttgggaggccgaggtgggcagatcacctaaggtcaggagttcaagaccagcctgaccaacatggagaaactccatctctactaaaaatacaaaattagctgggcatggtggcacatgcctgtaataccagctacttgggaggctgaggcaggagaattgcttgaacccaggaggcggaggttgcagtgagccgagatcacgccattgcactccagcctgggcaagaagagcaaaactccatgaaataatgaaatgaaatgaaataaagaaatgaaatgaaatgaaaagaaaatgaatctcagccaccccacatacttggtttatttcttggcctcagctgtccattggtgccactttatttctagctgtgtggtgggtctttgggcctgcaggaagcaaaggattctttttcattttgttttgttttgttttgttttgttttttgagacgagtctcactctgtctcccaggctagagtgcagtggtgtgatcttggctcactgcaacctccgcctcatgggctcaagcaattctcctgcctcagcctcccaagtagttgggattgcaggcacgtgccaccacgcccagctaatttttgtatttttagtagagacgaggtttcaccatgttggccaggctggttttgaactcctgacctcaaatgatccacccacctctgcctcccaaagtgctgggattacaggcatgagccactgtgcccggccagcaaagtgttcttaagatgaagtttgacaaacatcctagaggccccctactggccctggcacttgccatagggatgaggctcaggtcacatcatctggtcgctcagcatggagggatttggttcctaagattatcgttggggacaggtgactccttctgggtttcctccactgctgctggtacattgagtggagggggttatgttaatattggtctcattttcaggtcgagtaagggactggcaggcatggtggcttttctggtggtcttctgccctaacacttgttcttctcagctggctgacttttagaagtaaccaaggtaaaggtgggaaaggcaggctagcttagactcctcctctttgagtagacagggaaggtggaatatactttggggaatggggaagaattggtgggacccccagaaggcaggggctgcactctcttgatggagccttcctccagtttcctatacaccaggactaggtatgtggccatggtgtagtcatatttgttttcccaacaaggactcctggatgtggtctgccttgaaccccatggacaccatgagctgtgtctttccgtggacttggtaatgagggagtggctcctggtgtggccttagtatcccctggtcgttattgactcatggatgccccataatctagcctattgtgttcctcttcctggggttgagggtaagcagtttgttcatgaggctttctagttctgaggaaatgaagaatgggattttgtaattcccgtaacatatctcgtcttgcagttccacaaaggtcagtctgacaaatggcaagaccttgtcaccatggtgtagagaaggtctcccaggctccacaaatccactggggcagggagaagggtggtcataattttgtccctggaagatttctgaggcagcataagggggactcccacaaaatgtgcccagattctggctaacagtgaacctgctgccaaagccagagtctgctgtttttatgttgtaattggtatccagaaggaagttctctggcttcaggtccctgtggacaattttcttctggtggcaatactgcacagtagatactgtttgcaggaactggcctcaggtctctttctcctttctgtggccatactctaggatgtagtcaaatagctctgctctgctggcacattccaggactaaatataatgtttctgttgtcttggttgcttgagagagtttgctgatattggagtgattcaggaccttcattatactgaatatatatatactttggtatagtctctggaggctggaggagctctgctgagctttgtggatgaccttcatggctatctgggtctcagtcagaatatgccaggccagcttcaccttagcgaagctaccccggccgatggtcttgaggaccctgtaattgtaaataagtgtctcctcaccagacaaggtgagaccctgctacatggtgactgatatggtttggctgtgtccccacccagatctcatcttgaattcctatttgttgtgggagggacccggtgggaggtaattgaatcatgggggcaggtctttcctgtgctgttctcatgatagtggataaatctcatgagatctgatggctattgagagtttccctgcacaagcgctcctctctttgcctgccgccatccatgtgagatgtgacttgctcctccttgccttctgccgtgattgtgaggcttccccagccatgtggaactataaatccagttaaacctcttggttttgtaaattgcccagtcatgggtatgtctttatcagcagcatgaaaaaggactaatatggtaaatgggtaccagtagagtggggtgctgctgaaaagataaccaataatgtggaagccactttggaactgggtaacaggcagagatttgaagggtttggagggttcagaagaggacaggaaaatgtgggaaagtttggaacttcctagagacttgttgaatggctctgaccaaaagcctgatagcaatatggacaataaggcccaggctgaggtggtctcagatggagatgaagaacttgttgggaactagagcaaaggtggctcttgttatgttttagcaaaaagactggtggcattttgcccctgacctagaaatttgtagaacttttaacttgagagagatgatttagggtatctggaggaagaaatttctttttctttttttgagacagagtctcactgttgttgcccaggctggagtgccatgatgcgatgtcagctcactgcagcctctgcctcccgggttcaagtgattgtcctgcttcagcctcctgagtagctgggattacaggtgcccgccaccacgcccagctaatttttgtatttttagtagagacgggttttcaccatgttggccaggctggtctcgaactcctgacttcaggtgattcacctgcctcagcctcccaaagtgctggggttacaggtgtgagccaccgagcctggccagccaaagaaatttctaagcagcaaagcattcaagaggtgatttgggtactattaaaggcattcagttttataagggaagcagagcataaaagttaggaaaatttgcagcctgacattgaaatagaaagtaaaaacttattttctgaggagaaattcaagcccttacagaaattacaagtagctgaatgttaactcccaagacaatggggaaaatgtctccagggcatgtcagaggtcctcatggcagcccttcccatcacaggcctggaggcctaggagaagatggtttcatgggccgggcctagggtccccgtggtttgtgcaaactggggacttggtgccctgcgtctcagcagctccagccgtggctgaaaggagccaatgtagagctcaggctgtggcttcagaggatgcaagccccaagctgtggcagcttccacgtggtgctgagtctgcgagtgcacagaagtcaagaattgaggtttgggaacctctgcctagatttcagaggatgcattgaaatgcctggatgtccaggcagaagtttactgcaggggcaggactctcatggagaacctctgctagggcattgtggaagggaaatgttgggatggagcccccacacagagctctccacagggagactgcctagtggagctgtgagaagagggccaccatccttcagaccccagaatagtagatgcaccaacagcttgcaccatccacttggaaaagctacagatactcaacaccagcctgtgaaagcagccaggagggaggctgtaccctgcaaagcctcaggggtggagctgcccaagaccatgggaacccacctcttgcttcagtgtgacgtggatgtgagacatggagtcaaaggagatcattttggagatttaagatttaaatgccctgctggattttggacttggatggggcctgtagcctctttgttttgaccaatttctaccattcagaacagctgtatttacccaatgcctttacctccattgtagcttagaagtaactaacttgcttttggttttacaggcttataagcagaagggacttgccttgtctcagatgagacattggactgtggacctttgtgttaatgctgaaatgagctaagactttgggggactgttgggaaggcaagattggttttgaaatgtgaggacattagatttgggaatggccaggggcagaatgatatggtttgactatgtccccatccatatctcatcttgaattcccatcggttatgggagggacccagtgggaggtaattgaatcatgggtgcaggtcttttccatgctgttctcgagttagggaataagtcttacgagatctgatggttacaaaaaggggagcttccctgcacaagcattcctctctttgcctgccaccatacataagatgtgacttgctcctccttgccctctgccatgattgtgaggcttccccagccatgtagaattgtaagtccagttaaacctctttcttttgtaaattgcccagtcttgggtatgtctttatcatcagcatgaaaacagattaatacagtgtgacctcctagctacactaactacaaatcctaagaatgctaaccagtaatactggtgctacaaactatgctaactaactaatgaacataatactaacaataccaactgtatactgactacactaacagtgataaccaacaatactaataatgctaaccagcaacattaactaaataaaaaatgaaaaaatgagaaaaacaacaaaggaagtggaagaaaaatgggaagaagatataagaatttaaaaagtgggacaaaagagtaaaggaggatgagaaaataaaaagaaaaaataataagaaaaaggaaataaaaaaatgacaaaaagaaaaatgaggacaaagacaaagtagagaaaaaagaaataaaatagaaaaaaacactacacatgaggaaacaacataattgtggtctctgtttgtcaggtcaccaaaaatcagcttactgggctgtgcagaccaaaaacctacatccagccaagtgcttatttaggtgtttgtaattccagaacaatggctccttataatatccagagcaagaaatgggccagttgtagctaggaataatccatagtggttttctcacttttggtctcaagaagcttttcctctttttttttttttttttaaagtgtttattctttaggtgggttatagaggttgatatttattttttttgaaacctgaagtatgctacaacagccttttttatttccaggttcaaaatctctaacaccttttggcttttaaacatgtcataatgtgtacactcaaaatattcaatacctttttctgaattaaactctgaatgtttggtctcaaaatgatgctacaaattaactgacatcatgataccctaaggaaatgttctgttgcataagacacaattgggtacattattaacatctgtagaatggagaggaggatatctattattataatttccccagaagatcatcatcggatttctcttcagaaccttcaggaacacaagttagtgggtggatgtattcagttattgatggaagaaaactgtcagttatgaattctagatccagcaaaactgaaatattgtcatatgcagcaacatggatgaaactggaggccattatgttaagtgaagttagccaagcacagaaaaacaaatattgcatgttctcactcacatgtcagagctagaaaagtagattttatgaaaatagagcatatattggtggggaagcagatagaggatgaaggggggggaaaaagaatgtaaatatatttattaccctgaactgtatacttaaaaatgataaagatagtaaatttcgtatgcgtgtgtgtgtttaacctcaataaaaaatattttaaaaaatgagggtggaattaaaacatcctcagatgtcttagtctttttgtgctgctataacaaaataccttaagactggataatttatgaagaacagaaatttgtttcccacagttctgaaggttgggggaagtccaaaatcaaggctccagcagatacagtgtttgataagttgccctctgctttcaagatggtcccttgtttctgtgtcctcacttggcagaaggaatgaacttgctcccttgagtccttatataaagtcattaatcctatccataagggtggagctagtatggcctaatcatctcatgaaagccccacctctttattttttatttttggtagagatggagtctcactgtgttgcccaggctggtgtcaaattcctaggctcaagtgatccttctgcttgggcctcaaaagtgctgtggttacaggtgtgagccacacctcttaatcctgttgcattggggattaagtttcaaaatgaattttggaggaacacaaacactaaaactacagcaccagatgattcaaaagcttaacgagtttgttaccactagatctcccttcatgaaggaagtcatgaaggttgaaataaaaggacattagacaggaaatcaaatctgtatgaagatataatcatgtctgataaaggtaaatacatgaaaaattataaaagctagtagtgtttctgttttctacatgatttaagagacttatgtatcaagaagttattagtctgtgttttggacacacaacacattgagatgtagttttgtggcattaatggctgaaaggtgatggggttggagctgtataggagcagtttttatatgttattgaagttaacttggtatacattcacatcagagtagtataacttcagggtgttaaatatcacccccatggtaaccaaaaagaaaataactgtaggatatacacaaaaggaaatgaaaaggggattaaaatgtttttctacaaagatcaactaaacacaaaataagataataatgcaggaaataggggacaaaacaactgtgaggcatatatacaaaacaaacagcaaaatgacaaaagttctgccttatcagtgtttaaatgtaaatagcttaaaccctgcagtccaaagacagattggcagaatggatagaaaaacatccagcttctagccataagagacccactttagatgaaagacaaaaaaatttaatgtgacaggatggaaaaagatactctcttcatatagtaaccaaaagagatcggggttgctacactaatatcagacaaaatatactttaaatcaaaaaagtttacgagacaaagcaggacattatatattaataaaaggtttaatacggcaaaaagacaaaacacactaataacagaccactcaaatatgtgaaacatgactgataatggaagggagaaatagttctacagcagtagttggggactttaatgggtagaagaaccaggcagaaggtaagtagggaaatagaatatagtacttgaacaatataagaaaccaagtagatcttacagacatacacggggcattctactcaacaacagaatgcatcttcttcttaagtggacttaggaccttctttaggatagaccatacattaggccagaaattaagattcaagagatttttaaaaatacgataccaagtattttctttgacaaaatgggatgaagtgagaaatcagtaacagaaggaaaactggagactttatgtaaattaagtaacaccctcttcaagaaccagtggtcaaaggagaaatcacaagggcaattagaaaaaaaaggattagaaacaatttaacagacagaaaataaaacattgcaaaacttatgatatgccacaaaagcagtgttaaaggaggaaatttacagctataaatgccttcattaaaaaaaggatgaagatctcaaatcaccaatctaactttttacaccttaacaaagtagaaaacaacaaactcaaagctagcagaaagaaggaactaatacagtagagataaataaaatagaaaaattcagcaaatccaaaagttagttcttggaaaagactaacaaaattgacaatcccttacctagattgactaggcccgagatgagaatctcaaattcataaccacctttctttgctcagttcctgggactgtactctttccaccttggacgatgccatctcctcaacctggaaagtgatatgattttattttattttattttatttttaacttttggaagattttttaatttcatgaataatggtaatgattttttttaaattatactttaagttttagggtacatgtgcacaacgtgcaggttagttacatatgtatacatgtgccatgctggtgtgctgcacccattaactcgtcatttagcattaggtatatctcctaatgctatccctcccccctaaagtgatatgattttatatgtagggaactgtaaaaatttctcacacataaaacccttttggatctgataaactcattcagcaaaattgcaggttacagaatcaacaaaagttctgtttctataacattaacaacgggccgggcacagtggctcatgcctgtaatcccagcactttgggaggctgaggcgggtggatcacaaggtcagaagttcgataccagcctgaccaacatggtgaaaccccgtctctactaaaaatacaaaaattacctgggtgtggtggcacatgcctgtaatcccagctacttgggaggtgggaggctgaggcaggagaatcgcttggaggcaggagaatcgcttgaacccaggaggcggaggttgcagtgagccgagattgtgccactgcactccagcctgggcaacagagcaagactttgtctcaaaaaaaaaaaaattaacaatgaacaatctgaaaaggaaattaagaaagcagttatatttacaatatcatggaaaagaataaaatagtaaattaggtaggagaaagacatgtatagaaagctacaaaacattgcaaaaagaaattaaagactttaataaatggaaaggtaactcatgttcatggatttaaaaacttactattgttaggatcacagtactccccaaagtaagaaatgcaatgcagttcttactaaaatctcaatgatggttttgcagaaaatagaaaaatccatcctaacatggatacagaaaatcatgggatctccagtagccaaaataatcttgaaaacacacaaccaagttggaggtctcacacttcctgatttcaaaatgtactgcaaagctacaccaatgaaaacagtgtggtaatggccgaggttcatatttggactgttggggtttttcaccttagtattcgctatctttttttttttttttttgagacggagttgcgctctgtcacccacgctggagtgcagtggcatgatctcagctcactgcaaactccacctcgtgggttcaagcgattctcctgcttcagcttcccaagtagctgggactacaggcgcgcaccaccacgcccggctcatttttgtattttttagtagagacggggttttgccatattgcccaggctgggcttgaatccctggcctcaggtgatccactcacctccacctcccaaagtgctgggattgcaggtgtgagccaccacacctggcccagtcccactcttgtacatacatcaccaccacctatttccagaacctttcctcatgccaaccagagactatgcaaattaagcagttattctccatttttttctctcccagccatacttgatagaacatgaatatcagataagtgctatggagaacagtaacacagggtgaagtgaaagtgtgccattttatgtaggatggttggggaaagatggcatttgagccactgatggtgcaggagagggaacaagtgtgatattgaggccaggtgtgcttagcagtttgaaagcaaagctagaagtacaggcgaggcagaggcacaagatgaatgttttatattttattttttaaataaaatatttttatttattttaaaaacaatttttttttttttgagaccaagtcttgctgtgttacccaggctggagtatagtggcatgatctcagctcactgcaacctctgcctcctgggttacaagtgatttctcctgcctcattctcctaactgggactacaggtgcccaccaccacgcccagctaatttttgtatttttagtagaggtggggttttaccatgctggccaggctggtcttgaactcctgacctcaagtgatccacctgcctcagcctcccagagtgctgggattataggcatgagccactgtgcctggcctaagaaaaatatttttaagaaaacagagacaaggtcttgctgtgttgcccaggctggtctccaactcctgggcttaagcagtcttcctgcctcagcctcccaaagtgctggagttacacttgtgagccactgcgcccagcctattttattttttttatttttagagtcagggtcttgctctgtcacccaggctggagtacagtggtgcgattgtagctcactctaacttcaaagttctgggctcaagcagtcttctgtccttggcttcgcaaatcactgggattacaggtgtgagccaccacacctggctaatttttaaatttttttgtagaggcagcctctcactatattggttaggctggatttgaatttccggcctcaaatgatcttcctgccctagcctgtcaaattgctggggttacaggtgtgagccaccaccccagtgtttgtttttttgttttttttttttttttgagacagagtctggctctgtcgcccaggctggagtgcagtggcgctatctcggctcactgcaagctccgccttccaggttcacgccattctccagcgtcagactcccgagtaggtgggactacaggcgcccgccactacgcccagctaatttttttttgtatttttagtagagacggggtttcatcgtgttagccaggatggtctcggtctcctgacctcgtgatccgcccgcctcggcctcccaaagtgctgggaattacaggcgtgagccactggcccagcctcctgcgtttggttttttaattctgcttgtttgtagtgacattcatcaagaatgaatgactttaaaacaacaacgaaaaatctttagggatttttactcttgggcaagcatgcttctgtctctgagcattagttttctcatatatcagataaaagggtttggagtatatcaatgatattctggttgtggacagaactcttgagggttccttgaacatgatcctttggtagcattggattgctctcggccatcccacgaatagctgtgttttatctgttttttgcttaagatttaacatatgagttcatttgaaatgtttctgttgccacaaagaaacaaaatccctggctcagagttttaaggggacttactgttctaatgctactcactcaggctttggttgagtagtaaacagactacagcttgtttttaagttcagtgatcttcaacttacagcccctgtgttttacaaatgagttaaattaagatcagtatcttctgttcaaattctttttccaaagaaatccaaatgtgccataagctgataggtctctggccatgaaatatggtttcatagttacattgagattgttgagtagctacagggaaactgagaatttacattctgaggcaaatggtttaacctaagaggaataagattaagtaaactgtgtattagctcctcataatgtggcaggaattcagtgttagcggtggaaaagccacaggagcttaatgtggtaggtaaggaaggtttatgttagttcctttccccgattatcccagttgctgtgcattgccatctcggatcagtttctagccatgactacctaaaagttgtctgagggaggctgtgcactgggtgatcttgtgaggcaggtggacgtctattctgccaagatcttgtgggcccagtttgagaatgggttttaagttttagtccttttacacttcctttgcaggaatgtagcttttgaaatagaagcaaagtgttgtgaaacctttgacattctgttctttaacacttcctcctcagcctgaagatctcagcttttgcttgggcgttacaacaccccatggtacctgaacctcaagtaagctctgttaggttttcatatctgcccgtgtatgatggtgactttttttttttctgagacggagtttcgctcttgttacccaggctggagtgcagtggcgcaatcttggctcactgcaacctccgcttcctgggttctagcgacttctcctgtctcagcctcccaagtagctggaattacaggcatgcaccaccacgcccggctaattttgtatttttagtagagacggggtttctccatattggtcaggctggtctctaactcccgacctcaggtgatctgcctgcctcggcctcccaaagtgctgggattataggcgtgaaccaccatgcccagcctcgatgatgacttatgagtcaatttgactggtcctcaggtgcccagatatgtggctaaacattattctgggtgtgcctgtgagggtgtttctggatgagatttggtggactgagtgaaggtggctgccctccccagcgtgggtgagcttcatccacgggaggctgcttagagaaggaggctgagcaggaaagtcttctttctccgcctgaccgtgcttgagatgggacataggtgttctttgccctctggactccaggctgcaactagagcttaactctgtcagctctcccgattctcagacctcccaactgcaggtcatgggacttctcagcctacataatcctgtgagccaattccttgtaataactgtctttatgtgtaatctattggttctgtttatctctggagagcccaaatactccagcaataatggagtcactttttcccagagataggttttatcttggaggattcttatattgatccttcccatatctctgtttcagaaacacttcctacaatgtagagtgctaatagctggtttgtgagtaccccttagatatactgggatgagcaataaggtcaatgctgtcacctaaccgtctgttgattgtcaagcctttgtgtggaagcaaggaaattcatctagcaatcataacaaaggcaaagcctggagtgtaaggtggttaggtttttggctagcaagagctgcagaaaaacagcctctagcttaaactgagttataaacatatggaactagtgtaggccttgaaatcttttgtggtcgaatcctctttgtaggggaacctaggcaaaatcatgtcatttccactgccggtcccatagcgacttcagttaaggtatagacctatataaagtgttttatcccttaaaaagcttcatctcccatttgcctgtggaatcctccctacaaccctaagaggtggagaggaagcctttcttacagataaggatggaaattgtacagatgcacgaatttgtttctaaagctaagtagaaacaagagtaccaagaggtcagatttttccagcccccaaatccttggcgtaagtgtataaaaagtaagcacagctgttcttgaggtttctcagcctgttgcctcctccccatgttaaaattctggcctgtattcttctaagataatctctgtacccagttgaggattcaacatctaggtatcctctttgggaagcgttcttaaagccctcatataatgggttagattcctgatcacctctaaccccttttgtgttgagagtttcttttgattacgaagtcatacatagtcattgttttaaaacttaaaatatggcaaaccatagtcaaagtcctctatacccccccatcccactcggaggaagaagtcttgactattcttatgacatcatacatttattgccattttcctgtctgcttatccagggtctccttaaaccaagcttgaggtagggagactatcttggtcatctttgcatctctagcagttgggctggtgcaggtgcttgggaaatgaatctgtgttaagatcaccagcctctgaacaggccttatgtaccaaggtctgtgtccagattggcatgacctctgagttaacagtcctttatttagatctttaagactgagttctctgccacagatttgccctctggaaaaaggcacctctcctctagagcagcagctgtcaacctataaatcctgttttgaaaattggaattttagttaaattacagggacagagtgtgattgtatacaatttaattaacatattgaaatagggatgtgaataagactactttaggcattactgaaaagcaaccgagcatttaatgttttcatttatatttatgcctgccaaactgtggcaccagccccatcaagatgtctgtggtgcacttaactgtgcagaaggtgtggagcctttacatttcctctccctggacttggtaccatgtttgcatgttttgccagttatcttaaagtgggattttaaatctattgtaaaacaaaaataaacttcatggtacttaatgccactgaaatatacacttaaaaatggtgaaaatggtaattgttttaatattttaccacagtaatttatgtaggaatactttctataactttgtgctaataaatttgaaaacccggaggggaaattgtgctggcagtgttgaactatgggtcagtttgttctaggctacagatagactttcctgtgtgaagattaaagatgaaaaaggctaaggaggagggacaagggaaaagaaaagtggaaattttaagggttcctgctaactcttcccaaggaattggaaggagtgtttactaagtgttccattcccgtttaagctctcttctcccaacacagttaaccaagcaaactgttacttattctttataataaaattcctccccgtcacagtttttcttaacctcctcaagtcttatcacccccctacttcccaccgtgaccctcaaaatggaagtgattatatgaagacctgaaggattacttaaatctcagtgagtattgagtgccttctgggagtggggagtgagatggggtgagagttactggtcagacaaacttggagtactttggaaggtttgctttggggcatttcttattgttgaagttacctggaccccacttcagtgggagagcctgagggtggagattagaagcagaatctgtttagctagattaggatccagtgagagcttctgcctcaactgtcctgttcagaaagccactcctcctctaatgtggaatagcttcacagtttattatgaaaaaatgtcagacatatacaaagcaaagagactcagtgtaaaagatacactctcctacctactttcaacagttagcattttctgtatttgctttatctgttctttcagttgagctactacaaagtaaattagacctcatgatacttcacctgtaaatgctctcaagtcctttaatctagaatgtggtccctccttccctttttctgtcattatctttagttttggaaagatcaagccagttgtcctaacagagtgtcccacattctaggtttgtctgggtgcatcttttgatgtttaatgtatttctctatccccactctttcttgtgaagtggaagttgggtctaaaggcttgagtacatttagcttatatatatatatatatatatattttttttttttttttttttttgagacggagtctcgctctgtcgcccaggctggagtgtagtggcgcgatctcagctcactgcaagctccgcctcctgggttcaggccattctgctgcctcagcctcccgagtagctgggactacaggcacccgccaccacgcctggctaatttttttttgtatttttagtagagacggggtttcaccctgttagccaggatggtctcgatctcctgattttgtgatccgcctgtcttggcctcccaaagtgctgggattacaggcgtgagccaccaagcccggcctagcttatatatttttgacaagaatacttcattaggaaccttttaatgtctgattgttccactattagagacagtaagtttaatcatggtattaaggtagtcacagccatatcactgcattgtaaagatacttttccttcccctacccccattcctgtgtgattaggaagtgctctgtggggtaatactttggtgccatgtggatcttttagtttcccatccacctttcacctatggtatcactggtgatgtttacctgaatcccttcattaaagattgcaaaattattttttatttcaatcattttaaatacattccttctactggcattcacctgttagattcccgcccccccccccgcccctgcttttcaactaatatagttcctacttaaaagacaggatacattgttttcctctacctacttattttcagagtgaggagttattgttagaagtattcactcatctttaatgaaattgttttgttcatcagattatttcaggagagcaagcaacaagtgagcaaaataatctgggcctggcaggactacagaggtcaaaagggaggacatgagaagccacaagctgtcccacagagatggcagccttctccctcccatttagcggggctggaaatgagctccctgtgactcctttctgtccttccccggctcctcccagtcacctcagtgtgagtgatgagtagtgcagtgacagcctcgaccacataccacatttctgtcctgtaatagctttgctaccgacaactttctttctttttttttttggtaccaaatttctttatttgaaggaatggtacaaatcgaagaacttaagtggatgttttggcacaacttatagaaaaggtaaaggaaatcccaacatgcatgcactgccttagtgaccagggaattcgccccatggctatggggaaattagcctgaggcttagttttcattatcactgtctcccagggtgttcttgttaaagatatattctgccaagccagattcgggggctcccatcttgtgcaagttggtcacgtggtcacccaattctttgatggctttcacctgctcattcaggtaacatgtctcaatgaagtcacacaaatgggggtcatttttgtcagtggctagtttgtgcagttccaatagtgactgattcacatttttttccaaatgtgatgcacactccattgcattcagcccactctcccagtcatcacagactggtttcttgatatcctgaaggaagatttggccaccacgatagttttgcagcttcatcagtttctcggcatgttccctctcctcatgagattggtgaagaaagtatgtggcaaagttcctcaaagccacatcatcgcggtcaaagttgtaagacacggacaggtaaacgtaggaggcgtagagctccaggttgatctggccgttgatggcggcctctgagtcctggtggtagttctggcgcacctgcgaggtggacgcagttgtcatggcagcaactaaggagaggtggcggcggtggctgcgcggcgctggagcggcggcgggggccttgggatggtccgagggtgcagtgaagaggggacagagggctggctacgggcggccggccggggtgggggacgagcgctgggttccgtccaagcactgttgaagcaggaaaccccgacgactctcggcgaagaatgtctctgctacccacaactttctcactgtgccaaaatcagtgcctgtccagtaccctcgccttttctacctctcctctgctagcgatactgtgtttaagtcgagtgaccttcctctccttcctcaccatccctgcttctcacacttacccatactcttactaaatcagcttaccattactcttgctaattcaactcaagtaatacaattaaacacctcctaaaatgaagaaatcccttacatcttcagttaacctctgtcttagttcctttgggctattgttgcaagatatcttagactggataatttataaacaacagaagtttattgcccacagtttggaggctgaggaagtccattatcagggctccaatagattcactgtctagtgagggtcacacttctggatggtgtcttttatgtgtcctcacatggtggaaggggcgaggtggctcgctgcagccactttcctaagggccctagtcccattcacaaggtccctgcccttcctgacttaatcactcccccaaaggctctacctctacttttttttttttttttccccgagacagagtttctctcttgtcgcccaagttggagtacaatggctcagtctcggctcactgcaacctccgcctcccaggttcaagtgattttcctacctcagcctcccaagtagctgggattacaggtgcatgccaccactctgggctaatttttatatttttagtagagacggagtttcaccatgttggccaggctggtcttgaactcctgacctcaggtgatccacccacctcagcctcccagagtgctgtgattacaggcatgagccaccacacccagccaggccccacgtcttaatactgtcactttgggccttaggctccaacatacaaattttgcaggggcattaacattcagaccagagcagcccctctacttagatgtacaccaatgtaaaaattaacatgaactctgatatgctccactgaatacagagactcaaacatggcaccctcaatatataaaatcagtatgtttgcaaaattgcatctctccagaggacagaatctgaaccagttgtttaaccagtaagtttcaaacagtgaaaccaagtaaataacagttattcaacaataaattaggacacccaagaagtcctgggtaaccaccgtcatgggaaacagaagacaggtctttcactaggacagaaggcataaaattggactaaatttattgtatggttcttttctgggatcatgattttaaaatcaactaccaagaaggtttgaaaataaaaatcaaaagtcgaccatgattttcttgggggaagagaaaacagctcctgaaccaaagatcactgtcgacactggcagagcagatcccataggaatggtcatacattttggttggttggtttgtttgtttattttttgtagagatggcagagcagatcccataggaatggtcatgtgtgtgtgtttggtttttttctttattttttatagagatggggttttaccatgttaaccaggctggttttgaactcctgaactcaagcaatccacccacctcagcctcccaaagtgctgggattacaggcatgagccatcgtgcctggcctgggtcatatgtttaactctttgaggaactgccagactgttttccaaaatggctgcaccactttacattcccaccagcggtgtagaagagttctaatttctccacatgctcgtcaaaactcgttttctgtttttttttttaattctagtggtcctagttggtatgaagtggattcttctttcttttgaccatcactggggtctgatttgccctgataccatctcttgctgcagccttcatgcctagtgcctgatcctgcctcaccctgctgcgcgttggcattcagatttgacttaaaatccgagtggctcagcctctgctctgaattgtcccttcagtcaggtgtttgcaactagtctcctgaggagttgctgggtttgagtcacagaatacaagagggatgccccttccaggatctgggggttgggaaagtgtggcaaggcaggtttaagatagaagaggaagtcagctgtagcaagcaaacacatagacctgggctgtgggaccctcggaagggatatggagccaagctcttggagtgcctgaggaattagcccaaggagctttggctttcagtagctgctcctgtgtgtagcaaagcaggctggagtagagtgaagggagcctggggtaaggaaataaattaggagtcaagaagtaatgatgcaactaggattgtggaaatgtaaagaggttagggaaagatttgtatggctggggctaaaccagatgtgatggttggggtaaagggacataggaagtggttttgggtatgagaacaagagaaagtgttcctcttgggaaggacagacggggtgagtggaaagtttctgtctaatgtgactttaggtgctaacacaacacaaggcagacgtttgcagcagagaattaagaaaagctgaagctggaatccagattcagcaatcgtgaatgcagtgagaactgaggcaatgcagagtggctgctgcttccatgtcatcccctcagatagatatctgcagcctcctggcctctgactataccttttatttatttattttttaaagaacagcttcattggaatataattgccatacatgttgaaactatacactttgagttttgacatacatatgtatctatgaatacataccattcaaagatggtatgtattgtgtgaaaccatcaccatagtcaagagaatgaacaaatccattaccctgaagtatcccagtatttcttcgtaattcaccctcctgcctactgcccttccttacccctctccaggtaaccactgatctgctttctagttcgcattttctggtattttgtataaatgggatctgtatatatactttaagtatactgtgtatttatttgggggggagtatctggcctcattcgacattattattttatttgtgctgtatgtatctatagttcattcctttttgtagctcagtggtatttcattgtatagctatatcacagtttgattagcctttctgttgatggacatttgggttgattcacgtttctggctgttacaacaaaagctgctgtgaacactggtgcacaagtctctgtctagatctgtgttttcatttcctttgggtaggtagctgtttcggaggggaatggttggggcatatggtaggcatatgctttaactttgtttaaaaagttgaaatacttaatacatcataaaatttgcctatgtaaagtgtgcgtgttttgttttgttttgttttgtttttggagacagggtctcattctgttgcgcaggctggagtgtaatagtttgatcacagctcactgcaccttcatcctcccaggctcaggtgatccttccacctcagccccacgagtagctggaactaagggcacatgccaccacacctggctaatttttttttttttttttggtagagacaatgtctcactttgttgtctaggctgctctcaaactcccagcttcagcctttccaccttagcttcccaaagtactgggattacaggcgtgagacactgcgcccagcctaaagtgtgtgcagttcaaatattcacaaggttgtacaaccgtcaccatctaattacagaaccgtttcttttctcttttcctttcctttccttttttctttctttctttccctttttttttttttttttttttttttttaaggaaacagggtctcactctcatggagctgggaccacaggtgtacaccaccacacccagctgatttttgtaattttttgtagagacagggtcttgccatgttgcccaggatttcttcaaactcctgggctcaagtgatttgcctgtctctgcttcccagagtgctgggattacaggcatgagccaccacacccggcccagaacattttcatcaccccaaagtatatatctaacttttaaaatggtttttccctttcacattcttaccagcagtgtacaggagttccatctgctccatatccttgccaacacagcatggtcatttaaaaaatttttagcctttctaataggtatgtgatggtgtctcattatgtttttaatttgtatttccctaaagattagcagtgttgaacagacatgttttcacctgcttattctttggtgaagcatctattagatcttttgcccacttattttattgggttggtttttttcttactgtgtttgagagttctttgtatattctgattacaagtctttttgtcagatatgtgatttccaaatattttctctcagtctgtgtctttccattctattaatagtgtttttggaagagcagaagctcttagtgttgatgaagtccaatttgtcaatccttctagggattgtgcttttgatgtgctatctgttaaaagacaaaattacaacacatttaaagatcttagttggcttttatttgcaattcgtgaatgagggcagcttccattctacaaaataggatgaaaactcccaatgggcagtagcagaagaatgggctttgtaaggtgggaacagtgaaacagtaattgaaagataactgattggttaacatcaggttacttttttgtaaggattaaagcagagggtagttccttatcatgcctgctaaaactggcttgtttgggtattctgtctctcttgattttttagaaggtcagataaacaacttacttttcttttttccttttttctttttttttttttttgagacggagtctcgctctgtcacccaggctggagtgcagtggcgcgatctcggcttactgcaacctttgccttctgggttcaagctgttctcctgcctcagcctcctgagtagctgggactacaggcgcctgccaccacacccagctaatttttgtatttttagtagagaccagttttcaccacgttggccaggctggtttcgaactcctgaccttgtgatcctcccaccttggcctcccaaagtgctgggattacagcactggcgtgagccaccacacccagcccacaacttacttttcgtttggtgacgtggaactttagctagagtgactctgttttgtttgatctagtctcttgaggcctagtacaggagctcagtccaaatcagtggcctcctgtcatttttgtttaacatatctaggaaatccttgcctaacccaagatctgacagtcttttgaaatgggactggattttaaactaagctaggatctcaggtatccagaaggcatttaagtttataacgtgtctcaccggatacgctggagagtcatgggggaggagaagaaagccagttacaaaagtacatcatcagttgttcagtcatctgtcagtttatgtgtgaatgcccctcatgagccaggtctgtaatccagtgggcagtccccatctcctgcattgtctctgtgacttatagtttcgttctttctgctgtcaaatgaatatataaagaaaatatccaaaaacttaataaattgtaattaagaaggcaaatctcccatctttctcttcctgaaaaaatccaagtgtaaatgattttttttttaacataaagcaaatcgttatactactcttttccataaagcatttgggaactgattgcttgttagggtaacctgaaagctctgccactatttcccctaatatttaaatgttaagaaagggaatgtgactttttttttttttttgagtcagggtctcactctgtcacccaggctggagtgcagtggtacaatctcagctcactgtaacccccacttcccgggttcaagcgattttcccacctcagcctcctgagtaactggcactacagacatgcaccaccatgcccagctaatttttgtatttctggtagagacggggttttcatcatgttagccagggaggtctcaaatttctgacctcaagtgatccggccgcctcagcctcccaaagtgctgggattacaggcgtgagccactgggcccagcctacaattttaagttctataattggtagaaaatttcctcagtttggggggctcatcttcaagagtggagactaaagtaggttctgtaattgcgctggctaaagaacaaagaattctatagcactgtgagctggagaatgttgtagcaggttaataaggggcttactccattttgtcagtaaccagcattggttccaggaattcaagaggtggtgagatattatgcttaatggtaataagataccacttattggtaatgtaccaggcattggtctctggcatcttaccatctttgtactcatatcttcacaggagcacaagaaaattaaaccatccaccttttacagatttagggatttagtagaaggctgaaggaggccagataactgaacttttacttgtacagctaatattaagtcggtgcaatagtaattgcggtttttgcaattacttttaaagtttcagaaccctgatttgaagcagagcgtctgggagtctcttcgttctgttataccagagttgttcttgtatgtgaataaggagcgtatctgaatgccttggcttcagccctggaagccattgcattctgaccaacctttgtgtaaccattttgtagactgtgaggactcttgtcactccttaaattctctcctaaacatattatattttgcttctgaagatgatccaaataccctcaaaactcaggtggagatactgttaaaagatagttttcaaaaagggtaagatcataactcattttaaatataaaatgaacacatgttaaaaattttaactcataagacaagcagttacaaccagttcagggagagtaggacaacaaagagcagacatacatgtagtaatgtcagtaatgtcgaaatgaacacaactggcttttccacagggaaggattatcaagacagttcatttacttatccatggacaagagtgatttgcatttccctcagttctacacaacttagagttgctgaagggcagtgaaaggctagaatcatataacctagaaggatgtgttccaaagcttagagtataaatctaaatattgcagtttcccattggaaacatcccatggtcttttttaaaatttgtttacagaatgtgagagtttataatactattgtctcgtttttttttcttccataacatatttaaaattcttgcttaaaaatgtttttgatggggatagggggttgtgaattaaattcctaacatgtcctaatagttacatgttatgcctaatctgttagtgtacttgggtgatatgacacttattttaagcctgatgcacttagaagcatgttctactttggatatctgttctgaggatggtagctacaaaatgaacttgtgccctttcgcaaattgttggacttgtggtggttgtcttgtgtccctagtatctgatttggaagactcaattaagggtttaaaagcctgcagaaggcgcgggccgccacgcctaactggttttcatatttttttggtggagacggggtttcgctgtgttggccgggctggtctccagctcctaaccgcgagtgatctgccagcctcggccccccgaggtgccaggattgcagacggagtctcgttcactcagtgctcagtgttgcccaggctggagtgcagtggcgtgatctcggctcgctacaacctccacctcccagccgcctgccttggcctcccaaagtgccgagattgcagcctctgcccggccaccaccccgtctgggaagtgaggagcgtctctgcctggctgcccatcgtctgggatgcgaggagcccctctgcccggctgcccagtctgggaagtgaggagcgcctcttcccggccgccatcccatctaggaagtaaggagcgtctctgcccggctgcccattgtctgagatgtggggagcgcctctgcccggccgcgaccccgtctgggatatgaggagcccctccgcccggcagccgccccatctgagaagtgaggagcccctccacccagcagccgccccatctgagaagtgaggagcccctccgcccggcagccgccccatctgagaagtgaggagcccctccacccggcagccgccccgtctgagaagtgaggcgcccctctgcccggcagccaccccgtccgggagggaggtggggggcagcccccgcccggccagccgccccgtccgggagggaggtgggggtcagcccccgcccagcaagccgacccgtccgggaggtggggggcgcctctgcccggccgccccttctgggaagtgaggagcccctctgcccggccaccaccccgtctgggaggtgtacccaacagctcattgagaacgggccatgatgacgatggcggttttgcagaatagaaaagggggaaaggtggggaaaagatagcgaaatcagattgttgctgtgtctgtgtagaaagaagtagacatcactttgttctgtactaagaaaaattcttctgccttgggatgctgttgatctatgaccttacctccaaccatgtgctctctgaaacatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggcctcagggtcctctgcctaggaaaaccggagacctttgttcacttgtttatgtgctgaccttccctgcactattgtcctatgaccctgccaaatccccctctgcgagaaacacccaagaatgatcaattaaaaaaaaaaaaaaaaagaaaaaaaatttttttaaatataaggtaatctacatcttctgatatggaaagaggtctatctatatattcccctaatatatgtattaactaaaaaaaaaaaaattaaaaaaaaaaaaagcctgcagaaacttacgctgttaggtaagagttggcagtctgactcccctaggagtgacttcccccttccccctttctaatgtcagcaagagataaatgctatatggccaaaatttttgattcctttgatcttaactctttgtggtgttgggtggagagtggttgggagagggtggcaaaaaagttcacctttcaaccagtcttccagtcagttggatcatcttttgaactgaaaggctcttggatcttttttttttttctcccagaaacagagttttgctctgttgcccaggctggagtgcaatggagcaatctcggctcactgtaacctctgcctcctgggttcaagtgattcttttatttatttatttatttttgagacggagtctcgctctgttgcccaggctggagtgcagtggcacggtcttggctcactgcaagctccgctcccgggttcacgccattctcctgcctcagcctcccgagtagctgggaccacaggcgcccgccaccacgcccagctaattttttgtatttttagtagagacagggtttcaccgtgttagccaggatggtctcgatctcctgccctcgtgatccgcccacctcggcctcccaaagtgctgggattacaggcttgagccaccgcacctggccttgggttcaagtgattcttgtgcctcagcctcccgtatggctgggattacaggtgtgagtcactacacctggctaatttttgtatttttagtagagacggggtttcaccgttgttggccaggttggtctcaaactcccaacctcagatgatccacccaccttggcctcccaaagtgttgggattacaggcgtgagccactgcgcccggccgacatcccttcttaatgtccttttcttaaatgtatgaggagtgggccactgagcagggagagccctggttggggtcctttgattggagaatagcagtaataatggggaggagaggtagaaatgcaacctggacatttgtaggtctttggccacagcttgtgttcagatgggaactggtaggccacctggcttttagtgagactgttcaccttgccttctgttgagccccattgtcttggtcaactgtagttcagtctgtcttccgttagtctccacccttcctccactagcagagaagaggacacatttgcctttcacctggtgtaacatccctcgcctcttccccttctctcttttcttagtagcagtgccgtaccacattctgtgggcttcctgatttgagaactctggggcttgtatcccatggatggtggtagaggttaagtttaagttttctccatttgtcctgagcaggcataatgttatgctttgcattatttactacacttgttttggagcattaaaaaattccaagtgtggagacagattatcctttacctaaatgaatttgttttactttgggatgttgttggaagtggtcataaggaaattgttgaggaatataaatctagccccatgaaatgcctgttaagtagaattctttttttttaacttgacaagtaatttttaattgataaataaaaatggtatatgtttgtggtgtacaatatgatgttttgaaatatatatacacacattgtagaatggctgtatcaggctatttaacatttgcattacctcacatactttttttttgtggtgtgaatgtttaaaatctagtctcagcaattttcaagtatacagtacactgttattaatcatagtcaccatgatgtacaacagatctcctatttctcctgtttaactgaaattttgtgtcctttggccattgtctccccagtcaccctaccctcaggttctggtaactaccattttactctctgtttctatgagtttgttttctttagattccacagataagtgaggttatgctctatttgtctttcctgtgccaggcttatttcactaaatgtaatgttctccaggttcatcctcgttgtggcaaatgacataatttctttgttttaaaaggctgactagtattccattgtgcatatatgccacggttttttttttctttttttacaggcagggtctcactgtgttgcccaggctggagtacagtggtgcgaacacagctcactacagcctgggtctcccaggctcaagtgatcctgatcccttagggcccagctgcctcatcctcccaagtagttgggaccacaggtgcacaataccacacccagctactgtattaatttttttagagatggggtttcaccatgttgcttaggctggtctcaaactcttgggctcaagcaatccttctgtcttggcctcccaaagttgcaggattacaggtgtgtgccactatgcctgaccaactacgttttcttgatccattcgtccatggatggatacttaagttgattccatatttcagttactgtgaataatactgcagtgaacatgtgagtgcagatctcttccacgtactgattccatatcctttggctatatcattggatcaaatgggagttctatttttaatactttcagcagcctccatactgttttccataatggctgtactgatttacattcccaccaacagtgtgcaagggtgccattgctccacatcctaacaccaatctttgtctttttggtagtagccattctaacgggtgtgaggtggtatctcagtgtggctttagtttgcatttccctgatgattagttgagctacacacacacacacacacacacacacacacacacacacccctattagtcatttgtctattttcttctgagaaatgtctttttaggtcctttgcccattttaaaaattagattatttgttttcttgcaattgagttgcttgagttccttatatgtttagggtattaagcccttatcagatatatgttttgcaaatatattctcccatttcgtagattatctctgcactctgttgtttctcagtatgattctttttttctttgagacagggtctcactctgtcacccagccgctggagtacagttatatgatcactgctcgctacagccttgacatcctgggctcaagtgatcttcccacttcagcctcccaagtagctgggactacaggcgcatgccaccacacttggctaaggttttctttcttttgttttctgtagagatggggtctccctatgtggcccaggctgttcttaaactcctgggttcaagcagtcctcgcaatgtattgggattacaggcaagagccactgcacccagcctctattgttcttataatacttgataataaaacacatgtgactgccttgcaaaactccttagaactcctcaggaggactgtctccaatctgatgaaactaaactatcactagcagattttcacacctaatcagagaaaactttgtgttacacagaattgtaaaaatttgcattgaagttttaaaactttaccctgctcagccaaggactctataaaagctgctccagtcaatcattgtgatcaatttctgtttagtttttgagatggagtcttactctgtctcctgtgcagtggcgcgatcttggctcattgcaacctctgcctcccgggttcaagcgattctcccacttcatcctcccaagtagctgggattacaggtgtgcacctggctaatttttgtatttttagtagagacagggtttcaccatgctggccaggctggtcttgaactcctgacctcaagtgatctgcccgcctcggcctcccaaagtgctgggattacaggcatgaaccaccgcgcctggccaaagagccagtatttttattgtgtgtcaggagggaaagaagatggtgtagatatcaagtagtgaaatgagtaagggctataaattgagtcttgagatgtttgaagagtatatattaatcctagtaaaatgccttagaattgtttagaccaacactgtatagtagaactgtccaatatagtagctatggctgagagactgtatttgagatcatgcaatttcctttaaatagccaccggtggctagtaactgttacattggacagttcaggtttaaactagttttctcaatttttttcattattgtacctctcttttacccctaagcctttttagacctttttttcctaatgtctcccctgcttcaatgaaattttaataccgtggatatgctgtgcatacattgtggctcctagagggctgcagatccatgttaattatcacctctgttaggaatgtgtggtctagactaatcagggattggcatcatagtgaagcctaaccaactgttgttatatttcttgggcagttaaaatcactaaaggctaatcatacttacgatgagtattattcagaacttcagaactgagaaagtttttggagttttggaagtttataaaatgctcagtcatcctgtttttcttcatatgtgacattcttaaagcatcaacttgttttagtaatggatagtacttgtacaaagatacagacatttaaagaaataaaaggagcctaatccagccagaggtaggcaaccaagaagttaaggcatctagaagccatgttgcttgcagaagagttgagagaaccagagatgtacagttttggtgatcgatagactgggtgtctcaaataataagggatatcacatgggaaaaggattagattggtactttgctgcctcacagaacaaggcagggagaagaactacacagagacagaatctagttcactgcatgattttgcagctagaatagtttgaagatggaacactgcataggaggaagttaatcattattgaaagtgtttgggcagaaaccaggtgatgtttcagtattgtggaccaagtatatcgactaatatagagctgaaataaaatgacttttaaggattcattgtggggctgggtacggtggctcacgcctataatcccagcactttgggaggctgaggcgggcagattacctgaggtcgggagtttgagaccagcctggccaacatggtgaaaccccgtctctactaaaaatacaaaaatttgccgggtgtggtggtgggcatctgtaatcccagctactcaggaggctgaagagttgcttgagcccaggagacaaaggttgcagtgagccgagatcacgccactgcactccagcctgggtagcagaggaagactgtgtctcaaaaaaaaaaaaaagagagattcattgtggctgagtttcaggtgctttggttttgttctacagctggcctcaccatttctaaatacatagaattgtaaccataagaggtccattacctgatgcatgcagcaatgctgagacactgggttgtagcagagaaagagttgtgtgtgtgttggggtggggtgggggggtggtgttggagacaggatcttgctctgttacccagactggagtacagtggcaagatcatagttcactgcagccttgaactcctaggctcaggagattctcctgcctcagcctcctgagtagctgggagtaggcacgataccatgcttggctaatttcttattttttgtaaagacgaggtcttgctgtgttgcccaggctggtctcgaaactcctggtctcccaaattgttgggattacaggtgtgccaccgtgcccagctgagaaagaggtttaatcatagggccacctcatgaggagataggagagaactgcacatccatttccctagggagtttggggctgggatttctaagggttttaagtgggctgaagtgtggagattgttgattggtcaaagagtgcagagtgaagtcatgggacagggagagaagctgtattctcatgctgatcatgttcctccatgggggtcttcaaactggttgctggaattggggtctgatatacatcttaagcaatccttaaataaaagccttatgattctaatgtcagagatgctgtctataggaacagtggggacacaaatcaattttcacacaattttatgaccctgatgttagaaatcctatctctaggaacagtggggatgcaaaaagtcagacttgtagcaacaaggaaaggggccaaagtacagtctgattaatgctttgttgtaactatatttctatccagaaccagcaggccatttttttcaactctgtggaggcggtttcagaattgtgtagatgcccttgtccaggaaggagttgtgaagtagctagttgaatatagccactgaggtttccagtttaacacttacaaagctacaggacacaatcttgtacttaccagcttatagagaactgagatggcccctttttgaagtaagaaagtgtttacagttttgtctgcaggtcatccccagcacctagctcagtaatggacacttcatggcactcagcaagtgtttgaactggatttggtgtgtttaccccctagctcatggtcagtgactactgcttctgaattaaaaatagcaacacatgatcagatttaagtggggccagaaagaggctgttagggcataggatattttagcatgaagtggataggatcatgagtggtaacccatgttcttagggcccatgtgcctatgtggtcactgcaaaacaataaaagtggaggcaagaattcaaattagtatatgggagtgagccacttagtgacccagtgcccatgtttcagtgctgctttgtttttcttctaacaaagggcatttttgccctatgtaaaaattggtattggccaattaggacttcacaaaggtctccatatcttcctcaaatgacaagggtcttatgctaaatgtgactctctactgccctgtttgttaacatatgatgcagtacaccaatgcagatcacactgcagttttaggtagtatatagctgaatgcataatttgtattagaaatacaacaaggacattagactcatgtctgcattgacatggatacagcaaaaatcttgaagttagtgtgagagattacagtagtgagatttggaagatggaataatacttgttgattaagtgcatatttttcatttaagttagaaaagccctcataacaaagccacccatatttcatgtgtcaaatggaatgctaggagctttctgtgcattatctcatttgtggaggattctcatttttcacatggaagcagaggggcatttaagttcacacagctgccacttggggtagcttatccctgtaatcccagcactttgggaggccaaggtgggaaagaatgtgtgaacccaggagtttgagaccagcctgggcaatgtagagagacctcatctctaccaaaaaatttttcaaaaaagaaaagctgggcatggtggcgtgtgcctgtagtcccatctgttcaagaggccaagggtgggaggatctcttgagccccggcggtcgaggctgcagtgatcatgctctactgcactccagtctgggaaggagggagagaccttgtctgaaaaaacaaaaaacagttcacacagctgaatgtatctgaggtgagattgaaacccatggttgtggccgggcacggtggcttactgtaatcccagcactttgggaggccgaggcgctgaattacctgaggccaggagttcgagaccaacctgggcaacatggtgaaaccctgtctctaccaaaaatacaaaaatcagttgggtgcggtggcacgtgcctgtaatcccagctcctcaggtggctgagacaggagaatcccttgaacttgggaggcagaagttgcagtgagccaagatcgcgccactgcactccagcctgggcgacagagcgagactccatctcaaaaacaaaacccatggttgtgatcctaaaaccggaaggttggctttccattgtcttgttttggcaatttctagccatctttctttccccagtgttcagtataattagcagtcttcctgagaatttgggagcatttccttctggttacctacaatagggactgtgatctcaagttccttaagcatctttgaatgggacaaaatagaacctggcctgctaccttgcacatgactagctatggagccttagacaagttgtgtaaatctcgaattctcaggaagaaaatgccatttgagctctagctgaatggagaaacactgcacatgccagaaccgttctccctcatggtccatccaggctgatgcccgcatgggtggagatgcttgctgtcttcctccctgtgcccttttcccagcctcacaagcagcgtgtgaggtcacctttgatggtgccacataagctccatgggctggctctaagggacagcactgtgttcatggcacaaaggcctgctgtgaccagtagtaacagcaaaagtgactgtaccttctgatacttagccaccccttcttgtgacacacatcagcatgcctctgttgtccatagtaggctctagtaggatgcagggctgtcagcagaatttattgaaacctggaaatggcggggtggggggtgggggaagtgcccaggcattctttatgtcttgtataatctctctagattttgtttactctcttcaactatttattaccaaaggatcacaggtcaccaagcatgaggaagtactgtctatacgttttaagtaagagtccaggtaacacttattgttgttgctgcttcagagaattctccttggccagaattgtcagcccaccttttcttgcttagtggtatatatgaggtgtcataatgggcaagaggttcaaagtcttcatttgagtaagagagtgtcttgtgctaagcatctgcagccctcaggggaacctaaaagaaggcactctcacagaggcagtgacccaaaaatgtatatctaaacaaagacagattggcattctccatcatctcttacttggcctctgggcatgtccactgtccctgcacaattgtttaccaagcccttgcaccacaggcactactgggattaggaatttggggatgaaggagagaataccttcaaggagaatttatcccccgcccccccgccccccacaaacacacacctcccacctgctctatcctcctcctgccctacccccacttagatgagaggcagagacccaggtagtcatgattcaagtatgcttttcaaaaaggtgtctgggccccaggtgctcttgcgtttgagggagtagtatccaggaagacaggctctcaacactgcctagacctcacctgccccctccagatgagcaggctcctgggcagaaagggcattacattagggggtgaggtgggaccctgtgggaggaatggcaagcccatttgagacaagccgtgtggtggctgggaacgaggtgtattctggagaaggactgtaagggtagactagatatctccctcacctggctgcttttatgtgcccgctcaggcctctagccttggtggatctatgccttcgggccttgttcctgaatcccaactgtctcattggcctgccaggataacttactgcgccacccccctgatgcttagctgctctctgtacctgaaccatcaatcttgctctttctcattccagtcatttaacattttccagcatgctttctgggaacttctctgaagcttgttaagggattgataaccagtaaaatgttttgaccagttatttttaacatgctgaacacttctttttaggcattgcacgttcagctgtttagtcttgcctttgaaaacattcagtatttctgctggtagtgctctctcctttgctgtactttgccatgattatgtcatctgggccaccagacagcagacctctagatggcaggtccagccatctcttctcttttgctttccgtgtctggtgaatgcacgtaacattcccaatttagcacaggcgtctagatagacttcagccataaaatcctagcacaaactagtattccctcagttaacagtgaagcttaaatataactaaataccactgtatctttaaaaatagatttggttgagaatcacctcaaacttagcatgtctaaaatcaaacacaattcctccccaagaaacacgttactgtttttcagacttccctgatctaagaaatcctcttggtcccatgagacataaacacaggtgacttccttggcgttttccctcatttcccatacccatcccaatccaatccatcactagatgccatccacctttactttctccccattctcttctgctttcacactggtctagtgcagtcctctcttgcctgaaggtggcgcagcatcctcactgtccaccgcagggtctcctaccctccccactgcaggcaggcagggcgctggctctgcaggatgaacactgctgcttagaaatctccacaagtcaggcttctcattactctgtggttttgggaccttagtacggcccactgtgtcctgcgtgatcaggcccaggcacctcattttcatatccccctccaagtaaggccttgcatgtgcgttctttaaggaaaactgtttgttcccttttcccccttcatatccaggttcagttcttcccagaggaatccttccctaattctcccaaccaaggtaattacccttaaagtaaacttaacacgtcttgatcacagtagtattttactttttgcatttggtatgatttctccttatagtctcgtatctacttttgcccttggtatatgtttgattaatatagtaagattaataacacaatgattagtagtcctggggcttaagagttctattcatggcatgattttttttttttttttttggagacagtctcgctctgtcgcccaggctggagtgcagtgatgcaatcccagctcactgaaacttctaccccccaggttctagtgagtctcctgcctcagcctccctggtagctgggattaccaaatattggagtagagcttcttaactctgtagaagagagaacagaattacatttttgcatctgggcacagtggtgcatacctatagtcccagccactcaggaggctgaggcaggaggtcacttgagccacaggagttctgggttttagggcattataccaattgggtgtctgcattaacttcggcatcagtagagtgacccctcagaagcaggtgaccaccaggttgcccagggagggtgaaccggcccaggttgcgaatagagcagatgaaacatctctcctatgctgatcagtagtgggattgcacctgtaaaaagccactgcactccaacctggacaacacagtgaaacccgtctcttgaaaataaaaaattaaaagaattttttaggctgggcacagtggcttatgcctgcaatcccagcactttgggaggctgagccaggcagatcagttgaattcaggagtttgagaccagcctggccaaaatggtgaaaccccatctctactaaaaatacaaaaaggcgtggtggctcgcacctgcagtcctagctattcgggaggctgagacagagttgcctgaaccctggagggggaagttgcagtgaacagagatcgcgccactgtactccaacctgggcgacagagcaagactgtctcaaaaaaaaaaaaaaaaaaaattctttaaggtatttggtcagctccttgatgtgcttctctcactagatattttcattgtaatgaaagtgtttatcctgcccccctagatccttaatgtttcttttcaaaggcttctgtcttttcctactgagtttcttcctagaggtggtaatttctaaatggaacaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtttcactcttgttgcccatgctagagtgcagtggtgtgatctcgggctcactgcagcctccaccttccaggttcaagcgattctcctgcctcagcctcccaagtagctgagattacaagcgcgtgccaccacgcgcagcttaatttttgtatttttagtatagctggtgtttcaccatgttggccaggatggatttgtcagtctcttgacctcgtgatccacctacctcagcctcccaaaatgctgggattacaggcatgagccaccacgcctggcccctggctcttttctagaaacaagtgtcccattcttgatctgggagaacattaagtacaaaaatataccttttaacttttgccagtttaaagccatcaatgtcctggtgaaagaagatgtggaattcttagtatcagctgtttagtaccatttgcaacaactctgaaatgcttagccagccctgagtgaagatgaaaatctgcatttaaatgtaatttgtcttacatgatgagtggagatttttgtcatcagaaattgatttgaaaaaatcaacagattaacatttttctccaaagtggaggtggctgtttgagtgtaaaggtaatgtgctcctctaagagtcacagttaagtataaggaaacaaaaacatctgtaatcccaccacatggaacaacttgctaatatttgtgtatattcctttctgcttcatgtgtaaccatttttacatttaaatctttactcctttgggaatctcttggaagaggagatgtagagatcttaattctcaccaaaatttttctggctcttaccatttagtgaattgttcatctttttgccactgaattttataatgccatatttgtcaaaattgttcatttctggtgtctgtttcattgatcggtttagtcctattccagcaccccactgttaatactgtatttttataacatgcttttcaagactgtaaaggcaagtctcttgtcatttgtgttttaggggaagggacatttcttgtgtatttatttatttttatgaataaaaacgggattgtttatattaaatgctccccagcctccccttcccacctcaaaaacaacaacaacaacaacaaccctggacttgtttaaataggagagaatgcatgaatgcaagtctttacattaaggctcccatagactgtttattcaaattctttttttctctgtaaaattatttttctcatttaggtcctgtactcgtgctaaccactgtaatagtgattgttgtataaatgggaaaaatctttcaggaaagtgaattagcaaaaatcatgaaaacttcttcatgttttgtttgtttttttttttaaagacaattttgctcttgttgcccaggctggagtgcggtggtgtgatctcagctcactgaaacctccgcctcctgagttcaagcgattctcctgcttcagcctttttggtagctgggattagttgcccaccaccacgaccagctaattttttgtatttttggtagagacagagttttcccatgttggccaggctggtctcgaactcctggcctcaggtgattcaccttccttggcctcccaaagtgctgggattataggcgtgagccaccgcgcctggccaaaactttgctctggactcagaaatcccatccctaaacagaatctgtgagttacagttgacaaaatcctttccttgcatgagaatttgacttttgtttaactttctagctctgtttccctgggagctagataaggcagaacataacatttgtttctgggcatggtccttgtggtaaaatgtcccctggttggtaaattacatttggatgggaaagagccatggataagtgatgggccacccaggcttttgtttcatggaacacagtgactctgctgggcatgtccttatggggagcctaaggagctgtcagaagagatacttgcacccccaggattgagcattctgagtcaaggtattgagtcggcacagtctccctgtgcctgagccatcttctgtatggactcttgcaagaactgctgctgctgatgacctgccactgccctgcctgccagctttgtctgtcccagtctttctcagtgggcttgtgccacatgtggcctgtgataatcttacgagtcagaatctagaaagatctacccacccatcaaccctcacacaggtgttgctgtatctcaaggaagtaatcccatagattacagcattttttccaaatttttgttatattaaataaagagcgggaatggctatttaaatgcttaattcactcagaggaatattagacattaagacgtaaggtggtctcacggtcactgctttgtgacacgtgtgggtagagactcaaagggaaggaaacaaacatgaattctatcatgtaggagtctggaggttgaagtgtatttcctgttttttttctttttaatattattaaacagcattggtacaccagtgaaacctattaacaaagcaagttatgcaaatcccttttcccattcttaaaatcagtcactttcataaatattctccaaatatctttgcatatccttttatcatctttttatctattttctttttttttcctttttgaaaaagagtcttgctctgtcgcccaggctggagtgcagtggtgtgatctcagctcactgcaacctctgcctcctggatttaatcgattctcctgcctccgcctcccgagtagctgggactacaggtgcgcaccaccacacccagctatttttttgtgtatttagtagagatggagtttcactatgttggccagggtggtcttgaactgctgacctcaagtgatccacctgcctcggcctcccaaagtgctggcattacaggtgtgagccaccacacccagcctttttttcccttccccaccactcactgcaacctctgcctcctgggttcaagcgattctcctgcctcagtctcccgaatagctggaattacaggcacccaccgagctaatttttatttatttatttatttatttatttatttatttatttatttattcatttgagacagtgcctcgcactgtcacccaggctggagtgcagtggcgtgatctcggctcactgcaacctccgcctcccgggttcaaacgattctcctgcctcagcctcctgagtagctgggattacaggcgcgtgccaccatgcccagctaattttgttttgttttttgtttttttgagacggagtctcgctctgtcgcctaggctggagtgcagtggcgcaatctcggctcactgcaacctccacctcccgggttcaagccattctccagcctcagcctcctgagtagctgggactacaggcacatgccaccacgcccagctaatttttcatatttagtagagacggggtttcaccgtgttagccaggctggtctcgatctcctgatctcatgatccgcccgccttggcctcccaaagtgctaggattacaggtatgagccactgtgcccagcaatttttgtatttttagtagagacagggtttcatcatgttagccaggctggtcttgaactcctgaccttgtgatccacccacctcgggcctcccaaagtgccgttattacaagcatgagccaccgtgcccagccttttctatttttagtagagacggggtttcaccatgttggccaggctggtctcgaactcctgacctcatgatttgcctaccttggcctccccttctttctatttgaaacttgcccccattatcatcatctgatctctatcttgaaatatgataccagaccttagagtgtgacatttaaactttgaccagtcaaagcggtccctggggagaaaggtaggggaatagtggggctccacatataatggatagtttggggtatacctctcagtgctgattatgatggaagacagaactccaagtcatcttatactgcccctaactagcactagtaagaactttctagatgaatgctggtgggctgagataccgtgtcttcacagtccagccatgggcatgaggcttttggcagagaaacagcttgaccctctgcataggtcatgggacctggggtgtgtgcctagcaaaccatcctctagtctggctcctattcccatactgttcttgtagccagaaacagactctgaagccatcgaggatggttactttcaagagcgtaggccttcttagcaaatcctgccctttaggacagtagtcaggtctgatatttccttttagttagtggtcttgggtgtaataccacctcttgagaaagagaacaattgacagccaagcatctggaaagagagggatagctggattaccttgcctaggagctgtaacctgctgcttctctcactgtcttctggactctgtgttctgttactcatctctgtatttggcataccttaagatggtagcggccagtatttactagtcatctgctgtattctagttactgtcctgagcattttatttattcagtcttcacagcattcttaggacataagagctgtcatctctatattccctattccaacagagaaattaaatgactggctcaaggtcatatagctaaattaataagcggcaaaaccagaatagaaatccctgtggcctgggttcatatctgctgcttaagtcactcccactataggcactgctgtcagccttgccttcaaaaggtaggtggttaaagaggaaactaacaagtagttcttctgagtcccattcattttctggaagtcactgagtcataccctggcaaatgagaggcaattacagcaggagccctgtcttgatgagtagatagaccatgctgtggcaagtcctggaagacagttgagcagagatcaggcatttttcacatcttctggttatgagtagacaaggctgcctgaaagattttctggaaaagagtagtcactagagctgcagagtcaagtattcagacggtacccaacatttaataaatttctacttggcattgagtatacagtggggagtaaaactgtcttcatggagattgttagaaaagggatagactagattaatatagtacataaaaatgtcaattagtggtaagtgctctgaaggaaaagcaagcagagtaacgggatagagagcaaatgaggggttatgctgctttaaataaagcggtcacttctttgagaaagtgatactgaagcagcgacctgaatgaagcaaggaccaagctgttgagtaagttggagcattagttcaaattgccaatccattcaattgatccaccacccaagtgagagaatacattctctccaacagcttgcaggggcaggatggccctgctgtgctgttctgcctcgctcttgggtccagagttttggtgagtgatactgttttttatcagtgccccctggtggaaggaagatacctagcaggaaggttcagggccctgcactgttggggctgctcagacatttgtgcaagggaggtgttttgttttggtgtttccatcacactcacagtgatttctccttttccccctttagtttgaaggatgacctctaggaagaaagtgttgctgaaggttatcatcctgggagattctgggtaagttactcatgaatttgagctaacagattggcttagagctaagcctctctgctgtggagcccacactgtccgtgctgccacttcttgctttcatagtgaggcttagggccttacatgtttccctccacggcagaaatttagatgatcccttgttatataaccttttgttctctagtttttagcatgattttttatggggaacggatggctatttgaactcaactaaggataggcattttcatggaatcccttttctccaagctggccaggctggggagtcttccttacgtagatgtattgccattggcatctggcgtagcagatgtgcttttttttttttttttttggagacagagtctcgctctgtcgcccaggctggagtgcagtggcgcgatctcggctcactgcaagctccgcctcccggattcacgccattctcctgcctcagcctcccgaggagctgggactacaggcgcccgccaccacgcccggctagttttttgtatttttggtagagatggggtttcaccgtgttagccaggatggtcttgatctcctgacctcgtgatccgcctgcctcggcctcccaaagtgctgggattacaggcgtgagccaccgcgcccgacccagatgtgcgttcttagtgcaccatacagtatcctcctgctgctgtgcctgcttcagatctatctgcaaaagagcctgggacggcagaactgggttctgattctagatgtgccactaaccatgtagctaactctaatggctcttaagattctgtggtaggttgggtgaggtggcttatgcccataatcccagtgctttggaggctgaggggaggattgcttgagcccaggagttggagacctgtctctacaaaaaaaatttagccaggtgccgtacctgtagttccagctgctggggaggccgaggcgagaggatggcttgagcccaggagtttgaggctgtagcaagctatgatcatgccgttgcactgcagcccgagtgacagagcaagaccccaactcttaaaataaaaagattctgtggtaggcttttcagacttggcatctgaagggacccatgaaagctttgactcattggaagcttatgtatttttaaaaataacaacaatagcaaatgcaggtatgcttctttattccaaagtcccctgcccttcctttgaaaagccagaggtttttctgtcttgactggcttatttgaatcacctgcagaacctttttttgtatgtgtgtgagagacagggtctcgctctgttgcccagactaaagtgaatggtgcaatcacagctcactgcagcctcaacctcctggtcttaagccatcctcccacctcagcctccagagtagctgggaccaccagtgtgtgctaccactcctggttaaatttttgtattttttatagagacagggttctaccatgttgcccaggctggtctcaaactcctgggctcaagcagtccactcgtctcgacctcccaaagtgctgagattacaggcttgagccaccatgcccagcctttgaagaaccttttgttcgctagcatttgcccagccccagaccagtgggctagggcctagatttgtgctctctctcctaccccgcaactccatccccgtcgggatggaaagatagtgcttttaggcctgccttccccaaacttgtgcaaaaagtctcaccaagcccttgttcgattccaggttttgccacctctcaccttgtagattctggcttagatggtctgggttggaaaacactgccttcggctgtctaggtacctccaggttctttaacacaaatatgaacatgttcctttgtggccaagaaaggtgatatcactggctatgggggggacggtttttgtattagctttaggttaccttaaccttatcacacaaaaatcacacattgtctcttgctgagttttcttactggaaaacatatttggaggagcattctttgaggtggatttgttttggtgatatattggtgctttttctgcttcagattttaaactttaaagcagcaaattgtctgagtggtgtgtgtctgctgaaagccaaggtcttcctcctggtgttacttcatcaagctaaatagcagccactaaatggagaaacatctaagatagcagggatactgttggaatagcagaacagtcttaatagtgaagcttcttttagaaagcagtatatttgctggcatccttctagaatggaaaaaataatactaggctctaccatttgacctggctgtgccaaaacatgtaagcagcttttccacatctgccccacatctgtaccctatatttttacccagagagaaaacacaaaacttcaaaagtgtaatgctcggaaggctactggcattgccctttgctgtgagggcagtttcttgtccttcaggtcaggcagattcttttaaatgcttcaagtaattcgtgtcagtttcaggaccctcctatttgacttatacttatggtttttctccaatttcagagtcgggaagacatcactcatgaaccagtatgtgaataagaaattcagcaatcagtacaaagccacaataggagctgactttctgaccaaggaggtgatggtggatgacaggctagtcacaatgcaggtaagcacatgtcttggctgtgctgaccaggccttgatagttcatttagtcttaatctttcctcatgcatagacattttccttccctgttcttcaaatcttattatcttatttgtagataattggctgatactcagttaaatttgaatttcagatcaatagtgaatacttttttagtatacttctagtgtatctcagatacgacttgctaagacacactaaaaaattcttcttaaaaaaaaactcagatttatcctttcttgttttttgttgtttttggttttgttgtttgctaaatttggcaacctgcaggtctctgtcttgtgcctctcttgacatccttgcccagtgctttaggtaaacatctttgtctcacctcagtagtgagacataaactttatttttctgacttcctatttcatacgtaacttcaagagttgtgtgtctattgagccaatcttttttttatgtatcagcttattaatctttcaagggttccctttcaacagttaggataagatacagattctttcatatgacttgttgaaaagccttcacattctggctataaactattattccctttttttcccccattgagtcattttgtttgtatacatgtattaacatccctagaaaagaaacccctgaaggatggataccttgagcccaggagtttgagcctgcagtgagctgtgactgctccattatactccagcctgggtgatggagtgagaccctgtctctaaattaaaaaaaaaaaaaaaaaaaaaaaagaatcccaggattttccctcctgtattttcatctctttcttcatggtccatgatgccagctgaggttgtcagtacaacctcactttgaaaccaaactattgggataggagtagattatcctgtcatttttctagatctttgagttgcacatcacatctggggccaatcattccaggggcagttttaacctgcctgtgaggtttacagtaattttcccagctctgtgatgaccagtgatttcaaattttcaatgtgatcatgtttcatcttcacacttagaaccagaccatgacttgggagcacagcctaataagaacctggtgtttgcccttgagagcatcagccaagacgttcatgcattacggaggcaagaaaagatggtggaaatagctgttactcactttttttttttttgtctcgttccagtcattccgaatcatgtgctgctcttacagacttgtgttggtggatatgtctctgcttccagcagggcctgtatacccacctgaagtctccaacttttagctcagatctttggaaacttctatctccatggcagttgttctttcctatgtgcttctagaggcaaatacaattctaatcccattatagtcctagaaagtacctggcaaatagtgggggcttgctgaaatgtgtgaatgatgtaggttaaaggtagaaatttgtgcacgtgttgacctcgagccatggcatgctcctagaggatcaggactcttaattgactcacacttctaggacagagctggtatgaatctctcatcctcacctcacctacacacatacacctagagatcttcaaaatgtaactacagtttaagcaagtcaagcttgagagtagaactggaaaaccttggcccaagaaattggcaaagcttgtgtctgcagttgttggagattctcagtcccactctccacatgtacagaaatctttgtctcaaaggatttaacataaatccctgtcattcctggcaaaaacaagggtaagaccactctgtagggacatttagtaccgcaggagagaagatgagttcataaccacatgaggaaataatgtaccacaagagatgttcacaatgactagagatgttctaaaaagaaatagaaaccataatggaaagggatactataaaaaaatgaggatatggaaaacttagaacttcaagaagtgaaaacatagtattgaaataagctaaaggaacagttaaactgtagattaaatggagctgaaaaaagcagtaagccgtaagagctgagcaaattttctaaaagaagacttaaaattgtagaagaccgaaaagcaaaatcttaagagcaactatagaaaaaaaagacatgacttataaaggaacaacagactgacaaattctcaacagaaggcagaagggagtagaattacttcagggagctggggtaaaggcccatctgaagattctccatgtgtcacagcaagactcagactgccttttgctgagggaaaatagaacttctccagctgagctgtggttttggtagccatgtgggccagcgaattcagaaatcagagttcggcccctgctgggtcgggggttgtcataacagtcccgtctgtactactaagctgggaccttggggcgctgcactcttgaagtaaaccccatcaggagatccacagcgcactgtgggcttctcaagaagcccaaattccaggaaggataaataaaaagaattctgtgtaagtcataatgaaactaaaaaagaaaaaggcttaaaaatagactgaggaaaacctgacaagcacagcactgaggctgtcaggtgactcttggcagtagcagcagagcccagcaggcagtggggtatgttgggaaagagacgggcagcacagtgttctgtctctgctgaaataaccctcctgaatgaaagagtacatctttaagggctagtggcagaagttctaaaggataactccaggcagaaagtgatttcatgtagatgaggaaagagtggaaaaagataacaagttcccaagagattgaagcaaaaggatgacccttgtgctcttgcagccagcttcagatactagaagtaaatgaaaatcattgtctctgcacaaaggcgtcattatcctgatcttgaggaatcctcatgtgtttttcgagggcttttagcagcttgcagtaaaacataatcaaaataaaacaaggcaccacaagaaagaaccagtggaaacttccctggtaattccagagtgttttttgtatttaaagaaataaggaggatacagagtttcagttatatgagatgaataaatcctagagatgtgtacagcatagtgcctgtagttaacaatactgtattgtacacttaaaaatttgcatgctggatgcggtggctcatgcctgtaatcctagtgctttgggaggccaagagaggagtttgagactagcctgggcaaaatagcacatttcatctctacaaaaaaattttttgaaagaatttactaagaggatcttattttaagtgttcttatcacaaaaagtaataataagaggatggggggaaccttttgatgattaggtttgtggcctacattgtagtgatggtttgtgtgcagcctttgtatgtcagccatacctcactaaaggggctttgtttaaagataagataatcgtttatctgctgggaataaacgacacagttaacattgatagggggagaaattgaatcacaatcaatgacatttggaaattcatagaatgctgctaaatcatagcagattggccacaccacataagggctgtaataatgaaagaaaaatggcgggaaatatgaaagcaatatgtgaaagtgagaaggttggacctacttttaatcagtctcagaaggtgccttgagagaatattggatcaaagatgatatttgctgagatttttgagaattagtgtggcaccaatccactgacttaagaaaccccaattgccaggatggataagttaaaagaattctgggtgcgtccttcggaaattacaaacaatggcttaaaatggtctgggggagaacctacaagcccaggccttaggctgccaggtgattcttggaaaaacccacagaaccccacacagcacggggggttggtggaaaagaaatggccacccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtttcatgtttttctgacccctggggcaagtttttccttggttgttttgggggttattcaatgaaattaccggttatcttttgaggttagcaaacttttttcttttttagacagagtttcgctcttatcacccaggctggagggcaatggcacgatcttggctcaccgcaacctgcgcctcccaggttcaagcaattctcctgcctcagcctcccaagtagctaggattacaggcatgcaccaccatgcctggctaattttgtatttatagtagagacagggtttctccatgttggtcaggctggtctcaaactcctgacctccggtgatccactgtgcctggctaggcaaacttttcatacagtaaaatgcatagattgaactatatcactcgtgagtcatcacctcacttccctattgaactgtatcattcgtgagtcatcacctcacttccctatatttccattgctctcagaaagttcccagagtacctaagttttatttatagttcaaattttacacacttacctacatgtgaccactacttggatcaagatataagaaatttctagcaccctggagattggactcaatgtcactcgcttatagacagacacatacttaatcacaatatttgtgaggattgtttcagatactctggtgctgaaatttgcttcctgaagtctggtgtcatttgtctttgtgggtggccccacaatctagcctatttcttctggcaccccttgcatacatgctcctggtgctctgcctagcattctcccaaggaatgaatgttttgtctctcacagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtaagtaccaacgatgatagatattgtcacagacacctgctccccaggggccttgtgaatttggagggttctctgctaagctcacatggctctaggaggtgctggtgggagtcttcattaccatatgccagcccttcaggccaactgcctttaaggaccgggacccaggtgacctgggttaagtccccatcctgcccccagctggctgtgactttgggccattgtcttggctgtctcagcttcacttccctttctgcactttgaaggagggaattcggttttgtcattctcagtagtgccctcccagtacctccaggccatgcctggatctccatgtgtgcagaatattgctttgggctttgagtaaaattgctgtactgtagtttcaaataccatttctgttggaaacatagactctttgattaattacaactaggtttatttctgaccacagatcttttcttaagtgacttagtccttatctcttggctgaaaatgggctaggggttggggaaggaatgagaatgtgtgagtggcataggtgacatcacactagcagtaatggtgaagggactataaaccttaagaccaagctgctgggcatttcctgtcctgggatctctgaggtcccagtaaacactcttcatttcttcccggactggcttcttactccattcacaaatggcttttaagtataactgagggtcagaaggtatgagctgtagaccgagacaggctttgagctctctagctgaatcctagctatcctgagcatagctagcaggacaagtttggacgggtctgcaggtctcctccaacaccctctttccccatgtctgtgtcctcacctgtactacctgtagacgaggggccatgacacttcctggggaggatggagtcagtgctggctgcttctgtcatgagcctatgtgcaccctgcttcttctttcaggtggccacaaagcgggcacaggcctggtgctacagcaaaaacaacattccctactttgagaccagtgccaaggaggccatcaacgtggagcaggcgttccagacgattgcacggaatgcacttaagcaggtgggtctcccacagctgaccagcccactctggtgatgcctgaccactgacccagtccctgcctggcctcctgcccttaatcttcttccctaacccactcttttctgtatagccagaataccctatgtgttcatctgggaaggttatgacatgttctgcttaagcttccagaaatcccactttggggggaataatataaaagatgcagaggctgtgaagtctgaggctgcccttcttttactaggcttgttcttattttctttgctgtgattaggagatcaggtcactgggagaccccgaacagattgctgcttctatttaaggaggaaataaacttgaatatgaatcccagctctgctgcgtaccaatcgttatatctagtttgggcttaaaaaaaaattatggccgggcactgtggctcatgcctgtaatcctagcactttgggaggccaaggcgggctgatcacttgaggtcaggagttcgagaccagcctggccaacatggtgaaaccccctctccactaaaaaatacaaaaaaattagccagacctggtggtggtcgccagtaatcccagctactcgggaggctgaggcaggagaattgcttgaacccaggcggcagaggttgcagtgagccaagatcgtgccactgtactccatcctgggtgacagagtgggactctgtctaaaaaaaattaaaaattaaaataaaaaaaattatatctgaacttctaccccctcacctgaaaaatgggaatacctgcttttgcagggtgattatgaagattaaatgagacagactcttccagctctcacatactgactggtaacttttttccttaggaacagttaagtaaacaacacaaagaaggaagaagatgtaggaaaactattcaaggaatataatacctagaatttcttatttactgtttctgtgattagatacaaccactcatgcgagttgaaagtctgttttgatgtacagctctgttaggggcagtggtgattaaggcaggtcacgaggcctcatcagacagtgtctgggggtggtcagaggtgtggcaggtttgggaggatgcatagaacacttgaagcacatggtggctgtgaagggcaaggcagattctgctgactccaggaagccggctgaatgaaggtaatggctttcagcaggacaaagagttgtttgtaatggttgctccaaggaccagggaaattctggcatgggtggggtctgcactaagtgttccagaatgaaagggacagatctactcaatgaggaaattgttccacccagaatgccaggagagccctcaagtggtaaggagcagaccaagatgcagacttggccacgcttacccccaaataataatgtttgtgtttttcttaatgttcatataagggaatggaaatccaaatatgtgtaggaaagtgtttcccacctgttccctgttgcctggcatcactgtctgagtttttctcttccatcactactgtccctgttgtctttatgcttttatttttagagctagcccttaagaagttagattgttaaatcggagggtgtatcttattgtaagtcagggtgccaggttgctttccccaaggggaataacatttcagcaatgtgggcttgctttcttctacctccttgccagcaagcaataggtgtcacctgtcactgctgacattgccgatctttgggtgtgtaaattgccaccatcgtgactactggtccctctgagttcccctccctggggcttagccatttggattttctctgctgcacacagccggcacacagcacatggttgggcctctctcagttctcatgagctgttggtgaattgaagttaactctacttgcatcttaagtgacttttccaactctgtggtctttttaagtcctttgaacatagggaaaaagtaattttttatttggttatgtcattttaagtttctatgtttcctgtgtctacctcagatttttctgtaattcagctggaatttgttttggcttatggcagaaaagagagacttgcctttcctctcaagagagctcagccagttgtttgaaatcattcagctatgttacacaagccgtttccctccctgaatagaccgtggcctgtgctaaatgctcgtatgtgctgggatctgtttctggtctctccagtctgttctggtgatgtccatgccatgttcccttatctggactgtgttgatttgactgcctgatgaggcaagtttcctcttgccacagtccggttggtgtttgtaatgttttttttttttgagacggagtcttgctctgttccccaggctggaatgcaatggcgtgatctcgggctcactgcaacctccgcctcccaggttcaagcggttctcctgcctcagcctcctgagtagctgggattacaggcatccgccaccatgcccagctaattttggtaattttttagtaaagatagggtttcaccatgttggccaggctggtctggaactcacattgtgaaccgcccgcctcagcctcccaaagtgctggggttacaggcatgagccaccgcacccggcctgccacatttcttttttaataattttgtttccaccattttcctctcttaccttccacaccccaaataaaactctgttgagattttgattggaatttttttcttcaagcccactgttttttcctcattgattgcagttttgttgtggctgttgcattagtctgctcaggctgcgttaacaaaaccccacagcctgggagggtccagcaacagacattgtgttttctcacagttttgaaggctgaaagtccatgagcaaggtgctggcacatgtttctggtgagggtgcttttctgggctatcttctcactgtgtccctcccatgccctttctgctgtgtgcacagagagaggacacatgagcaaggtgtctctggtgtcacctcttcttataaggacacgaattctcagatcaggtccccatcctgcaacctcatttaaccttcattccttccttactccaaatacagccacctgaagggttagtgcttcaacacaggaattttggaggaacacaaacattctgcccagccgagtgcggtggctcatgcctgtaatcccagcacttcgggaggctgaggcgggtggatcaccttaggtcaggagttcaagaccagcctggccaacattgtgaaaccccatctctactaaaaatacaaaaaattagctggcgtggtggtgggcacctgtaatcccagctacttaggatgctgaggcaggagaattgcttgaacctgggaggtggaggttgcagtgagccgagattgcaccattgcactccagcctgggcaacaagagcgaaactccatctcaaaaaaaaaaacaaaacattccacccatgatactattttaggtcttgtttctgttccttcagtaagattgattgattctttttttttttagagacagggtcttgctctgtcagtcaggctgatacgcagtggtgcaatcatcactcgctataacctccaacttctgggctccagcagtcttcccaccatagcctcctaagtaggtaggactacaggcacacccatgctataattgatttataatatgatcctttgcctttcacagtaaacatattcctaggtactggtgggaatataaaatgtcactatttgtaatagccaaaaagtaagaacaactcaaatgtccatcaactggtaagtgaataaacagggcagcttatccatgcattctaatattattcagctataagaaggaatgaagtagtgacacatgctgccacatgggtgctaagtgaaggaagccagttgcaaaaagaccatatgttgtacgattccatttcagtgaaatgtccagcccggatgcagtggctcatgcctaaaatcacagcactttgggaggctgaggccggaggatcacttgaaaccaggagtttgagaccatcttgggcaacatagcaaggcctcatctctactaaaaattaaaaattagctaggtgtggtggcatgagcttatagttccagctacttgggaggctgagactggaggattgtgtgagcccaggagttagaggctgcagtgagctgtgatcatgccattgcactccagcctgggcgacagagcaagactctgcctcaaaaaaaaaaaaagaaagaaatcacagtccactagaagaaatggggaaaattaaaataaataaataatgtttaaaaattaagtgtccagaataataggcaactctattgagacagaaagtagatgagtggttgctgggtccaggatggtatagaatgggggtgggaaggaactactaatgggcatagggttttttggggggtgatgagagtattttaaacttaatgttgatggctgcccaactttctgaatatactaaaaaccattgaattgtacactttatggcatgtgagttaaaacccagcaaagctattaggagtgcaatggcaccatcttggctcactgcaaccttgacctcccgggttcaagcaattctcctgcctcagcctcctgagtagctgggattataggtgcttgtcaccatgcctggctaatttctgtatttttagtagagacggggtttcaccatgttcgccaggctggtcttgaactcctgacttcaggtggtcgacctgcttcagcctcccaaagtgctgggattacaggcgtgagccaccatgctcagccaaagctgttatttttttaagtatgtattcctagatgttttatacttttatagttattgtgaatggaatgatttttttcctagataacttttaatgaatagaaaacagttcctgctttatctccaaattctagaacagtcactggcacacaagtgctcagtggtttaagtgacattgttttcctgcacccaaaagtagaatgctgctcctcattggaagcatgttactttagcaaagtgccactaaaatgaccatagtccatgtgctctgatcacttgtcacagatggggataaaattcattcacagcttcctttctaggcctgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacactggctgagggttgccagatgtttgagaaaagctagtaaatccagaccattgttaaccattggcaactatagggaacatacagaaagcatctgaactggatgtggtagagctcccagatcatgatctgattgagaatgtccatgaacttctgtcctgattgctcagtgcagactgctgcttcttctggcaagactcctctcttcacattgacctggagttgtcacaaaatctgtttttctcttgctactcccctgagcatggcaccttctgccagagcgctcccttaactgtgtgggcaggctctgcttcacagctccccgcccactctgcccaagcagaagtgagcccctcctgggcagaaagtgcccgcaatgagggctgaaatgtttctattccctgagtaaccaacctttctctgtttccttgtccaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgatcatctgcctttgccagagtctttttttccttcttcaagagccttggctcagtagagaccacatgagctaatcatagtcaatgccttatcaagcaagagagccctccataaatgggcacgtgtggtgcttcaaggcagaaaggccctctcatatctggtcctgtagtgcctgtccctagtttttttttgtttgtttttttttccgggggcgggggtgggtgtattttaatcacattgttggaggttgaggaccatggatggagaacgcattgtccctttaggagagcagccagaaactgctggggactctgagccatgcatatcctgtaggtgtaactgtaacctagtcatgtgttatgtgttttatttttagttgacctagttgctaacacttagatgtgtaattctgcatttgtcacaggagaggaagatttggcagcagaggccctgtattccaacatatgtaagcccccacctggaatggaatagttgccacttagaagcaattttattaaaatagtagtagttcaggtcgtgagtcactttaggttttgcagaagtgcctcattgagttagatcttgaattctactttgctacacttttctacatttccacttctcaggctcctcagctggtttctttcctcgtggctcctcttggcatgtactttatgtgttaaaaatagcatagtttagaagttcagatgctgcacaatgtgagattatccacagtgcaattccaccctggctgggtggcttaaatcttctctggtcctatattttgcttgggcctcatcaggtgtttgtcctctagaggagcagagttctctccagcttggggcccagtgactgggccacagggtgtggacccttgtgtgatgctcacctctgcaaatcaggcatctattcctctgattgtgttccactggtcttgaccttgtatgtgacattaaaatggaccttgacttctgacctgcttgaccttcatcctaaaactgatgatcatcctgatattaacctgctttagcttgagatgaatgtaatctttaattgactgatttcaaccattgtccttatcataacttaccctaattttaatggctttggctttgaactggctttgactttaccctaaacacgttcactgctgaatgaccttgactctgacccacctcctgaccctaatcatcacctgactttgaagttaacatggaaccctaccatgacaataggtcttactctctgacctgggactaattagtctcatgtcccatcagcctgatggctgagcttggtgtcatattttaaccctaaattgtataatgttcatctaagggattcagcttaaccacaatagggagccatggctgagactgagctctgcatcaacacagtgcctttttcttttttttatttttttattttattttatttatttatttatttatttttgatcattcttgggtgtttctcagagggggatttggcagggtcataggacaatagtggagggaaggtcagcagataaacaagtgaacaaaggtctctggttttcctaggcagaggaccctgcggccttccgcagcatttgtgtccctgggtacttgagattagggagtggtgatgactcttaatgctcattaagagtcatcacagtgcctttttctatattcctatttagattcagcataagcatgtgttttctctcaaaagaggggaacttgtcattttgctggaataagcagtaaggatttacttttgtgaagaatatctgggactgagtttgtctgcagtactatggattgtttgggttcattcatatttgccttgaggtgagaatgagagatgagtgtgttgctgggtttgcatccatctcagtttgcgctaacaaatattcagaagttatttttggcgaggcacactggctcacacctgtaatcccagcactttgggaggtcaaggtgggtggatcacctgaggccaggagtttgagaccagcctgggcaacatggcaaaaccccatctctaataaaaatacaaaatgtaggcgggcgtggttgtgggcacctgtagcctcagctacttgggaggctgaggcaggagaatcgcttgaacctggaagacagaggttgcaatgagccaagattgcgccactgcactccagcctgggcaacagagtgagactccatctcacacacacacacacacacacacacacacacacacacaaaaagttttggaaaggacgtctgggaatgagtttgttgtactagtatgtacttgtttcagtagtactccttcctctgatcccagcttattctgcctgcatgtgagtgtgttgctgtgccgactgtcatctccctcaataagctatgaggagttggttttaataagaatgcctgagtttgttgtactaacaggaattctcatccaaactcctactcaggttcattctgatt

SEQ ID NO: 14891 - DNA, 81701 bp, Human
  misc_feature (1)...(81701): n = A,T,C or G
tgtgtcagccttgaccacttgattatatactgtgcttggacgtcacttcatctctcaaagccttagctgtgggaaaagcctgggtgattgctctgtgtattagaaactgaaaccccaccactaaatgctgaaaagtggtccaggcaaaaggtgctgtggaaatctgaaagccattatcttttccacacttcctctctcttcaccctcattttgtttgggaatgcacatgaacacccgtgaacaaaaataaaccaacccacccttgactgattgttctgtcttttgagttatcaaacttgagtgcttctggctcccagatatgctgaagtagagactgctgggaaggcagccacaaattagagttgatcttccagtatcttctacctgtaaggaatggttcaggaaattataattaatgagtcctgccccaaagttgaaatcatatttggatttcagaaataataagaaagcatataagaatcctggtgtcttttcttagctcaaccatgtccatccatactttctggcccttttaaaccagttactctatacccagtccatatacattttgactgtctgccctcaggaactgtctcaactcagggcatctttaaggaaggcagaaccaccttaggaggtagagggtgaaacgtggcaactcttccataggcgaatcaatatagcagacatgctcaaggtaggaggttttgctagggcttaaatcaggctgtcaactcaaacacaatgggctttgttactcctgtgtaaagaggaaatggagcagtttttggcctcctcagactgtattgtagggtatacaggatggcaattccaggcacaatcttcaggagacacaaatctgcttttagctattcagtgttccccagcaagttaattagctgtttctgaaatgcatggaaatattcagcattttcatagtgaagccaatctcccagatttaagctttgggggtgggaatgagtatgtgaggaagagggtctgtcagggaaacagaatagagcccttttggtgagagattccaacacctgtgacttatcttagaaattacacatgcactgtaattccaagactttttttttttttaattggtttgagcactcgagcaggagggcttgctgagacctctcactattttaggcgtggggagttacctctgggttcaaaagtctttgggtgggaagcacagaggaactgcgaaatgcctccctcagaaatgtccaattgctcaaggggagaagcagggagtggggtcaggtagcagccaggaaggttgcaggggccacgggcacatcctctccctgagtggtaaggtggcaagtgggtttggggaccattgctttgacaacttgtcaagggtgcggagagggctgtcccagcaaggtgaagaggtctgtaggaaaggagtctccccagagacctcctaaggaccagaagagcgcgcaccccgccaagtgacagaacgtgccccctctgtgtccgctcccttcccccgcggccaatcaccgggcagaggcgtctcacgccagcaggtcctccctggctcctctccttactcgtccgggcggaccaagcctcagcaggagccccgcctgtctccaggcagtttgagcccccgagcgctcgcccagcctgtcagtaaccgccgtttgcgttttcttccttcctttctttcttttttttcctcctcttttcttttccccttctgcctttgtcccgcttagtaactgggctctgaccaatcgccgccttaccggccggcgccggctgtctcctgattggcccgcttggggcgcgcagccgtctcccgctccttcgcaggagcaaggcagacaaaagacgcaggctccaggctccggcaaccggcctcagccaatcaccacccaccttgcctctcttccctcgccccactccctcctcgcctggctcgcgtgctcccggcactgactcctggagtgcggccagcgcccggatcgtaccattctgattgaggctgggggagagcgcggatggctgattggggagccgaagcctagagagcggtggggagacgtgaaagtcgagatggagagcagctttttgaacatgttctcaggcacttgacagaatcccggtacatcgaggcgggacggcgtggaaggggcggtggtgatgcctgctgtcccccctcccggcgcggttgggtggcgcctcagcgggtgggcagcatggggcggggagggtgtcccctccgcgccgttaaaatgaaactctagtggctggagtccgggcagagcttgagggcagttggtgcgggcgggttggttcttacaccccggcgggagcgcccagacaagccgagctgactggacttctccggccggccccattcccgaggctgcggcagcttcggttccgagaccgaccggagaggagcccgagtcccggcctctgggggattcgctctctgcagaccagtgggaccccgaaacttgaacgcaatctccagcccccttttttgccttcctttgtcacttgcccgggtttctcccaacgtgttcttttttttcctcttcattctccctccttcgaaggacacaaaagtggcttccgcggaaagatttggaggcggtgggagcttttctccccggagagcgactgtgtagaaaggatttttgggaagccgctttttaacacctctgctctccgtcccccaagcctctgtgtaatcctctgaggagaaaagcccatagcttgaaagttcgggggcattttgttgtgttctgtaggagagagggggaggaccctgttcgggtagtttggccggactggtactggccgttggaaaacccgaagtacatttccgtgtggaacttttgcagatatatatttttagatttttaaataccagataaaaaatatatgccttctatatatctcctggcgacctgcccctgacagcgcgatgtacaatacggtgtggagtatggaccgcgatgacgcagactggagggaggtgatgatgccctattcgacagaactgatattttatattgaaatggatcctccaggtacttgggagaaaaaaaaaaagaatctcgtgatgggtctgatttgtatttaccaagagcttgctgatgttttcagggcagaagtattcctgggtgcgctaggttcgggatgaggagatttgcagttacagctgcggtaaaactgcttctggtttacacgtttaaagtttgcagttaggaccctgatcctattgtcctgcgaaggtgggggtgggggctggaagtgggggtgggaggagagaccccctttttaaaattatcattattttttactttgcctttgcgtgtcgttcaggtttttcttgtgcccgccactttattttatttttttctttttcaattaaagactcttctacctgcaaaggatgttttatatcccggggttaaaaccagtctttcactttgggcgaattcttgaaagcttgtcctttcatacatttgtctaatttggttcgttgtgttttaccccggttaacttctgaaactgagttatgtgattattcattgtaagactccctttttctcttgcagaaacaaatgccggttagtgattttttttagggattgggcgttcgtattcagccatggtcttagtctgaggttttccttctcagaagatagtcgctcagagaaatctacgtgcaatattttattactctttaatttaatgatgatttaacttaatttatgggatagggtttaatgtaacttcaattcctagaataaagaaaaagcaaaaacaaaaacgagggaacctttctgtttcctgtgaacgtgtgatatatacatatgtgttcctatacacgtaatgtaaagtatacatatatagcactatatttttattttaaagctctgtctgacgctattacagacattttgtgtatctggtaggaaaggaaaaggaaagcaaaatggaaaagttggcttttttttcctttaaagtctaccccattttatgattattagctgtcagattttctcaaaccctgtttgcagttacagatggtgttttatgtaatgattctgaataagtagagagcctttgtgactccttgtttctgtcgaggatgaattctttatgtattttaaaacgtgttatggctaagtctacagaataaaatgtgtgtcattggggaacctcgtttattataagactgtatttttggaaacgtttgaaaggatttgagccatgcaagtgtgaagaagtgtaactgtcttatagaaggtatgtagaaattgtttcctgtgtccttgcaaacggtgaattatcctgttttttttttcaattagtcagtgttaaatggtgctgtactaaaaactagtattgaataaacctttttcactcttgatgatcacttagaatttttttcttttcctttatttcagagctttatttgcttttataattgtgactgcaatccagatgcagcttttcagtgttttgtaaagtttgtaagatttgccacccatctattgtgtctttccccctttgtttccccctaacggtaaagcatgttagatacatttgtcatacatatgaatagaaatttagtacatcactggtacttttattgtaaaaagtaaggttaataattctagattcctgttataagaattatatattcaaactgccttagaattatactgcattgtatagtaccttgccttgcagacatacaaagggaatttgttgggtgggaggtgagtagggaggaggggagaaaatgaagaatgcacttatggttgaaatatattagcctagtagaaaaatactggtcaagttgagttgagttgtccaaaaataattttaagaaaagttgactattataactatatggagacgtgggtcttataaggttgtatagaaaattctgatccaaactttattttccatggaaataaacttttgagtttaaaatgttcatccttgaatgaaattgtgcatactgagattctattgagaatactgaaaaatacatatgctgttctttattaccccttttgtagctttaatgtagaatatggttagttattcctaacagctttttgaaaacgaagcacacttgagtatgctgaaacattgcctatgaagtgaatggtttttcatggaaatagtgtgaatgtcaaccttgttttatgtgataaattaagttttcaaaacatttaaaactgtatcattagtgaagtggttgcagcatgttttgtaggtttttcctagctcccaccccacatcaagctcttattatttccttcctggactgctgtgatagcgtactaactgctctcccatttctatcctgttcaagccacggtaatgttaagagtatcatctgatgatttatcttacaatgataaatcttccaatgggtttaaaaacctctgaatggcttccctttgcctacaaaataaataaataaataaataaataaataaataactaaaaaaaatcccccaattgcttaccctctcatataagtccctctaatttttgcttccaacttaattttctagttaattctcctcctggagtgcatcataaattctatagaagcaattttgtatttgctgttacttgaatgtatgctttttttcctcttcctgggatgcctttcactcacaatagttacatgttgaaatcttatatgtatgtgtttttaggacccaggtcagatacctttggtgtcagaatatgttctctaaacccttctgttaaaagtcatccctccttcctcttgcctccctcttctagcacttcttcttctttttttttttttcctgaggcagagtctcactctgttgcccaggctggagtgcagtggcgccatcttggctcactgcaatctccgcctcctgagttcaagtgattctcctgcctcagcctcccaagtagctgggattataggcatgtaccaccacaccagctaatttttgtattgttagtagagacagggtttcaccaggctgatatcgaactcctgacctcaggtgatctgcctgcctcggcctcccaaagtgctgggattacaggcgtgagaccccgcgcctggcctactcttgtagcacttctcagatgaaattttttccattctgtctagagaagctactgtactatttatgtatgcttctccctatgaaattggcttcccacctggtcatgagctgcttagcttgcccagggtcttgcaagtagtagacaatttagtcagtatatgtttaattagtaaataaggaacattgtttccttctagtctttaggtgcctttctacttaaggtccttgctcaactcattgcttggctattgtagtagcctagggctaaataacttttgaattagacatttgttgacttagggcccttaactgtaatggtgccaatatttttatatgttttttcatctttattttattttcaagacagagtctcgctgtgtcgcccagtctggagtgcagtggctctatctcggctcactgcaacctccacatcctgggttcaaaggattcttgtccctgagcctcccgagtagctgggactacacaggcgcatgctaccatgcctggctaattttagtatttttagtagaaatggggttttgccatgttggccaggctggtcctgagctccttgcctcaagtgatctgcccacctcggactcccaatgtgttgggattacagacgtgagccactatgcctagcctttcatcttaattttagactgagccataaatgccaagttttatctattattgcttctagtggcctcaaaaactatttttcaaagatgtttccctctagcctatcttttcaataactaacattgttgtgcatcctgaaggttcctaataactgcatggattggtgtatctacagtcatagtaatgtaaaagttgaatccaaatgggagtttaatgtcttaatgtttgtgtatttcctggcagcagtagatatactgaactgttcagatgaaacataaaactttttatttttggctaggtgtggtggctaatgcctgtaatcccagtgtgctttggaagcccaaagcaggaggatcgtttgaggccaggaggtctagaccagaacagctttgtagagatgccatttctacaaaaaacaacaacaacaaaacttttattgtagaaatgttaagattgtagtacagagaatcgcctataagcatcttggttagtcttgctatgacttcgggaattgggattattctgtagcaaagctggatagaggcctctcaaagagcgtcacctttggtcttttgaggattacctatacacaactgattataactcatacacaaaaggttgtagctagtggtctgttagctcagcactttagttttgacgttgttattgttttcattttaggaaaatgtaataaataacttcctttttaaattaatggacaattcttttttaaaaattgttggcttttttttgttcttatcaagacagacttctgaaattatgtatatatatatatatttttttttttttttgaggcagggtctcacctttgttgctcaggctagagtacagtggcatgatcatggctcactgcagcctcaacctcctgggctcaaatgatccttccacttcagcctctctaggagatgggactgtaggtgcttgccaccacacccagctaatgttttaaaaattattttttggtagagacagggttttgccatgttgcctaggctggccttgaactcctgggctcaagtgatctgtctgcttcagcctcccaaaatgctgggattacaggcatgagccaccgtgcccagcctaaaattatctttagggcagcaacgtctcttccttagataattagaaaatgaaaagttttgttttgcaaaacatgaatataggaaagtctagaaaagtggttctcaattttttttggtctcagtaccccttttagacttaaaaaattagaagacctcaaagggcttctctttaagtggattatatctattgatatttgtagtattagaatataactgagaaattaaaatatatttaattcattaaaaaataataaagcattatacatatggcttttttttttgagacagggtcttgctttgttgtcccagactggccttgaacccctgggctcaagtgatccttctgcctcagcatccctctgcgccaccatgcctggcaaacatgttagcataatttttctaaatgaaaaaataactatattttctaaaagcaaaaagagttagtgggaagaatggcattgacatctttactatccagcttcatagaagacttatttggtttttttttttttttgagacagggtctcactcttttgcccagagtggagtgcagtggcgtgatctcagctcactggaacctccatctcccaggctcatgcaattctcctgcctcagccacctgagtagctggggttacaggtgcctaccaccatgcctggctaatttttgtatttttagtagagacggggttttatcatgttggccaggctggtcttgaactcctgacctcaaatgatccacccgagtcggcctcccaaagtgctgggattataggtgtgagccaccatgcctggccaatagaagacatttaaattctcatgtctgctgctgcattgagtctactgagatattacaggttataacctctggaaaacacccctgtacagttataagagaatgagagtgaaaatggccaatagtatcttagtgatactatgaaaatagttctgacctcttggaccctctgaagggtcttagaaactctagattgcggcaaagcgcggtggctcatgcctgtaatcccagcactttgggaggccgaggcaggcggattacgaggtcaggagatcgagaccatcctggctaacatggtgaaaccccatctctactaaaaatacaaaaagttagctgggtgtggtggcgggcgcctgtagtcccagctactcgggaggttgaggcaggagaatggcatgaacccgggaggcggagcttgcagtgagccaagatggtgccactgcactccagcctgggcaacagagtaagactctgtctcaagaaaaaaaaaaaaaagaaactctagatcgcattttgagacctactagtctagaaattagactatatagtttggtggacaacctagtaaagtatcttctgactttgaagccagacacaaaggtggtttcgaagaagcttatttgcttaccttgacatacttggtattttcaacctggcacaatttagattaagtaacattttggtggaaaactggtacactggccctatggttggggaaaatatctgctgagagctacatagaataaataggtcatctgccacttcatgatccttactgttaacaggttaagcagccttatgtggttgaatttttatttttaaccctgcacatttggattcatcttatataaatacttctcctgtgtgtagtaagatgtttcttttatgatctagttgtcagtttttaatgatattgtcgtttgggacaaatgcttatataatcaaatgatgtaaaagccatgccagtttttttgtcttcttattgaaaaagattagtcattgctttcatttaatatattataatgtatagtgtatccaactatgtttcactagaagtatggtgattctcccatttgataatgcttttaaaatttattctcattgttttgatgctgaatgcttttttaattttaattttaatttttaaaattttttttgagacaaagtctcgctcttgtcccccagtctggagtacagtggcatgatttctgctcactgcaatctccgactcctgtgttcaggcaattctcctgcctcagcctcccgagtagctgggattacaggtgtgtaccaccacacccagcttatttttcgtattttaagtagagacggggtttcaccatgttggccagactggtctcaaactcctgacctcaggcaatccacccgcctcggcctcccaaagtgctaggattacaggtgtgagccaccacgcccggcctttttttttttttttttgaaaaagagtttcacccttattgcccaggctggagtgcaatggtgcgagctcggctcaccgcaacctccgcctcctgggttccagcgattctcctgcctcaggctcccaagtagctgggattacaggcatgtgccaccacgcccagctgattttgtatttttagtagagatggggtttctccatgttggtcaggctggtctcgaactcccaacctcaggtggtcttcccgcctcggcctcccaaagtgctgggattacaggtgtgagccactgcacccagctgatcatgaatacttttatatttttcttagaatgtagaaaagataggacgtgtttatgattgccatatttaacaagataggtagaaaaatataaatgtatctatgtgatatgatataattttttattggtattaaagggggagacagcctgagtgtagtagaaagaacacaggctttggaaatagatgacatagattacaaaactagctttgcttcttatcctgcccagagaaaacctctctgtgcatctgttttctgtaaaattgaactcttacctttgtagagttgtggggattaaatgtaccatatcaatatctagtatagtatttgacatatattgtgtaccaaataagtgtagcttgtatttagagcttcttattgaaaacatgtaattatcccatgtctacctctttgggtactcttgcagtcaaaacctttgagctattttgccccattcttttcttccttcccagtgtttactggggccacattttatccattttgggttttggaattgttctctagggtcttttctagttataacgtttcatgagtctatggaaatgtcaacccaagtcatcttttccttttagtttctattgcctcttgtccagttcctcaatacctcaccttagaaatgatttgtaatgaaggtaatagttgctaacatttgttgaagaaattattatagtccaagcactatgttaaatgcttttatatgtattcttttagccacacaacaaccttataaaattggcattgttattatcccactctacagacaggaaactgagacttaggtttagtaacttaccaagtagcagagcaggtccatctgcctaactaaagcccaggttcttaaccagtacctctaaactggttgctctgtttccgatttcttctacccctcactataagtttgtcccaaattcttcagacaggttagttctactgaaatgttattttcattgttttactgttcttttcaaaaataatcagctcttcatttcttttaagtagagataatattcttaaacttggtatacatagtctttagtaatatggcacctaacttacatatttataactttattactaattttctattcatacttctagtcgaattccttctagcccaataccctgattgctcattcctatctcaagcttttgcttaagctgcttcctatgtagaatatgcccgtctcacctccatctttaaatcaagagcctgtctgcgtcccctttccttcttaaaactttctccaaaaattctagcactgtacccttttatatgtagggctgtctctgttattttgacttggaatcatgtgttatattatgataattatttcatgaatataattcacctcccaaacaagataagtttcttgaggtcaggctgttgtatttccttcatatctttttttcttttttctttttttgagacagggtctcattttgtcactgaggggtgcagtggctcactgcagcctaaactcttgggctcaggtgatcctcccaccttagcctcctgagtaactgggactacagtcatgtgtcaccatgcccagcttgtatcttttttccctaaacatccagtgcccaagtattttgttaaattttaggcccatggatccaactagcttcattttgtgacttaagctttaaaatgttaatattatttattatcagcatgtgacctctaaacttatgaagataattggctgggcacttattgtaacaaagggaataatgaaaaaaaatgcaatacttaatgttattagcaagatttatatagctctgagtaaaattgtgtttgaaactttgaacaattagaaatgaataggccgggcgcggtggctcacacctgtaatcccagcactttgaggtgccgaggtgggtggatcacttgaggtcaggagttcgagaccagcctggccaacatggtgaaaccctatctctactaaaaataaaaaaattagccaggcgtggtggcgcgcctgtagtcccagctagtcaggaggctgaggcaggagaatcgcttgatccctggaggcagaggttgcagcaagctgagatcgcgccactgcactccagcctgggtgacagagcgagactctgtctcaaaaaagaaatgagtagtaagtttttcacagtgtattaggttagttttaaatagcacagggccaaacggagagttttaagttatccagtgtgttattataccacttaattttactgtgtgtaagacttgacttttaacaagtaaagtgagccatcaagccttattaaagatcgatttccacattgcttgcccatatatgttgtatgtattgttccttgtgcatatttgtaaattcacataaagtaaaagggttatcttattgttttctttttcttttatttatttattttattttattttattttatttttgagatggagtctcgctctgttgcccaggctggagtgcattggcatgatcacaagttactgtagccttcccacctcagcctcccaagtatctggggctacaggcatgcaccaccacacctggctaatttttaaagttcattattttaataaaagaggcagtaggctacgtccagcctgccaaatcataccattttgcatgtcgcatatcagtatgaaaactgccctatgagttggtattgatgagccaacacaaagccaaagtcaataccatctacccttatccatacttggacttcctgtttcatgttctgtttgtgggccagattgcctatccttacctgaggatatgtaacaacaaatccagagcatgcaactgtgtaatcttaaatattgtgataatttttatttattaactatttatttttaaatatttattattttttaaatagaggtagagtctttccaggttgcccaagcttgtctcgaactcctgggctcaagcaatcctcccaccgcagcctcccaaaatgctgggattacaggtgtgagccaccgtgcccaacccgtatttatttataaacttaagaaaaattcaattatgaatcaaaattaaaaatctgaatgaaaattgctctgaaaaaggtcttgctgaaaggaattgttgtgctggaaatatattgctttagattctgttcttacatatgtattaagcttttttttccatagaggatagagtgacctttttacaacagggtcactcaatatggtctaatttatgttgaacttctaatagacatttatagaattaaccacaacctttttttctgatattagttctgggatgtattttataaaaagtgtttaattcatatgttttcagctgcaagcaacagaactaattcaaaatggctttaaaaataataaattttatcttctcatttaatagagttagttgatttcagtagttcaacaatgtcagtataaacccatattttgcttagccatatattgctcaattctgccatccttgggactggcttcatcctcaggctagtagcaaaatggttgcggtgattccaggcatcatatcatatccataaataacaacttccaaaagaagaggaaaagtatctcttcctgtgccactgtttttggatagaggaaactttctacaaaaacctctagcaaacttctttcccatctttttggccagaattgggtcataggctagttcctgaaccagtcaccagtaaataacccttaggttaatcacgtttctcaatctggaatggtgttggcttctactgaggtatatggttgtattggggagagattctgttaaagaggaagagggagagaattgatgctaggaaagtaatttggaaaaccataactctcttcagtgttattgtctttgtcaataaacagtattagcaagttattttttactttttcaaagttaaaatctagctgtgggaaatgcattctcattttctattttttttgagacggaggctccctctgtcgccaggctggaatgcagtggcacgatctcagctcattgcaacctccacctcccgggttcaagcgattctcctgcctcagcctcctgagtagctgggattacaggcgcccaccaccacgcctggctaattttgtctttagtagagatgtggtttcaccatgttggtcaggatggtctcgatctcttgaccttgtgatccacccaccttggcctcccaaagtgctgggattacaggcgtgagccaccgcgcccagccacattttcattttctaagttggacttcatagggtcacatagtattgagttaatataagacagacctttttctatcttgttggttgcttactagaagatgaggaagctaacatctctggtttacagttaactaatttgaggaatataggcattggaatagtgttagtgtagcaagtaaatgagtgtaagagaacattttgcaaaactatacacttaaaattctaaagttcagtaaattaagtaaacttgggacctgtggaatgatttatgatttgaaagctagcctgaaaaattaggagccgtccagactgggcaacatgaagaaacctcgtctttacaaaaaatacaaaaattagctgtgcatggtggtgcattcttatagtcccagctacttgggaggctgaggtgggaggatcacttgagccctggaagtcgaggctgcgctgagctgtgattataccactgtactccagcctgggtgacagagcgagaccctgtctcaaaaaaaaaaaaaaaaaaaaaattaggagttggttacaatggcacatacctgtagtctcagctacttacaaggccaaggtggagttttgcttgagaccaagagttggagatcagcctgggcagcatagtgaggctatctcaaaaaaaacaaaaaaatggaatactactttaaagtaacctgtagattatatctttcaattaaaatgtatgatgtgcctaagtattgatttttctcagtatgttagaaatctagaggcagtatagtggagtagttaagagaggggtctctggaatcagaacgcctgagttcagattgtgcctctgccacttcttaacatgtgtcctttggcaatttacttaccttttctgtgttgtggtttcctcacccaaaaagtagggtgataatggtcattcaatagggttatgaggatttagtagattaataactgtcaagtacttagtgtggtacctagaacatagtaaacacctgtaaattttttttgtttgtgtgttaattcatgtttttcaacaaatatttgactgccaggcactattctaagtgtagtagtgaacaaaacagcaaaaatgcttcatggactgtacatttccaagggagtgaggagagcagagaataaacaaattcataagtaaaatacctagtgatggtgttaaatgctgtggagaaagaaacagaggataaaaatagagtacagggtgagagatctgctattttaaataggaggccagggagggcctgacctaaagcaatgggagagcaggtcatatggaaatataacaggtgtgaggatgggggttccaggtagaggatatcagatgacctaccctgaggcaggagcatctctgtgatatattcagggatcatctaggaggccagtatggctagaatggaatgaggggaaagtagtaaaaaaagacaagtggctgggcgtggtggctcatgcctgtaatcccagcactgtgagaggtcgaggtgggcagatcacctgaggtcaggagtttgagaccagcctggccaacatgacaaaaccctgtctctactaataatataaaaattagctgggtgtggtggtgggcgcctataatcccaggtacttgggaggctgaggcagcagaatcgcttgaacccgggaggcagaggttgcagtgagctgagatcgtgccactgcattccagcctgggtggcagagggagactccatctcaaaaaaaaaaaaaaaaaaagacaagtaatggtatgggtggtggggctttcccaccatgtatgccattgtaagccattgtaagaactttggcttttaaaactcgtataagatgagaagccatcaaagtgtattgaacagtgatgtactatgattcttggcttaaagaatcattctggctgctggtggaaagagggaaaggtagaattagagaaactggttaggaggctattgcaacagtcaagctgagggatgatggtggcttggacaagggtagaagctgtgaggttgtaaaaagtggttgcgttctgaatgttactagttatatagcttgtcatttccaaactgacttactcactttattttctaatttcttagctttgtatttctccatatgctatatatgctttaataattaataagtctaacttttaaagtaatgccaaagctatttatatatattttgatgtatttttctgtgtgggtttttttgtgtgtgcgtgactgggtcttgctgtgttgcccaggctggagtgcagtgtcaccaacagctcactgtagccttgacctcctgggctcaagtggtcctcccaccttagccttctgagtagctaggaccaactacaggcgtgcactaccacacctggctaattaaaacaaatttatttttgtagagacacgatcttgctgtgttgtccagactggccttgaactcctggcctcaggcaattcccttaccctggcctcccaagtgctggggttacaggcctgagccattatgcctgacctatttttctctctttctttctctttctttctttctttctttcgagacaggtttcactctgttgcccaggctggagtgcagtggcatgatcttggttcactacagccttaacctcctaggctcaagcaatcctcttacctcagcctcccgagtagctgggactacaagtgcatgccaccatgcccagctaatttttctcttttttgaagtgttaagtgattcagatctctgacatccagttgccaactaacagtatatgtggccttagttgtttgatgaaagcttgttcatgagttactttttaaataaacattagttgataaatttagattgtactataatttactttttttttttggatacaagatcttgctgtcacccagactggaatgcagtggcacaaacatggctcactgtagccgtgacctcctgggctcaagtgatcctcctgccccagcctcctgagtagctaggactataggtgcgtgccaccatacctagctaattttttgattttttgtagggatgaggtcttactgtgtggcccatgctggtcttgaactcctgagctcaaaggatcctcctgccttggcgtcccaaagtgctgggattatagatgtgagccaccacacccagccaatttactttcagaagtaactttggaaaagaaaatttcctgatgttcttaatttttttggtgggctgtgaaggggagaagaaactaaagagaacgaagccatgccatacatgtttcattttactttatgtgctgaagttcttgctttctgagaataattaatagagatttatgttattttctttttggcataatgtttaagtgcttgagtatagatagatattgatataaaatgggtaaagtatctgtgtttaagagctccagactcaggttgttgggatttcctattctagccctgcctatttctagtttgtgaccttgggcagttttctaatctgtatagcatagaaaagaatattaatcctgctgtagggttattgtgagaattatatggaatagtacacataagacacttagggcaggtatctgttattgttgttgttatttttattatttatttatttatttaaaacaaaattttttttttttttggatggagtttcgctctgtcacccaggctggagtgcagtggtgtgatctcggctcactgcaacctctgcctcccgggttcaagcaattctcctgcctcagcctcccgagtagctgggactgcaaaaacacatttttgaaaaagagataaggctttaactctgtcacccaagctagcatgcggtgccctgatcatagctcactgcagccttgagctgctgggttcaagggatcctcctccctcagcctcccaagtaggtgagactacaggtatgcactaccatgcctggctaattttttttatttttaatttttgtagagacggcgtctcactgtgtttcccaggatggtctcaaactcctgtcctcaagtgatcctcctgcctcaggctcccaaagcagtgggattataggcatgagccactgtgcctggcctattttcattattattgataaaactgggatgctttgtggctcatctccatagcgtcccattcagaggaagaaccagcctaatattcaaattaaattgaaaagtaatttaagtatttattccatcctctcaaaaatgccaaaggggtttacattcataaaactacaatactacttaaaatcctatttcttcatgtttggcatggttaatcccaaactttcttctctcttaaaacttaccaactcatgacaacttgagcagtcttatttttgcgtttcttttgtaacccttctcaaacctattaagtttctattccgtgagtacctgtctcccattaaactctctcctttgcccgtgtcattattctgatctgtacaataagggccaggaaccaagagagcaaagaaaagaagctatgaatactcaaatatagcaacatttttgtttctgtcacacttgtctgtggtagaggatataatatgttttggcttttggaaaaaaagtctgtttagttttagaaggacaacgaggtggttcagacctgttgcaggacattaattcgggacttggaatttagtttttctccagatagtcataaactatataagagctgctatcatatctctctaactgggactggttcctagtgttcagcccttgaaatttagtattgccagataaaatatatgcagtatggaccatgcagtattattcattgtttatttgaaattcaaatttaactgtgtgtcctatatttttatttgctaaatctagcaaccttaatttagagagaggatgctgactaggctgtattttctagtacattttctatggtgtttaagagtacatgtgtaacttgatgtggtggatatgaggatactttcagttttgataacagaaaatgcaactcaaattagttaaaacaaagggaatttgaatttgaattacatacgcttatgtaattgaaaagaccaaagggagtgagggcccctggcatggtttgatgaagggtacaggctttggccctgtttttctataattctcttggctttaccctgtattagcttttttttctcaaacgggcttccccagtagtacaagatggctgcctttgtatgtttcctcattcctggagagaaagtagatgcttcctacaaatacagtgcaaaatcctaagcttgacactaattgaaccatcttgtgctccaaaggatcactgtcttaaaatctgggtagctttctgtgtctagaccagtggcttttaaacttgagtgtgcattagaactacctggaggacttgttaaattacagattgcagccaggcactgtggctcatgcctgtaatcccagcactgttggaggaccaggcgggaggattacgtgagtccaggaattcaagatcagcctgggcaacatggtgaaactctgtctctaccaaaaaaaaaaaaaaaaaaaaaattagtgaggcttggtggtgtatgcctgtagtctcggctacttgggaggctgagatgggaggattgcttgaacctgggaggtcgaggctacactgagctgtgattatgccactgcactccagcctagatgacagagaagatgctatctcaaaaaacaaaaacaaaacacacaaattgctaggtcctacccccaaaatgtctagttgagtaggttccgtaggcttggttccaagaagttatatttgtaacacgttcccagatgttactgattttgctggtcacaaaccacactttaagaaccactgttatgtcaaatcagggcctacttctggagctgaggaaggggtcaatcccacttaaactttttaccagtgaggggaggcggtaagatgttttggaagataacaacaatgtccactgaagagaggactgctggtttttttgcatatctactttctcttccctcttccctcttatttaggtaagaacttcctgatttttctcttggaaccactcctccttcatttggaatgatgtggcttgggtggttggcctaacccattggtttaagggtgggcacgtgatctaggcctcgtcaatgagagcacttgcatagtcacagtgatcagcccaggagtgaatagggcagtgatctttgtagtttagtcagtgtacgttactatacgttgctgtttactgtcctggctagggatatgaagattacataatccctgtcctcaagaagctcagactgtaattatgaaagacatatctgtaaatatacccatgcatcgctcctctttataattccttctctttctcctgtcatctaagatatatttttaatagatactgtactacctaccacctttataatccttaaccatacttattatcgtttagtgtctttagtcctcattaaattataaattccatcaggataaggactgagtccataattagttgctggatcttcaatacctagccctgtctctggcacatacaaagtattcagtaaatattgattgaatgaatgtcaaagtatagcaatagaagaatatataaatgaaatagggaatgattggtttactggtggagtaggagacgtaacagcctgaataaatgcataaagttattaaaacaccttaagttttgttgaagacaatgtatgagataggacgtggcctgcgcatggtggctcatgcctataattctggcactttgggaggctgtggtgggaggatctcttgagctgaggagtttgataccagcctgggcaacatagtgagacccccatctctttaaaaaaaatctggctgggtgtggtggcacatgactgtagtcccagctacttgggaggctgaagtgggaggattccttgagcccaggaggctgcagtgaactatgattgggtcattgcactccagcctgggcaacagagcataaccttgtctcaaaaaaaaaaaaaaaaaaaattgagagataggaagtggtattagatgaatctggaccactaggtgcggtccagatcatgaaaggccccgaaggctatatttaggggttgaattttatcctgcaggcatttgggaagccactgattggttttaagtagggaagagagtacagtggctgtaaggtaaaaaatagattggaggagaataagattaaagaaggaaaactggttaggaggctattttagtacagaagaaagatgttatgaaagcctaaggctaagattgtagcagtgagaatgaatagtagagttgtttaaaaagtaggattggtgggcttcgaggctattctgaggaaaatgaaataatctagaatgacttttggttttctagcttggtagatggtggtagtataaaccaagagaagcaagttgaggaagaaggacagatttggattatatggcctcttacataaaaatgagggaatggtgaaatggcccaggttctctccttttggtgggattctttttctcttaggcttcacttgggcaggagaggagagtggcttctgctacttctaggtttggggactagagcggatgatagtaaatcagatattactgagttcgtagggtgggggagagatcacagtgagaatggaatgcttccaggttttagttgctaaagtaatttttagttttcagatgtttaaactgcctcatcctttttgaaagcaagtgtataaattataagaaaattaactcttaagattcatgaattagcttcactattggtggagatgtgaattgctgcagctgttttggaaagtttgtcaatatatagtaaaatagctcttctgggaatctgttctgtagaaataaaagtatcaacatataaaggtatatgtatggatatttttataatgtttccaatatttgctactaaaaacagcctgaatatccatcaatagtaggaagtataaattgtcatttacctgtactgtggaatatttcgcaactcagagaatgtgttataagtctgtatgtatttacctggagggatgtctgtaatagattgtagagtaagacaaacaagttataaagaaatgtgtataataagatcccatttttataaaaaaccaaaaacaatgtttcacattcttttttaggattataggaacctgaagaaaggtgtaaaggtgtattttatttcaggttctctttccatggcatatcacagtgaacaaaacaaagtccttgttttacgtaggaggacatgtgacaataaataagaagtgaatatatagtatgttaggtggagataaatattatagagaaaacaactactggcttaagggggatggaggacagagatggaattgctattttattttgggtagtcagaggaggcctcactgatatggtgacttaactttctttttgtgaaatacaataatactaaaaagtgtaggaaacataaacatacagtttgttgacttcatataaattgaacagctacttaaccaccacctagataaagattttatagatagccagcttctcagagacccaaaacatgcccccccacccttttttttgagacagagtctggctctgtcacccaggctgaagtgcagtggtgtgatctcagctcactgcaatctctgcctctgggttcaagcaattctcatgcctcagcctcctgagtagctgggattacaggtgcacacagctacacgcggctaatttttgtatttttagtagagatggggttttatcatgttggccaggctggtcttgaattcctggcctcaagtgatctgcccgcctcagtctcccaaggtgctggggttacaggtatgagcactgcgtggagcctaaaacatgcccttttctaattatattccccttcttacccccagaggtaagaaggcagcggtggggcatgttttgggtttctgagaagctttgtgtacatgctgccttgagaggaagaagtattgttagaagactggtttgaatttggtctgcttaccaactatgtgacattgaatggttgtcatataaaatggaagtaataatacttaattcacaaggatttttaaataagaattataatatttatgtgcccatatatatatattcacatatatatgtaatgaaataacacccagtatctggcatatagcaggtactctatacatcttttgtgaaggtcagtgttttcgtgatatagtaatagggaaatgtgtagagcttgtgctagagattttgttagaggcagctacgtatcttacttgctagaggctacttggctctagtatgtttggctctaagatcaggatgggtaaaatcttgggacaagagaagcaatgtagcaagtgtgagtgaccatctttctttttttatgggtcatttcaactttttctatgggaaaattaaaaaaaaaaaaccaactttttctgttcccaggctgaccctcccccctccgctttttttcattttgtgtctcagtaaaattccactgctgttcagcataattacttcttggatcttcacttcctctctatggtaagcctaaatgctgaccatctcaagcagtaattcaacaaatatttattgaatggcttctatgtgtgaaacacttggcactggagatacaaagatgggtaagaaaatatgtgccctaaaggagctcatagtctttgagtacaaagatagggttcaacaactaaactataatcactaaactttagattagaaggttgagaagagctctgtagaatcaaagaagaggtattacttaacaaggcctgagaatatgagggaaagtttcatggaaaaaaacatgcataatttgagtcttaaaaaaaaagtagctgggctgggcgtggtggctcaggctgagcctggtggctcacacctgtaatctcggcactttgggaggcaaaggtgggtgcataacttgaggtcaggagttcgagaccagcctggccaacatggtgaaacctcaactctactactaaaaaaaaaaaaaaaaaaaaaaagccaagcctggtggcatgtgcctgtagtctcagctactcgggaggctgagccaggagaatcacttgaacctgcgaggtagaggttgcagtgagctgagatcgtgccactgcactccagcttgggcaacagagtgagaccccatctcaaaaagaaaaaaaaaaaagtggatgaggcaggttggtaaaagagatagggatgggcattttatgaggtacaggatatgtgcaaaggcatgagaaagagttgtgtgtttggatgagctgcaggtattggtgtatctagggtgaaaggtgcctgtgggaaagtaataggaaaatgagcttggaagagtaagcagagactggaccatgtagggccttctatgccatgctgaagagtttgaactttatcctgtatgtggtggtggaactcttgaaacatagtgtgctaaaccattatggttagatttgaaactcaaaagaagcagagaagggtggaaaagaaccaggagattggtcgggcgtggtagctcacgcctgtaatcccagaactttgggaggctgaggtgggcggatcatggggtcagaagttcgagaccagcctggccaatatggtgaacacatctctactaaaaaggcaaaaaaactagccgggggtgttggcgggcgcctgtaatcccagctactcgggaggttgaggcaggagaatcgcttgaacccaggaggcagaggttgcagtgagctgagattgcgtcactgtacttcagcctgggcaacaggcggagactccatctcaaaaaaaaacaaaacaaaaaaccaggacattggtctctggtaagccgggtagagatttttcaagaaggaaaaaatggctaacagtgtacaatttaaagtgattaagtgaaataatgatacaaaagctactgctggactttgctattgagacaaccttaacaagatacatatttatgtagtgattagggtagaagccaaattccaatagaagagtaactgggaggtgagaaaacagactgcaaatgtagaccatttttagaaaacttgctgtgaagcaaaagtaagaggtagttagagaagtagagcagagaaacatattttttttttttttttgagacagagtctcgctttgtcacccaggctggatggagtgcagtggcgtgatcttggcttactgcaagctccacctcccgggttcatgccattctcctgcctcagcctccccagtagctgggactataggcgctcactaccatgcccggctaattttttgtatttttagtagagacacggtttcaccgtgttagccaggatagtctcgatctcctgacctcgtgatccgcccgccttggcctcccaaagtgctgggattacaggcgtgagccaccgcgcctggccgagaaacataatttttttgaagatgaaagttaagcatgtgttatgttttggtggagtagaatagagttaagactgaatatttagggctgtgtgatttgatggaacaggaaggtggtgggtgtggaagcaagaagggattactgtgctagctcagggaaggaggagataaacctttgcctaacatttagaatgaaggatatgggtatgacgaagagtgtaggctggaaaatggggtgaggtcagatttattttttctggtaaagggcaattgtgagagaagagatgtatagagtgtttggcttgagatttagagtacccattgattactgtctgggatggaaaaggtcactgatcctgaggcatgtggatgaattaccaacaggatagtaatctcagttaggattagaaactgtaaatttgtagtggaatgaattcctaacctgttatgattttcttcagcaggactcagtagctgtggtatgggaatagaggaagcaggcagttggattgatcctcctcgttcagagatttactggctagtgtggcaaaagaaccatagggagctggagagatcctggcaagagagtgggtgatgttcaacattaagtgaataattaagtaaatgatgatacattcatataaaaagctgtgtttctgctattaacatttatgtttatgaagagtttataaaagtacttattttataatgttaaggtaataaaagtgctgtatattgtacaaagggttagtaataactgtaatattcaagagattgtttagggcataatgatgaaaagatacaaaaccattgtattggtcacacctattcacatgaagacaattatttgacagagattattagttcttctttataggtgaagaaaatgagctttagtaagggtgaattgttcagggtcacagatttggtaaatggcaaagagaactattataatttatggaatagttactgtgtcaggcattgttttatctatgtagtattaatatttttctcacatattgctctaattttaatttttagttaaaaaagcacactcaaaggagagtaacaatataagcaatagataactaagtatgaattatctaaatagtggattccaactaactttgcaagttgcaaagagtgataccaagtgctagagaagttcaaaagaaagatgtaggctagagtcgaagaaagactttggagataatcatatttgaacttggactgtgaaggataggtaggatggtctttttaagtaaatgatgatacagtcatatagaaagctgtgtttctgtttttgttttgttttgttttgttttgagatggagtctcgctctgtcacccaggctggagtgcagtggcgtgatcttggctcactgtaacctccgcttcctggtctctttgatttattcctttccatattaaaaaaataatagtactctgtaatagtctagtatctcatgtatctggagcctttgcttagataaaaagtcttgcttttttattttatttttttgagacagagtctcactctgtcacccaggctggagtgcagtggcatgatctcagtggtgcaatctaggcttactgcaacctcccaggttcaagcaattctcatgcctcagcctccggagtagctgggattacaggcacctgccaccatgcctggctaatttttgtatttttagtaggctttcaccatgttggccaggccggtctggaattcctgacctcaagtgatccactcgccttggcctcccaaagtgttgagattacaggcatgagctgcttattgtttttaaaagactaaggcagccgggcacggtggctcacgcctgtaatcccagcactttgggaggctgaggcgggtggatcatctgaggtcaggagtttgagaccagcctgaccccgtttgtactgaaaatacaaaattagccaggcgtggttgcacgtgcttgtaatcccagctacttgggaggctgaggcaggagaattgcttgaacccaggcggcagaggttgcagtgagccgagatcacgccattgcactccatcctgggcaacaagagtgaaactctgtcaaaaaaagaaaaaaaagactaaggcaatcaatctgtggatatcataaaggactcaacattatttgctgatccctggggtatcatttaagattgctttggaaggaatggaagaaatatgagttccaactaactttccaagttgagtcatgaactccttgataggccttctagaatatatttaaagtgtaaatataatgtatctatccatccattatctaaagttatttttctgctaagtcgtttatatttgattattattttttactatggttagtggaagaaaagcaatttgaaataactactaaaaaccattgaaaccaaagattgagatttttgagggggcagggagataatcatcaagaatatatcagaaaggatttaatggttgaggcttggtatgatagcttatgcctgtaatcccagaactttgggaggccaaggtgggtctatccacttgagcccaggattttgagaccagcctgggcaacataccgaaaacttgtctctacacacacacacacaaaattagctgggtgtggtggcatacacctgtagttccagctgctagggaggctgaggtgggaggatcatttgagcctggaaggtcaaggctgcagtaagccatagtcgtccattgtactccatcctgggcaacagagcaagactgtgtctcaataaataaataaataaacaaatgattgccctgtactcaaggttaaaatagggaatgctgtatgtggatttattattcatcagtttttatatttgagatgcctataattgccatgtgtaagttaatttccacaagaagcagtcatcattgtaatttttttgaaggtttcaaatatactttatttcttcatttatgccatatcttaatgggtacacagtgcttttacttggcttcaattatgagctgttttttatttaattaattaatttatttttttgaggcggtgttttgctcttttggctaggctggagtgaagtggcgcaatcttggctcactgcaacctctgcccccacctcccccttccaccccagccccggggttcaagcgattctcatgcctcagccttctgagtagctgggattgtaggtacccgtgaccacaccctactgatttttctatctttagtagagatggggtttcgctgtgttggccaggctagactggtctcgaacttctgacctcaggtgatccacctgcctcagccttccaaagtgctaggattataggcatgagccactgtttccagctgatgagctgttttttgttttgttttgttttgagacagagtctcactctgtcacccaggctggagtgcagtggcgtgatcttggcttaccgtaacctccgcttcctgggttcagttcgagcgattctcctgcctcagcctcccaagtagctaggattacaggtgcaagtcgccatgtcagctaatttttgtatttttagtagagacggggtttcaccatgttggccaggttggtctcgaacttgacctcgtgatctgccctcctcggcctcccaaagttctgggattacaggtgtgagccaccgtgcccagctgatgagctgttttttaaacaattcagtattacaccagctgggatgattactgatctctccattccttcggagtgactctcccatcaggggacaggttccattctattccaatttgagttgctacataagtccatacagcaatagagaaagtggctccactagctaatacagcattactgtatttgtcatgaaaatcaggtgtatgtttctggtggctctgccttgcgattgtttgcagaatgctttgaacttggagatgacttagtgtgtgtttttttttttttttttttttttttgatggagtcttactctgtcacccaggctggagtgcagtggcgcaatcttggctcactgcaacctccacatcccgggttcaagttccctgccttagcttcctgagtagctgggattacaggcgcttgccaccatgcccagctaatttttttgtaatttttagtagagacagggtttctccatgttggtcaggctggtctcgaactcctgacctcaaatgatccacctgcctcagccttccaaagtgctgggattacaggtgtgcgccactgtgcctggccattagtgcattttcaaccaagggaaacattgtgaaggtgaagatagaactgtggtaatgcaactgctgctttggtgcaaattcttatgattgtaatctgtctcgtttgtagatgtttcatttaatggattatggcttcaaatgggtatttgatactttctgataggatttacatggtaactacacagaattaaatattagacaatttagtgagctatgaaaagatagctttaatagggaaagcactttttaaaaataactaagcaaatcttaccaaaactgacttgaaaagaagttgaaaatctttttaattttgtcaccataaaagaaatttaattagtgatttaaaaaatctaccagaacaattctaggcccgtacgatttccttttttttatcattgcagttttaaaaaacttcatgtccaggcgtggtggctcacgcctgtaatctcaacactttggaagtccgaggcgagtggatcacctgaggtcaggagtttgagaccaacctggccaacatagtgaaactctgcctctactaaaaatacaaaaaaaactagccaggcatggtggtgcatcctgtaatcccagctatgcaggaggctgaggcaggagaattgcttgaacctggggagcagaggttgcagtgagctgagatcacgtcacttcaccccagcttgggcaaaagagtgagactccatctcaaaaaaacaacaaaaaaaagaccttcacataatataaaatataccatcatggccgggcgtggtggttcatgcctgtaatcccagcactttgggaggccgaggcaggtggatcacaaggtcaggagtttgagaccagcctggccaacatggtgaaaccccatctgtactaaaaatacaaaaaattagctgggcgtggtggcaggcacctgtaatcccagctacttaggaggctgaggcaggagaatcacttgaacctgggaggtggaggttgcagtgagccaagatcgtgccactgcactccagcctgatgacagaccgagactccatctcaaaaaaaaaaaaaaaaccactcaattctcctatcttgccaaatatatcttcatgcaaacttagaagactgggttgaggctgggcacggcggctcatggctgtaatcccagtactttggaaggctgaggcgggtagatcaccgaggtcgggagtttgagaccaacttgaccaacatggagaaaccccatctctactaaaaatacaaaattagccaggtgtgatggcgcatgcctgtaataccagctactcgggaggctgaggcaggagaatcgcttgaacccagaaggcgnnnnnnnnnnnnnnnnnnnntggttcatgcctgtaatcccagcactttgggaggccgaggcaggtggatcacaaggtcaggagtttgagaccagcctggccaacatggtgaaaccccatctgtactaaaaatacaaaaaattagctgggcgtggtggcaggcacctgtaatcccagctacttgggaggctgaggcaggagaatcacttgaacctgggaggtggaggttgcagtgagccgagatcgtgctattgcacttaagcctggacaacagtgcaagactctgtctgtaaataagtaaataaataaataataccatcataaactttttttgaggcggagtctcgctcttgttgcccaggctagagtgcagtagcacggtcttggctcatgcaacctccacctcccgggttcaaacaattctcgtgcctcagcctcctgagtagctgggattacaggcacctgccactgtgcctggccaattttttgtattttagtaaagacggggtttcaccatgtttcccaggctggtctccaactctggagctcaggcagtctgccttcacaaagtgctaggattacaggtgtgagtcaccgtgcctggcccatcataaccattttcaagtgtattgttaagtgatactaagcatattaacattgttttgaagcagatctccagatttcatcttgcacatctgaaactctgtacccattaaacagtgactcgtcgtttcccctatcacgcaacccctggtaaccaacctttactttgtttctatgattttgtctacttcagttacctcgtataagtaagtgggatcatgcaatatttgtctttggcttatttcactcagtataatgtcttcaagtttcagttatattgtagcatatgaaaggattttcttcctttttaaggctgaataatattccctttatgtatataccacattttgtttatccattaatctgttgatagactttgggttgcttccacctcttagctattgtgaatggtgctcctgtgaacataggtctgctactataatgtctctttgagactctgctttcaggttttttttttttttttttttttttttttaagatatatacccagaataagaaggattgctggatcatatggtattttaaaaattttttttgaggaacctccatactgttttccatagcagttgcaccattttacaatctcaccaacagtgctcaagggttccagttactccacttccttaccaacactcttcttttctttcttttttcttttagtagccatcttaatccggcccatatagatttataaatgagttctaccaaacatttatagacaatcataatttcatataaattcttcctaaatcaagaaaaagaagaaacattctcattctcatttaagtatttaatgggttattctaagataaatactgtataaaaagctaaagataatttgctgatatatatgaaataaggttgttggatccaagaccactatacagttggattcctttatacaagtagcagataacaaatgtaatttttaaaaagctttattgagatataattcacataccatacaaatcaccaattttaagtatacaattcaggccgggcgctgtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggtgggcgcctgtagtcccagctactcgggaggctgaggcagaagaatggcgtgaaccccagggggcggagcctgcagtgagccgagattgcgccactgcactccagcctgggcggcacgagactccgtctcaaaaaaaaaaaaaaaaaaaaaaaagtatacaattcaatgttttgatacattacattgttaattttttaaagttataaaatacgaatgacaaaatttttcattttaactgtttgaagtgtacaattcagtggcattaattacatttacagtgttgtgcagctgtattcatcttccatatagaaactctataaccattaagcaataactccctcattctcccttcactttcagctcctggtaaattctgttcaacttcctgtatgaatttgcctattctagatatttcatgtaaattgaatcatacaatatttgtccttttgtgtcttcttatttcatttagcataatgttggtgttcatccatattgcggcatgtatcagaacgttactcatttttatggctgaataataccgcattgtacatatagaccacattttgtttattcagtcatctgttggtggacatttgggttttttttgtgttgttgtttgtttgcttctttgaaacagagtcttgctgtgttgcaaggctggagtgcagtggcgtggtctgggctcactgcaacctccgcctccaggttcaagcgattctcctgcctcagcctccctcagcctcccgagtagctgtgactacaggcgcatgccaccacacccagttactttttttgtatttttagtagagatggggtttcaccatgttggtgaggatggtctccatctcttgaccttgtgatccgcccacctcagcctcccaaagtgctgggattacaggcgtgagccaccacgcccagcgcacttgggatgtttttacaaatttttttttttttttttttttgagacggagtcttgctttgtttcccaggctggagtgcagtggtgtgatctcagcttgctgcaacctctgccttctgggttcagacgattctcatgcctcagccacccgagtagctgggattacagatgtgccaccacacccagctaatttttgtatttttagtagagacagtgttttgccatgttgactaggctagtcttgaactcctagcctacctcagcctcccaaagtgctaggattacatgcatgagccacagttcctggcctacaaaatatatttttaaaaagatactcattatagcagcaacagctacaatgacaacaattgaaaggtaccagtgaacaaaatcagcaaaagatgcacatgactttttatgttgaaaagtatacaatttccattaaaagacatgagaagagatgtaattgggataccatattaactgataggaagacccagtgacataaacatgtcagttctttccaaattaatttataagttcaatacacttctgtttaatataatgacagggtatttcatataacttgacaagctctaaaatgtatgtaggagagtaaactgtcaagaaaaattaggaaggagcacttagtctttcacatagcattatttataaagccatattattaatatttaaggcaatgtggtattggcacaggatagaccaacctctgggaagaataaagagcccagaaatagaacccccgaatataaagaaacttaatacatgacagtgagcattgaagatgagtaaggagatgatggactgactaaacagtaaatgataatggaacaattggttatttatatggaaaataaaatgagatttctacttaccatattaaaaaatgtatgtgatgattaaagatgttaatgtgaaaagttaaacttttagaaaaaagtgggagaatgtttttatgatactagggcagggaaggtagaaaggatttcttcaacaagacttgaaatttgaactgtaaaagaaaaagattgataaatatgtctagattaaaataaaaaatgtacagttattgaaattcagcatgagatagataacccatctgggagaaaatatttgcaggaaaaataactaaaaaggattaataatcaggatatatgaagaatattttaccaaccagtaataataataagacagtagattggaaattcatagaagatgaaatacaaatgtcctgcagacatgaaaaggtgttcaacttctttagtagccatggaaatgcaaattaaaacttcaatggaataatattttacactcaccattttggtgaggatgtagaataaggaaaactctcttatacttaagtggacagtggagtatcaactagaacctcattgtagagagcaacttagcaatatctagtaaagtgtataccctagggaaactctagaagatggacaagagtttgtacctgggacaagtaccgttaagttcatagcaacattgtttgtaaaagcagaaaactacaagcagctgaaatgtccatcattaagaaaatgaagaaattatagaatattcatgtaatggtagagaacggtgagaaaataaaaatacctacttgtatcaacataaattaatctaaagatgtaatgcagaatgaaatgctgtggaaagattcctcctgtataaagttcataaagatacaaaatatgttaggagatggaacccctggggaaaaataagggaatttgggaggggtaaaaagcagtggtggaggaagaaaagcctgagggaaaaccaaccttgcattccaaggaatctaaaaaggagcagccagagattagaaccaggtagtttttctgtcatataaaaaattgtactaggttgaagtaagtcctgaattgaaacatctaattctctctgattgatctttgtgtatgtatttttgtgttttattacaacttaaaaagatctgataaaattctgttttaaattaggtagaattttgaaagtacctttgactactttttctgttatgatataattcacatgccatatatccaccttttaaaagtgtttttaaccacatcagtggtttttaatatagtcacatagttgtgcaactattacaactatcttattccagaacattcttatcaccccaaaagaagtcctgtaaccatcaagagtcactctaggctgggtggggtggctcatgcccataatcccagctctgggagactgaggtgggaggatcaattgaagccaggagttcaagaccagcttgggcaatttagcgagaccctgtctctacaaaaataaaaaaaaaattagctaagcatggtgtcgtgtgcctgtagtcccagttacttggaaggccaatgtgggaggatcacttgaactcagtagtttgaggttgtcagctatgatagtgccactgcactccagcctgggtggataagtaagatcctgtctcaaaaaaaagaaaaagtcattccccattcttcttagcctcagtctgtggcaactattaatctactttctgtctctataagtttgcctattatggacatttcatgtaaatggaatgacatggtatatggccttttgtgtttgacttctttcacttagcataatgttttcaaggtttatccaattgtggtatgtatcattacttcattcctttttatggctaaacaatattccactctgtggatatttgttttcccattcaccagttaatggatatttgggttgtttccacatttagctattttgaataatgctgccatgaacattcattgcaagttttcatgtgaacttagttttcagttctgttgcgtatacatgtaagagtagaattactgggtcatattttactttcatgacagcagtgtgttatggtttcactttttccacattgtcaccaagacttgttcgttatgtatctttttgattatagctatcctagtggatgtgaggtagtatgtcactgtggtttcgatttgcattttcctaatgactaatgatgctgagtatctttttcatgtgcttgttggaatgggattttttttacatttcatttttggattgttcattgctagtgtgtagaaatactcttgatttttgcatattccttgtattctgcaaccttgttgaactcttttattagctttagtagttttttgagtatttcttatgattgagtatgcaaatagagatcgtcattttccttttctctctggatgctttttatttattttacttccctaatagccctggctagaatcttttttttttttttttttgagatggagtttccctcttgttgccctggctggagtgcaatggtgtgatctcagctcactgcaacctccccctcctgggttcaagtgattctcctgcctcagcctcctgagtagctgggattacaggcgtccaccaccacacctggctgatttcttgtatttttagtaaagacggggtttcaccatgttggccaggctggtcttgaactcctgacctcaggtgatccacccgcctcggcctcccaaagtgctgggattacaggtatgagccaccacgcccagcccctggctagaatcttaattatagtgttgaatagacgtggtgagagcagacatccttgtgctgtttttgattgtaggggaaagcattcagtttgtcatcatgaattatgatgctagatgtgggttttctgtagatactctttatcaggtgaggaaattccctttaatctagtttttgagtatttttatcatgagtaggtgtttaatttttgaattattatttttttgtggaggcagggtttcacaatgttgaccaggctggtcttgaactcttggcctcaaggtgtcctctcgccatggcctcccaaagtgctaggattatagatgtgagctactgcacctggtagggtgtttaattttgtcacatgatttttctgcatctgttgagatgattatgctggtctttgtcctttattctgttaatacagtgtgttaccttgattgatttttgtttgttgagccaatcttgcattcctggaagcaaatctcgcttggtcatgatatataatcctatttatatgttgctggagttggtttgctagtattttgttgaggatttttttgtccgtgttcataaaggatattggcctgtagttttttcctcctgttttttttttttttgtttgttttctttttctggttttggtatcgggaagactggcctcacagaatgagttgagaagttccctgaatacttatctgatcttagttttcttcagttttgttattgacttcctcttcttttttctttctttttttttttttttaagacagagtctcgctctgttgcccaggatggagtgcagtgacactatctgtgctcactgcaacctccacctcacaggttcaagcgatcctcccacctcagccttccaagtagctgggatttcaccatgttggccaggctgctctctaactgttgacctcgggtgatcggcctgcccgtctccctaagtgttgggattacagacgtaagccactgcacctggccagttttattactgccttctaaaaatatattaatgctgttcttttgttccagttattctttttaagaacacacagaaatactttgttagattctaatttaatttagcttacctgtgaggaatgacttgtggcacccagcagaatattacgaaatttctggtattccagtgaaatctgcctagtatactgtctttcagatggctgaatataaaagtccataaaaattagagatgagagagactatggtgatataatcaaccattttacagataaatggaccagattgtccaaagttacactgctaggttacctggctgagccaggagattttactttggtagtttttactcaccaatgattagtagtgtgtgaaaaggataggttttttaaaaaaaagtttaatttcatctgtgtgtttgtgaacaatgctaagaaacaaatacagtatttatttgaatgacgtaagtgtatatgcgtgcccactcattctatactccagctggagaagccctagaacatataattaatccattgtgtcgggcacggtggctcacgcctgtaatcccagcgctttaggaggccaaggcaggaggatcatttgagtctgggagttcaataccatcctgggtaacacagcgagaccctgtctccataaaaaatgaaaaatatacatataattcattgctatcaggaggaaatttattattaatatcaacagcattttgggaagtcttcaaagcaattaacttttaactgaagaaactatttacccaaattatatcatatgagtgggtggtatcaaaatgaattgaaatcttgaagaaactgtctccaacttggaaagagatatagagggagaatcacattaatgtatcaatctaatatatcaacctaaatgtgtcaacctttaacttttaattaattgttcccttctaattgtttttttccttctacttttaagttcaggggtacatgtgcaggatgtgcacgtttgttacataggtaaacatgtgccatggtgatttgctacacagatcatcccatcacctaggtattaagcccagcatccattagctattcctcctgatgctctctctccccctaccaccccgcgacaggccccagagtgtgttgttccctgccatgttgtccatgtgttctcatcatttagttcccacttataagtgaggataagcagtgtttggttttctgttcctgcgatcctcctgccttggcctctcaaagtttgctgaggataatggcttccaactccatccatgtccctgcaaaggacattatcttgttcctttttatggctgcatagtattccatgctgtatatataccacattttctttatccagtctatcattgatgggcatttagattgattttgtgcctttgctattgtgtatagtgctgcaatgaacatacacatgcatgtatcttaataataggatgatttatattctttttggtatatacccagtagtgagattactgggtcaaatagtatttctgcctttaggtctttgaggaatcgccacactctagttgttgaagtaattgtttattttgattgtgaaacagtttttaaaaaatgtattttcagagagaaatagtagtataattttatgaaaataccatatgtgtctccaaagataaaatcatcgtttaattttgctgagccaagaaactcaactaaaactacctgctggaaatggcacagttttctctctcaacgtcagtaacatacgatccaaattctacgttgtgattggctgttgtaccattttcattcagagattagttttgccaacagtgtctgatttgggattgggatttagctcacaaagcagttggttgttggggtataggaaggggttagtgttactaatgagcacactacagagaaatcattccactggggaaaaatagcatttgtccatgcatgagcaaagttgttgtgtaattcaatgctggatgccaaatagtcagtgaagtttggatttggatgtggcagctcactgatgctggggggatattttgtttaatcattgtcttttaaaatgaacttggtaaaagctgtcagttttttcccttttagaaagatgaaatgttttttgtcttttttctcttttcctgtttccataattttatttttaggctttcaaaaagctgaagatttaattaaaataaatgttttccccttggttagcttgattagtctttttttcctaagcattattctgcatctaagattatatcctaacatccaagatagttctaattcacttcattttttgttcctctaaaataaaatagatttgtgaattttaggaagtatatattatcacattattttgttttattttgtattttgaaccttttataatatctagttatcacaaatagatatctttgggatttttttcttgtttcttggttctttaacagatagtcagaatttaatatctgatggaatattttaggtttgttttgtgtctttgataacatcgttcatcttcgacactttttttttttttgagacagggtctcactctgttgcccagtctggagtgcagtggtgcaatcttggctcactgtagcctcgacatcctgggctcaggtgatcctcccacctcagcctcctaaacagctgggactacaggcacacaccaccatacccggctgattgctgtattttttgtagagacagtttctccatatgttgcctaggatgtttttttttttttttttgagatggagtctcactctgtcacccagactggagtgcagtggcattatcttggctcactgcaaactctgcctcctgggttcaagcgattctcctgcctcagcctcccaaatagctgggattacaggcacctgccaccacgcatggctaatttgcctaggctggtcttaaactcctggactcaagtgatctgcccgcgtaggcctcccaaagtgctaggattacatgcatgagccaccacacttggctgacaacatttaacataataatttatgttcttagtatttaaatgccctcaatactatatagcaaagatttatgtgactgaaacatttttcttaaactgagcattttcatgtcaaagatatttgtagaagattgcatttactatttggaaggtaaatattaagaattttttagaaagcaaatgtgagaagttgacagagaaggagaaattagggggcattgcaaatcccttacagtatttcttttcagtagattgaccaaaatgagtaactaaatatagcttaaatgagttaactgcaaaccagaaacatgaattagtaatagtgtctttatttcttcctaatgaaacttaaaggcaaattctgatctactagtttatgatctctaggatactaaactaccagtaccagctaattaagctggaagtactggggactttttcctaacacaagaataatacttttatgtttgccgtttttggttctacatatgttacttagggctggttcagggaggtagaatatgattttgaagtagcttatagtgaagaatgggagagaggtaaatttagggtaagatttttggattgttttgagggtccacttatggttggagaccattactggtgaaaccaattgaagatgatgtaactttttccctctttattagccgagagagagagcagtaaaagcatgaaaatggattgagctatagtcggggtcttgccagacaggtacagtgggaggataagagagcaaaagagatgatagtattagttgagagagagagaaatgaagaccagtatgggatagaaagaaagtactaagtttgaggaattagaggtcttactgaggtgaaagaacagtggtagtattgctgtaaattggaggtctcattgaggtgaaagaactgggattattggagtaagtggtaaagatgtagagagagggccaagcgcggtggctcactcctgtaatcccagcactttgagaggccgaggcaggcggatcacgagttcaggagatggagaccagcctggctaacatgatgaaaccccttctctactaaaaatacaaaaaattagccgggcgtggtggcacgtgcctgtagtaccagctactcgggaggctgaggcaggagaattgcttgaatctgggaggtggaggtttcagtgagtcgagatagcaccactgcactccagcctgggcgacagagcgagactccgtctcaaaaacaaaacaaaacaaaacaaaacagaagtcaaggagtacgtttgtgaggttaggaatgtgattcttattctagttttataccagaattaccaattgccttttttaaaaaaacatagttgcccaggtctcattctggatcaatggaatcagaatctgtagggagttgggctaaggcgccttcatttaagatgttatacagctgattaaaaaatacttcaaaatttgcatacagtaaagtttatactctttggtgtacagttctttgagttttgacaaatgcatagtggtgccctttatcaggatagggtggataggacaggtgaggaaatatggtgggcccgctgtattcacagattctgcattctcggattgaaataacaaacaactgtggattagaaatattcagggtgtgtgtgaaaaaaaccaataaaaataacaatacaacaacaaaaataatacaaataaaaatatagtataacaattatttacatagcctttacattgtattagatacaagtaatctagagatgacttaaagtatatgggaggatgtgcataagctatatgcaaatattacgtcattttataaaatggactttgaacatccttggattttggtatctgcaggggtcctggaagcaatcctatgaggatactgagggatgattatatatgtttggttttgaataccctcaaatttgctcgttgcactaaagctacagccatagaattcagaagagtggagattattacaatgaattaatattttctctaccatttccttaagtctagatctggaattgacattttttctgtaaagagccatatagtaactactttaggctttgcaggccacaaatggtctctttcacattctctgtgtgtgtgtgtgtgtgtatgtgtgtgtgtgtgtttataaccatttaaaaatgtaaaaatgggccaggcatggtggctcatacctgtaatcccagcactttgggaggccgaggcaggtggatcacctcaggtcaggagttcaagaccagcctggccaacatggggaaaccccgtctttactacaaatacaaaaattagctgggcgtgatagcacgtgcctatagtcccagctccttgggaggctgagacaggagaattgcttgaatccgggaggtggaggttgcagtgagccgagattgcaccattgcactccagtctgggtaacagagtgagactctgtctcaaaaaaaaaaaaaaaaaaaagttaaaatgctggtcacagtggtgcatgcctttagttccacagctactcaggagggtgaggcgagaagatgacttgaacccaggagtttgagaccagcctgggcaacatagtgagaccctcctctcaaaataataaaaaaagtaaaaactattttttgcaccttggaaaacaggcagagggccatagtttgctaaccccaggcagatcatcaataccacaataaatcaagctctgatttgtagtatttgctgatttccaaagtataaatactcccactgtggctgatttcagtctactagtgtgactgacataccaaatgcagaatttgaaagaaatcctcagtagcacacagtatttccattatataaatacaatagatgtttcttaaaagcatagttaaatacagtattaatgaagcaatgagttttgagtatttttaactttatttttaatataatttaattgtgaacttacatggtttaatatttaataatgactgtgtggaggctgggcatggtggctcacgcctgtaatcccaatactttgggaggccaaggcaggtggatcatgaggtcaggagtttgagaccagcctggccagtatggtgaaacccccatctctactaaaaatacaaaaaaactagccgggcatggtggcacacacctgtagttccagctacccgggaggctgagggaggagaatcgcctgaacctaggaggtggaggttgcagtgagccgagattgcgccaccgcactccatcctgagcaatagagggagactgtctcaaaaaaataaataaataaataaataaataaataaataaaaaagactgcgtagaacagcagtttgcaaaattcctgaaaatacaacaatcagctctcactagcctgtacaagttgaattcaacatagcatgaaacttaaggttcagagaggtgagataatttaccaaatctagtttaagtggtggaatcagaataaactctaggtttctttttatttttatcttaaaacaatatgggtttatagtttaaaaagtcaaaaagtactacaaggtttatagtacaaaatcatcagttgcctgtcctaccctctcttctgccactttctagcccctaggggcaacacttaactcttccggccttttcttctggtgttttacctccctattttttgtaatacggtaatactgctatttataatttttcactttttgatgttatttattccttctaaggaagatagtgatttacttctcttatgccatacactctttccttctatgcatttttccagtgtatttatatcacaattataactttcttaaattatcttccaatatttacactattattactgtacagtgttcacagctaagccattagtatactataattgcatcctttcttttttttttttttttgagatggagtctcactctgttgcctaggctggagtgcagtggcgtgatctcggctcactgcaacctctgcctcccaggttcaagcagttctccggtctcagcctcccgagtcgctggaactacaggcacacaccaccacacttggctaattttttacatttttagtagagatggggtttcactgtgttagccaggatggtcttgatctcctgacctcgtgatccgcccaccttggcctcccaaagtgctgggattacaggcgtgagccaccacacctggcctcatttcctttctttatataaatttaaagacagaattttatggttctgacagagccatataacagaaccataaaattcatcacagtatggttaaacatcaaataatttaccatttccattcttttcttaaacataccctctaaactgcccttcatcctcctgtttgaattctaacttgttttcagctgtcatcctagtactgcattcagcattatgctgggcattgccattgcttctctcttgtgttggcatccattttcctgcattttacaccgcctggtttcctagtttatttcttcattttggtggagcacatcattcaggagcttcctaagaaaggatgctgagagataagttggttgagatcttgtatatctgaaaatatctattctaccatcatatgtaattgataatttggcaggatatatcattctagcttgaaaaatcattttccctcagatttggaaggtttatcttcagtgttgctagtctccagtgttgttgagcaacccaaagacattctttagtcctttgtgacctttttttttttttttccccttgtgatagattttaggaccttctctttttccccagtgttgtgaaattccacaggggtgtagcttgatatggatctttttcattcattgtgtggcatactctgtgggcattttcattcaggaaatgtgtgtccttcagttctgaaaattttttcttatttattttaatgtttctcttcctgctttctggaacttctattagtttgatgctggatcttctgagttgatcctctgattctcttatctttctcctattttttcattactttctctctttgttccacttcctgggagatttcagctttacctgccagattgtgaacaacttaaaaatttttctagcataattttaatatataagggctcttgttctttgaatgttactttgatatagatcttgtttgtctttcatagatgcagtctttccttttatatatctgagatattatgctgtctttgtgtgtctgtgaagttttttttccctttaattctctggttactcccaagtttcttcttgttttggtcacctttaatgtaatggctttcctcaaatgtctgttgtttttttattttaagttgtggtaaatatatgtaacatgtaatttatcattttaaccattttatctgtttcttttaaaatatttatttatttattttagagatgggatcttgctctgttgcccaggctggtctcaaactcttgggctcaagcaatactcctgtcttggcctcccagaatgttgagatcagaggcatgagccatcacactcagctgtttttaaccatttaaaaatgtttaaattctgtggcattaagtacattcatactgttgtgcaaccatcaccaccatccacctccagaactttttcattttccccagttgaaactctatacccattaaatactaacttctattccatccttccctcagcccttggccaacagcattctactttctgtctctacggatttgacactttagtagcctcatgtaggaagaatcataatacttgtctttttgtgactggcttatttcacttagcataatattttcaatgttcatccattttgaagctccatgtgagtgggcaggaacttgttaactggaggccttcactgagaagtgataaggtgatgaatacctgccaggtgcagtggctcacacctgtactccagcactttgggaggccaaggcaggaagatcatttgagcccaggaattcgagaccacccttggcaatatagtgagaccctgtgtctaccaaaaaaaaaaaaaaaaaaaaaaagatgaatatgtttttcattgggtaaccctagaatatctgtatttttagatgctttttagggtcctgtcagtttctgtggaaaaaatctcccaactcctgactgggggtatatgcttgacagctcattgtttaggtaaccagaaagggataggggaatctacctgtttggtaaacttttctttagttatgccgttttcaatatagggctcacccctattctcagcgagcttggtgttccctgagtccagagcctttcttttttctttctttttttttttacattctaaaacacagcactgagcatgctgtatctttcttttttttattattatactttaagttctagagtacatgtgcacaacgtgcagttttgttacatatgtatacatgtgccatgttggtgtgctgcacccatcaacttgtcatttacattaggtatatctcctaatgctatccctccaccattcccccacacacgacgggccctggtgtgtgatgttccccaccctgtgtccaagtattctcattgttcagttcccacctatgagtgagaacatgcagtgtttggtttttctgtccttgcgatagttcgctcagaatgatggtttatgtcctttgtagggacatggatgaagagtccagagcctttctgattgtttctctggactggtgagttgacaggcagcctttatctagggtggaggatgggtagttgcctggttgcttgggcaggtagggaggagaactaaggacttaactgctctttctatagattgtcagccaactcttctgtttctggccacatgactcaatcctcccttcagagatgcattgtgcttccagttcctggcctttccagagtacagtggtgtgaatcagattgctttttttttcttagacagtctcactttgttgcctaggctggagtgcaatggcacgatctcggctcactgtaacctctgcctcccggggtcaagcgagtctcctgcctcagccttccgagtagctgggattacaggtgcttgccaccactctcagctaatttttgtatttttagtagagacagggtttcaccgtgttggccaggctggtctcaaactccttacctcaggtgatccacctgcctcgacctcccaaagttcagggattacaagttggagtgcagtggctattcacatgtgcaatcatagcacactgtgggttcgaacttctggcttcaagcaatcctcccatctcagcctcccgagtagctgggggtataggtgcacaccactgcacctggcaccatttttgttgttaaaacatataaagaaaacatatacaatatacatacatacctacagtgttctctgctgttccccatccctattgtattcactattaacagtttgtgtactcttcatatgtttctatgcacacatatctatatgcacacatacacacacttaaaacatctatatgtctctatgtttcttcatatagctacatattaattaaaacggaattgaaaatatctttctgtattgctaatattttaaaacttgttaatataggccaggcgtgagtggcccatgcatataatcccagcactttgggaggccaaggcggaaggattacttgaggccaggagatcgagaccagcttgggcaacgtaatgagaccctgtctcacaattttgaaaaaaacccaaacttgtaatatagtttctaaaaatggaaagagaaatatttttcattgtctactaaatggaaataaaagtgctatatattttatggatactcatttcagaaggtatttgcttaggtgcacctaacttatcactcagcattgcagtgctcacctaatgcaagaactactttgtcaaggagttgaaaagataactaatgtatcctaatcagtttttccctcaagatagtccttttgaactacttaaaagcttaatgatttggaattattttacctttatttataatatcacaacctggaagatagatataaatctgcttatcttcatgcaattaggaggttattaggagataaatttttattcacatttgcccagtatattctacaatctacatgggagggtggggagcaactctcagagaaggtaaaacatttagatggaagattcagtttagtttgatagagctacatttgagtgtactcacaattttaggaacaatgaattatcttgaaatttatccttttggattataaagtccatatgtatggagactgtgtctatctaatctagttcattgttatgttcacagcttctggaacatgggaggtgttcaatacatatttgcctatgtatgtgtggagtgattatagatagtaggaatgtagaaataggccagtattgcattcagttcagatcttatgattgtgttcttttagcaactttatgtagcaactgcctttataataatttcattcttcttacatttctgtagttgagaacagcaagatacaaggaggcagccctctgtaatagatgtgaaatggtcattacatgtttgttggtggtagagctgtctgtgaactatcattatccataaatagcagcttcctcatgcagtctggtcagctcaactcatctcaatatagagctcctccagtgaagggatgtagaaaagtctccataacaccgtttgaaggtgattagagtgtaacccacctgctgatacaatgaagcacattggttcttgagccctgttggtcatgtactcaaatcactaaggactagatttgagaagcttagtgtttgaccttaaagtttcccttttgctgggtttctgttacaatttgctttttaccccattctgatgagtattatagttaggtatttctatgtgtcattctctctggatttgttcttttgagtgcagggaacaccttgtctttgtaacttttcatagctatagtgcagtgctttgtatagcacaagtttacactgttaattcttgtgttaagtgggtaagtagaagaattataaattttgctaagttatagttcaaactgtagctacttttataagtcacataaaatccttttcaaacaagatggttatttagctactttgaaaaaaagtatggattatagcaaatccacccccatctggtaatgtcagaagcctgatatttatttattttaaaacagctttattgagatataattcacatgccatgcagttcacccacattgtataactcagtgatttttagtatcttcacagagttgtacaaccatcatgatagccaattttggaatattttcattaccctgaaagaaatcctttatacattagcagtcactccctatttcccactttactccccagccctagccaaccattgatttactttccgtctctatagatttgcctattctggacaatgggattatataatatttggcctttcatgacaggcttctttcactcagcaaaatgttttcagattcgtccatgttgtaacatatcagtacctcattcctttctattgctgaataatctattgtatggatatatacctcattttatttatctattcgtctgttgatagatatttgggttgttttccatttttgggccattataaataaagctactatgaacattcatgtgcaagtttttgtgtagatacatgcttcttttttcttgggtatatgtaagagtgaaattgctgggcaactctgcatttaaccttttgaggaggttagactgttttccaagcagcagcatcattttacattcccaccagcagtctatgagtattccaatttctctacatcctcaccaacacttgttattatctgtcttttttattatagtcatcctagtgggtgtgaagtggtatttcactgtggttttgatgtgcatttctctgttggctgattatgttcagtatcttttcatgtgcttattggccacttgtttgtcttttggagaaatatatattcagatcctttccccatatttaattgggtcatttgtcttttattgaattgaaaggattcttttatgtatttagatacaagtacaaaaatatatttatagatacatttacaaacatttacaaaaatatattttatcatttctacttacaaaaacgttctcccatcctataggttgtctcttcactttcttggtgatgtcctttgaagtacagaagtttttaattttgatgcagttaatctatttttttcttgtttgttattttcagtgtcatatttaagaaaccattacctaatctaaagtcacaaagatttaagcctattttttcttgtaagaattttatagttttaggtcttgatatttaggtctttgatcaatttttagttaattttggtgtgaggcagggatccaacttcattctttttgcatgtggatatctgcttgttccagaacaatttgttaaaaagaatattctttctctcattgaattattttgacatccatgttgaaaatcagttgactaagggactttatttctttatttgtttatttttgagacaaaatctcactctgtctccaggctggagtgcagtggtgcaatctcggctcactgcaacctctgcctcccgggttctagcaattctcctgcttcagcctcccgagtagctgggattacaggtgtgcaccaccacgcccagctaatatttgtatttttagtagagatggggtttaatcatgttggccaggctggtctcaaactcctgacctcgaactcctgacctcagctgatctgtccgcctccacctctcaaagtgctgggattacaggtgtgagccaccgtacccggccaactaagggacttctctttggggggaaatattcacattgttctccttcccccaaagattgcttacaattttttggttaaattaagaaaaaagaaacaatctcaaaaaagttacaagtacagttcaaagaacataattttttttgaatcatttgaaagtagattgtcaacgtgatgccatatgatgaccatgttgtgtgtatttcccacaaacaagaacattttcctacagaagcacaatataaccatcaaaatcagaaaactaacactgctgtactactactatgtcatactcagatcccattcaagttttgcccattgtcgcagtgttgtccttaatagcaaaaaatatccagtccagaattacacattgcatttaattgtcaggattctttagtcttcttcaatctgaaacatttcctcagtctttccttgaccctcatgacctgtacattgttgaagattacaggtaagttattttgtagaatacccctcaatcatggtttgtctgatgtttctttatgattagattcagtttatacatatttggcaggaatgtcacagaagtgatgttacatcctttttagtgcattgtattggggcccacagttttgccattatttctaatattaaccttgattcttgattaaggtggtatttgccaggctttttcactattattgtttttccttttgcagttaggattttgtgggacagtatattgagataacagtaatcttggtcctcatcgatctttgtttcttttatttatttatttatttatttatatctgcatgaacacatatattcctattttgtttaatgagttatatttctttactattattatttgtattgatatgccagctgttccagatttggtcagtgagagccccttccagttcgctgttttgttcttttaacatagcctctcccattctttgagcacttccttcctttttggcacatgatgatgttcaggctcatttggtacttgctctattctgtccctggaatcagcaatttcttcaaagagccctggttccttttagtagagaatggtattagaaagcaaggtctaggtgctcagtgtacatattggggtgttgttgcccccaggacctctcagggcagcagtccccaacctttctggcaccagggaccagtttcattgctggggtggggttaggctgggggtattggtttcaggatgaaactataccacctcagatcatcaggcattagttagattttcataaggatcacacaacctcgatccctcacatgtgcagttcacagtagggtttgtgcttctatgagaatctaatgccgaagctcaggcagtaatgttcacttgcccactgctcacttcctgctgtgtggcgcttttcctaacaggccgtggaccagtgccagtccgcaccccgggggttagggaatctctgtctcgggacagagctagggaatatatgtattctgtgtatagacatttacatatttatgtttatatacgttgaaattcatgagttgatatctgtagctctaattctagtccaagacaagggggttcattctattacagttgagcaaattattaataacatacccatcatttcatagttacccttttttttggtagtaagaatacctaaaatttactcacttggcagattaccagtatataatacaatgttattaactataatcctcatgttgtacattggtcacttagtggcttttggactgagttgtttggaaaaggggttgcatgttgtcttttgagagatgtgaatgaagttttacagacttagaagtcaatgtttcataagaaggaaaaaaacaaatatcttgacgttttcactttttaggcaatcaaaaggattccttctgttgctaacatttaacataaaataatactcaatttgattgataattattagaatcttaacataccttggttagtgagctgctcctgaggaaattagaaaacagtaaataatttacatctacagagtaatattcatttctcttctagctcttccaccaaagccacctaagccaatgacttcagcagttccaaatggaatgaaggacagttctgtttctcttcaggatgcagaatggtactggggggatatttcaaggtaactagaatgctactgtaattgaatgcagttttttaaaaagtcatttttgagaattagtagttaaagtaaaccattttaagctgggcatggtggctcatgcctgtaatcccagcaactcaggaggctgaggctgaagaatcacatgataccaggagttcgaggctgtagagagcactctgttgcactccagcctgggcaacagagtaagacccccaactctcaaaaaaaaagagcattgtaatgctctactaattgttatttaaagattaccatttaaggccgggtgcagtggctcacacctgtaagccatgcactttgggaggctgaggtgggtggattgcccgagctcaggagtttgagaccagcctgggcaacacagtgaaaccctgtctctactaaaatacaaaaaattagctgggcatgttggcatgcgcctgtaatcccagctacttgggaggctgaggcaggagaattgctacaacctgggaggcggaggttgcagtgagccgagatagtgccactgcactccagcctgggcgacagagtgagactctgtctcttaaaaaaaaaaaaagaaaagaaaaagctcacttaaaaaattttgcatgggaacgcttcattagtgtcttaatacttttcttcccatgaaaaagtgacaagaaaatcttcattatttatttgttttgagatggagtctcactctgttgcccaggctggagtgcagtggcatgatctcagcttactgcaacctccgcctcttgggttcaagcgattctcctgcctcagcctcccaagtagctgggattacagtcatgcatcaccataccctgctagtttttgtatttttagtagagacagggtttcaccatgttggctaggctggtctcgaactcctgacctcaggtgatccacctaccttggcctcccaaagtgctgggattacaggtgtaagccactgcacctggctgaaaatctttaaattatgggtgtgattattacttctaatactatattgaggatggatttctaaataagtgacatgtagacatttaggatagttacatgtgttttagaattaaaaatatttgtgggtacttaacatttctgtacctttctttctcttaagccagtggttccaaagtctttgcatgcacaaaaatcaattgaggtggagcccaggaatctgcatttaatagattccctgggtgaatttgatgcagtctctttacacaccccagtttgataaacaggactctaggacagatttgttttctgggtaaagtgtagttttaggtaattttgaacctaaagagggaattatatacatttaatttgaatattgtattttcttactaaatttttttcttgttaaacttgctttagtgggtctcagatgtattttctttttaaagccctatccatttctgtcaaatcagtttccaggttgatgctgtattcctcagaacacttacctatccctttctcttctctgttctcttcctctaccaaaatggtatttatttaattttttttacccttacaatttcaactattttaagagtacatttgcattgttgtgcagctatcatcaccatccatctccagaactttttcattttccctaacagaaattctgtacccattaaacaataaccccccattctcccctccctcagctcatggcaaccaccattctgctttctgtcttatgaattcaattgtaggtactttgcataagtgtaatcatataataattgtacttttgtgactggcttatttcactttcttcatacgtcttcaaggttcattcatgttgtagcatgtgtcagaatttcattccttcttaaggctaatatatgtatatgttatatatttttttaatccattcatctggacatttagattgtttctaatttatggctgttgtaaataatgctgcaattaatattggtgcacacatatctgagtccctgctttcagttattttgggtatatacccagtagtggaatggaattgccaggtcatatggtaggtaattctgtgtttaactttttgaagaggacttaatatgttttattaaaaaatttttttttttgagatagagtctcgttcagtcccccaggctggcgtgcagtggtgcagtctcagcccactgcaacctccgcctcccaggttcaagtgattcccctgtctcagcctcccaagtagctgggattacaggcgcttgccctgccaccacgtccggctaattttgtatttttagtagagacagggtttcatcatgttggccaggttggtctcgaacccgtgacctcaagtgacctctctgcttcagcctcctaaagtgctgggattataggcgtgagccactgcacccagccattttattttaaaattggttagaatatttctattttaatattgtacaataaaagtctttttttaaattttaagatcatgtggttctgatatgattcaagggtcttttatgccctgccatttcctttaagtgttctagtgttgtgccttaaagtcctaaatcaactctacagaaggaatttgttatcgggacaaattcaaactaggagactatcctattgaaaggttatgaacttagtgaattttcccccttctgttcagaaacagctgccactgttgcttaaatataaccttctttctaaacagccactgtttttttcctgaaactttacaagttcagacctgcctaaggaaacccttaaaggcttgatggaaacagtatctcttacacacatttgaaatctggaagagtttaaaaatcaaatagctcttctgtagattgcgtaacaccaaaaatcaaaacagaaagagcatatttaatgcagggaagaactaaatgacctctaaatggctccgttattctataacctcaggcacacctactgccgaagctgccttagtagtaacatgtaaagaaggcacacctactgccgaagccaccagtgttgacattttttcatttttcttataattctgttcttcagggaggaggtaaatgacaaattgcgggatatgccagatgggaccttcttggtccgagatgcctcaacaaaaatgcagggagattatactttgactttgcggtaagtacttttcagtcttttggctagttctctactgatgttattttagttctgggtatacagatatttctgtatttaaatctttatctatacaatttttcatattttcatttaatttatgtacataatttccagtctggctaattcttttttctatacattaagtatttaaacattttgtataaaaatggcaacttaaaaaaatgtagaaagaaaatgaaaaggttaaaatcccaaaatgtaagggagtaggaagcatactgttgaccttataaaggaagtagaagtcatgggcatattctaagggtaaaaatgaatctatcctttgaataaccctattatcttccttaatgcagactttagaaagcagaactcaacataattttggttgatgaggatatgctgaagataaagcagttcctagcgtatatcatgcttttcatatgggcatatttagagtcttttaagtgatggatatatgattttttaatatttgcacatatttttaaaaggttaagaaaactgcatgagaaatttccacatttaattttaataattaaagtagcccagttacaataaagccttatgattttttttaaaaaggaaatatttaacaaaaagaaaataacagtaacaataacaatgactaactttcttgtactaaggcctttacatgcaatagatcatttattcttcacaacaaccttatgaggtaggtattattactattcccattttatagatgaggtaactaagggttaacatggttaaggaacttgcctaaagtcacatagttagaaagtggtagaggaagagtttaaatccagattcatctggctgtttgctgcctttccagcctaatatctttaggaaaaataatgcctcattttatgctagtatggcataaatttggaggcactattttagtttctggtaaagagctaaagaaattaatacctttgcacttgaattgtgctgactaatcagtgttctacagtaattcattgaacacaatttttcctctactccactcaggcttctgtctccaccactccacggagactgctaaacacttttctcttcttaccttacttgacctcttagcagcattggtcatagacacttcttcttagaagcagtttattgttttggctgttaagacgtcacactttcctgattttcttcctaactttaagctattttgctcaatatctaaattttaagtgttccagggcttgggacctgggcctctttttcttctctgtattcattctcttaaggtgagcttgtcctgtcccatggccttaatatatgtgatgattaatttaagtgtcaatttggctggattacctagagaactggtaaagcattattttggatgtgtctgtgagggtgtttccagagcagattagcatttgagtcagtggactgagtaaggaagatcgcccctcagtgtgagcaccatccaattggctgaggatagaacaaaaagaaagaaaaaaattttatctctctgtcttggagctggagcacactcttattctgtccttggaaatcagaactccagcctttggactccaggacttataccaatcctcctcaccccctatgggttctcaaggccttcaatcttggactgagagttataccattggcttcctgggttctgaggctttaggaattggactgagccacactactggcatgccagcttgcagatggcctgtaatgggacttctcagcctccataaacatgtgagccaattcccctgataaatcccctcatatttatctttgtctctctcctattggttctgtctctctggagaactctgattaacacagatttggtaccaggaatgattctagaggaaggtaattttttttttttttaacacaggttattgctctgtctcctaggctggagtgcagtggcatggtcatggctcactgcaaccttaacctcccaggcctaagtgatcctcctacctcagcctcctgggtagctgggaccaaaggcgcatgccaccacacccagctagtttttgtgttttttattttttgtagagatggagtctccctgtgttgcccaggctggtctcaaaactcctgggctcaagcagtcctcctgcctcgaccttccagtgctgggattacaggcgtgagccactgtgcccagcctgaggaagagaattttaaggatgagtttccttaattaattttggggttcccggaattggctctcttaatttgatgagacttaaaaatgctaaggaccctacttctaatagtacagagagcactgacagtccatgctgtgaactgtttatatagcgatatgctaaatatctgcatttgatacttctaatttaccacctataagaggcaaggaacttggcaaccctgtatttgatactgtcaaacgtttgtagaaaaccaaggttttctaatattgctggacgaagtgatgaaagaaaagggtgagctcagggttttgatttcctggccccagctctgccataaatagcccaagaacttctaaatatgccctaagtcagaatcttctcttctgttgccaaaggtctgaaattgcacaaaatcaaacacatactctcatcatgtgattagctgaattacaatcaaaggtgaaatatcagccttgtaaggtatctgctgttaaaatgagggcattggttgggaaagatggaattctatacgtttggatggggatgtgtgggaagaccctgatgaggctggggacgttgagctcctaaattctgatgagtcttgtttgccagcagaaatggcctcccacccccagtaacagcatcccccctacactggcctttccacctttgtctgaggggattgactctgcattgcctgaggaaaccataatggccttcctctaggcagctgctaagccagaggatgctgagtcttctcaggacccacccccaccacacctctttgcttctagacctatagctagacttgagtcccagcagcccctaaagatgaggtacaaagttttactcatgaggagatgtgctacatggtaaaaaagctacttgaggtttctaatttatacaaggagaaatctggaaaatatgtatgggaatagatatttagggtgtatttagggtgtgagataatggtggaaggaacataaagttgagtcaggctgaatttattgtttttttttttttttttttttttttttttgacggagtctagctctgtcgcccaggctggagtgcagtggctgatcttggctcactgcaagctccgcctcccaggttcccaccattctcctgcctcagcctgctgagtagctgggactacaggcgcccgccaccacgcccagctaattttttatatttttagtagaggcggggtttcacctgtgttagccaggatgatctcgatctcctgacctcgtgatccgcccgcctcggcctcccaaagtgctgggattacaggcatgagccaccgcacccagctgaatttgtttttggcccaccaaacacattctgcatttaatattgtggctcagggagttagaaaaggcaacagttggccggtcatggtggctcactcctgtaatcccagcactttgggaggccaggcaggcggatcatgagatcaggagttagagaccagcctggccaacatggtgaaaccccgtctctactaaaaatactaaaaaaaaaaaaaaaaaaaattaactgaatgtggtggcatgcgcctatggtcccagctacttgggaggctgaggcagaggaatcgcttgaacctgggaggtggaggttgcagtgagccaagatcgcgccactgcactccggcctgggtgacagagcaagactccatctcaaagaaaaaagaaaggcaacggtttatttggttagttggctgaaacatggatgaaaagatggcctactgtgagccagctggaagtgtctgatctaccttggttaacacagaggaagagattcaaaggcttaggcaggagactgggttgctacagtggatttgtcacttaaaatctacttatttacactgggtgagtccagatcacatacttttcagcagtactttgagaaacagatttgtgaggagaaccccatcatccctaaatgccatgattgcccttctctgtaggccggaccttaaaatggaaactgcagtcactcaattgaaaaatttaaatgcaatgggaataactggattccagggtagcagaggccaagtgaagggactcatttgacaaaggcaaggtggacatggttatcataacagacagcagaagcaaagcaacagtcagaatagtctgactcatgtagacctgtggcattgactaattcactgtatgggcagctcactgtctattttcttctcccttcccacctagtctgtcttggcctactacaatttaaattatctgaggttggggattttgtttaatgattgctgtatctccagtgtctagattagtgcctgatactgggtaagcattagagaatggatgcctaatatatatatatatatatttatttatatttgtatttttgagacagggtctctctctgtcactcaggctagagtacagtgatgtgatcatagctcactgaagccttgaggctcctgcctcagcctcccgagtggctgagactacaggggtgtgccaccatgcctggtggctaattttgtaaaaatttctttgtagagatgaggtctcactatgttgcccaggctggtctcacgctaagggtctcaagtgatcctcccaccttggcctccccagtcctgggattacaggcatgagccaccatgcccagcttataaatacttatttaataggtgaatatgcttcttatttatctggaaaatggttttaatcccacactaagttgtggaatttcattccttttaaggctgaataatagtctgctatatgtatatactacattttgtttatccatttatcacttgatagcattagcaagaatgtttgaaagttttcatgtatctatcacaaggtctgacatacagtaggtgtttgataggtgttgagtaaatgtttgaatgaaagaattaatgagagaaagacagagagaaagtttctcgcaggaaatgacagttgagctaggccttgatagatttttgcaaggcagaagagtgatgatcttaattcaatttaataaatagttgcaacttagtgctaattactctgcagggtatctaacaatgagttaaaacttttgtctctgggaatgtataatctagtgaggacaaagggaatgagaaaatggctttgagtgaaagtttaatagcaggagagtttcacaaaatatgctttggtgactgaaaggaggaaaagagatatctttgttaagagaatgtagaaaactgaccttcacagaagagattacatttgcagaatatcttgaaggggataggtttggacatgtagaaagtgggaggggagtagcaggaatagataacaataggagcaaatatacggaggtgagattttatagctgctttctgtgagatgtagtcctgtttggctaaaagataaagtttgtgaagaagaagtggtaggggataggaggtaggaaaggggtcatgtttaagagggccttgaattccaaaacttgggagtttgtatttaatgtatttaatgttgtaggtaggtggggagaaccactgcattttttcggcagggaaattgtgatcaggcgcgcgctctctctctctctctctctctctctatatatatatatatatatttttttttttttttttttttttttttttggagacagagtcttgctctgttgctcaggctagagtgtaatggcgcgcaatcttggctcattgcaacctccgcctcccaggttcaagtgattctcctgcctcagcctcctgagtctgggattacagtcgtgtgccaccacgcccagctaatttttgtatttttggtagaggcagggtttcaccatgttggccaggttggtcttgaactcctgacctcaggtgatctgcccgcctcggcctcccaaaatgctgggattataggcgtgagctaccgcggggatagatgttgacttctagctgctccagaaccgcaaggtaaaaatgtatctaggatatagctagaaatttaggtttaatgcttaggagagagtacaggaccagagaaagagtcaagctaccatatgcataaatgggatttttatggaaaaaaatatataaaatttaaaaggtggaggctgaaggcaaaatttttttttagggaataactagggttggaggagacaggaagagtggtttgagaggttgaaagaaaataataatttcatcaaagttatggaaggatgaaatattaagaagggagagagtgagggagaaggagggcctgggataaaggaaggggacagagtctgaatttgttcaaagtcattggtgactcttaaatgagaggaatgagagtaaaaccagactgcagagagtagtaggtagtgaagaaatagagatttttcagttcaatagctcttattttttaaattggtaaatagtatttgttgtagaaaatctggatacttaacaaatctttaagaatctgctatctgccaggcattggactaggtgctgagatacaaggaggactagcatgaccttcagttcctttccttctctcatctctgcttagagtccatgtacattattattaaaattacccatgtgaatatatccttaacaaacttgctcctctcttcctccagtgtagtcaccagactaaattccaacacggtattaaattcagttctccacttagtccttccctatacttgagctgctgaatgtggagaaggggacgtgaccacatggactggtttcacattaattatgaccactaaccttaagtgacctttaaaactgcccagcttaacttctgcatttccacaatgcattcatcctgcttcctcgtcagtttcgtaaatgacaatttcacatgttctttttttctcttttaaaggacagcctttcttcccacttttaactatagaacttgcttttaatttcactgatatatggacacagtcagacgagaactccttcatgctcctattaccacagctatcaacatatttacacattaatgtgaatagtctgccgcttttctgttccagtggatgactgttcatgtccttgtccagggtctgcttctctgtttgtagactggatcccatcccatccctctaatctactcaaggacatcactctaggaataatcttgtcctctttgttggatcaacaatttttgtctattgagtcattcccatcagcatataaatatactctattatctcccatttaagaatagtaaataattgaccctatatctctttctagatacttccctatttctctgcccttatttatagcagtgttcctcgagacacttgtctatgggcatttctatcttctttcattttcttgaatccattccagtcagggttctatccttaccatttcactgaaaccatttagtcagttcatttagtgctatctactttgccaaacctaattatcattggacttggttgataatttcctctttgttgaagtgcttttgtacgtattggtttttaggatatcacactcttagttctcctctcacttcattaattgctcccttttggtttcctttgctgattcttccttccatgtctctgaccaccaaacattggcataccccagtgcttaggccttggacctctttttctgtccagctatgctcaccatcaaataacatacatcggctggtaactcctgaatttctatctttagcccagacctttctcctgaactttagattctttaagtagcctgctggatcatctgcttttgaatgtttaggaggcatctcaaacttaaagtgtctaaaaccaaactttttccccctttaaacatattcttttttttttttttgagatggcatcttactctgtacccctggctggagtgcagtggcgtgatctcggctcactgcaacctctgcctcctggattcaagcaattcttctgcctcaggctcctgaatagctgggattacaggtgccctccaccacgccaggctaatttttgtattttagtagagacggggtttcactacattggtcaggctggtctcgaactcctgatttcaagtgatctgcctgccttggcctcccaaagtgctgggattacaggcgtgagccaccgtgcctggtctaaacacattctttttaaatagccttcttcatgtcaataaatgacaattccattcttctgattgcttatgacaaaaaccttgaaatcatctttatcttgtctctctgtcatatttgtatccaagccatcagcaaatcctgtcagctctatcttcaaaatatgttaagaatctcactatttctcatgacctctactactgctaccctcatccaagacaccatcatgccttgcctagattattataaaagtttcacaagtgatctttccacttctactgctgcctcctttgaacagtcttttctcaactcagcagctagagtgaatcttttaagccacaagatagattatatgattctactgaaaacccttttgtgcctccccttctcactcagtaaaagctaaagcccttacagtaacctacagactgttattacataatctaagctccttttacatgtcttacctagtctcctattactctcccttttggtcattcaggcccagcatcactggccttcttgctgttcctcgaacatgccaagcatgcccttaccgcacctctctctaggaaacttcccgtacatatctgctgtactagctccctcacttcacttagaactctgttcaaatgtcacctgaacagagaggttttccttgagcagtacaaacaattcctccatcacaagaactcctttccctttactctgctttattttttttcccaacagacttattactatttggtatatttagttgtttatttttgtgttctatcttgagaagtttgttatcttccttaataaactgaaagacagagatatgttccttatgctgttaaactggaagctccatgagagcatggactgtgtctggcttgtttatcatatatctgtagtgcattgtgtaattcctggcacatagatattcagcacataattttaaatgaatgaatgtcttttaactttaacagagaggccagcttgcaattattgtatgtgtgagtgtacacatttatagtaactgtatatgattagatggtccttctcatgtatatttaatagaaataatttatcatccatctaaaaactgacctaaacattgtttaaatcagcttatagggtcaatcttactgtgtttgaccttttacaaaaaggtcatttatataaaatggtcatttatgtaaatgctatttatataaaatggcatggcataaagagagttaggggcataagcctgcgtgctgctgtaagaatggttgaatgggaatggtacagcattttgctatgaatcaacctgctgtggttttagattatgccttatgggacttgcaaaacattgctattttaaactttagttataaattatcttttaagggtccatttagatatgactcagtaaacaaaggtggcctgaactgtccaagcatgaaattacattcatctaatatacatagctcttcaaaagctatactttgtaaaacagttgaatgacttgaatcatttacatgttgtgattgcctgaacagtcatttctgagaattataagcaagtgtaaaagacaaaatagtataaggttctagattaattatgcagctataaatcatagattaaggagctcagttatgtttgtgcattaacaacaaaaccttgagtatgttggtgattgtgtgacaaatgtttatcattcccttcatatagagatggcttctgctccccccacagagacatacaaccacatatctttaggtccttaagagattttttctgttcttcctgataaaaatattgatagaatttaaatttgaaaattcattcagaatataaacaaaaatagaatttacttctgttttatttttcttaagtgattttttttgctacatttgttcatactgaatgctgtgtagatatgttgacctttaataaccaaagtattttatggacaaaacaatgcaaaatgaattatatatatatatatatatatatatatatatgttcacacacagaataacatgccttttcactccttccagcctcattaacatagtaaaacttgtttatcatgtgacaccaagctttcacgtctccatatgaaagcagtagttcagttgaatttgggggaaaaaaatccacagttgttgtcttgttgttcacaggaagggaggcaataataagttaataaagatctatcaccgggatggtaaatatggcttttctgatcctctgacatttaattccgtggtggagctcattaaccactatcaccatgaatctcttgctcagtacaatcccaaacttgatgtgaagctgatgtacccagtgtccagataccaacaggtatgattatggaaatccttgctagctattgagcaagtgattatttaacagccttatttgattttatttaccaggcttatcagttttaaaaaactagccattttgttatttatttatttactttgagacagggtctctgttgcccaggctggattgcagtggcatgaatatggctcactgcagtcttgaccttctgggctcaagtggtcctcctgcctcagcctccccggtagctgggatcacaggtgcatgccacaacttcagggtcttgccatgttgcccaggctagtcttgaactcctgggctcaagcagtcatctcactttgaccacccaaagtgttgggattataggcatgagtcattgcgcctagtgcatacttaagattttagatatttttggaacttattttgtggctacccttctgtaatatcttattgcatgtacttgttacctttatataaaaatacttatgtttatgtctcccacttcatttcttaatttttaaagtattaatcattttgatgtgacttaaaggctgatcttaatattatcaaaggatttggtacatttgtgtgcttgatattaatacagtggcttaaagttgtacagttgaaatatagtttaatagatggttgaggtgatattttcctttaaaaaatagatgtggaaaatctatttccacatatgtcagaattgttaacattctttatttttttctttacctgtataggatcagttggtaaaagaagataatattgatgcagtaggtaaaaaactgcaagaataccactctcagtatcaggagaagagtaaagagtatgataggctgtatgaagaatatactagaacatcccaggttggtatattatgttgtttttgactaatatgtgtgcaatgttttagttacatcaaattttcgatcattcacttgatgatctttagctgttttaatgtcttaaaggcttaaacagcctttttgaaactttaatgatataaattcccctcccttcttaattggttaaggatataatttgtatcagttaatattaactggtcacaagtgacaaaataaaaccaaaggcttcagatagaaatttagttttctttcatgtgtatataggcactacaggggtgttagggtaactccaccatcctcagaacttatagacattttctgtcttgatgctttgctatctgtggaagagggcttactctaatatcagccatcacaaccatattctagtaaacaggaagtaagaataggaaggagaaaggaaggttctctatctttaagacaacttcctagaaggagcacactctgctttcacttttatcccactggctagaactaagtcacatgggcatacctagctacaggtcacagctagctgtaggggaggctgagaaatctagtttttatttggtcaggtgtgttcagctaatgtggggatttactgaggaagaaggagctgatggatggaaattgtgggcttactagtagacttagttagctacacagtttttagatcattaactttaatagccagtaatacttttcatatttatgatatagagcaaaattctgttgaataatctagtttctttcctaggacttcttaggcctgactactttttagattgttttttagctagacttggattggtttaatttgccctaagttgttacatagtttgtcaaaagtgtttggaattttgatgaaggtgaatatcttcagagaagtttaccttttataatatttgggtagaagtggcttaggaaaatatatttaactgtatttctcatgtacattgtcttggaacacaggttattattttgaatatcaaatgatttatagaagcattagtctatgttgattcgacttaattcctagtgaattcttagtgcaacaataacttaccttgggctctttctagtagataacaataatggatttttttagtgtttactttctgtttcatgaatttctgctctttctaatttttttctgcttgctttcagtttaattttctcttttcctagcttcttaaggtggaaattttgttcattggtttaaaaactttctcttttctaaaataagcatttaaagcaatacattttcctttaagcactgtgtatatgcatctcacaaattttatcatactgttttccttattattcagtttttaatattttctattttttgtgatttcttcttttgccccttgtgtttttaatttctaaatatttgggactttcaaatatttatttctaatttaaattagttttgttgttagtaaatatattcattaaagttatattcttttgacatttattgacctaaattttattttattattgatatttttatgagacagaatcttgctctgtcgcccaggctggagtgaagtggcaccatctcagctcactgcaacctccgcctcccgggttcaagcaattctcctgcctcagcctcccgaatagctgggattacaggcgtgcaccaccatgcccggcaaattgttgtatttttagtagagacaggggttcatcatgttggccaggctggtatcaaactcctgacctcaggtgatccgcccatctcggcctcccaaagtgctgggattacaggcgtgagccaccgtgcctggccagctctttttttatttttattttttattttacttacttatttttttgagacagagtctcactctattgcccaggctggagtgtagtggcatgatctcggctcactgtgacctccatctcccagattcaagtgattctcttgcctcagcctcctgagtagctgggattacaggcatccaccaccatatctggctaatttttgtatttttagtagagatgggatttcgccatgttggtcaggctggtcttgaacccctgacttgaagtgatcgacccgactcagcctcccaaagtgttgggattacaggcgtaagccaccggtgcccagccataaacaactctttaagaagcttatctgtgatttgaagagagttttggaataagaatgcttttttttcaaagtgttgttaccagagcttgtttatatgctgctaagaaggaaccattagactgggagagttaatgatgtaaaaggggttagctgatacgatagagtgaagtacccagaaaggaaggggagctgagacccagagcacatgtaaataaagggaggggaaggaagagaggaggtgaacaggtaggtttatagttttggtggcaggtgtagtggtatagtggcattgttgatgggggaggtgctgacttagtagtgatatcaaatacttttccctttgctgttctacttaccaatatatctaccagtgttaataaagtctaaattattagtgttttctttgaagatccagggccagaactttataggtaatttctaacttggcaagggagctaaagctctccactataatttaagagttgtagaattagtaccaagatatttggcatatgggaattctagttactttttagtattaagatacatatgatgtaatcttaactgtatggactatcacaaggttccagcctccctcatctgctaatcctctaatgttctagccctactgggcaattactaatccttgaacatgccttgttattttatgtatacattataccatgcctcctttgtgcagtgctgtattttcttcctctatctcagttctttaagacctagcttaagtgtcacctcctctgtgaagtctctgtaaagcaataaataactagttaataaataactggttgcctcttccatgacatgaaaccaaaccttattagagttcagaaatctgttccacctgtatattctgagtcctggagggcagacttcacgtttcacaaatctctatcaccagatggtaatttctgtatagtggattctcagtaatcaattgccgaaagtgacaaatgcttaagctgggtgtgtggtgccctcctaaagtctcaactagttgggaagctgaggtggaatgatcccttaagcccaggatttcaagtccagcttaggcaacagttttaaaaaaaccaatccacccacccacccaccaaccaaaactgaaaccgaaaccgaaaccaaagccaaaaccaaaaccaaacaccccagcctagtaagtgctagataatgtaggaattatcccataaacatcaaaacttctagaattgtaaacattcaggacagcagtttttctagacccttatgcatatttattgcctttctaaaaagcaaactgaacaaaatttaacctgaagatttttggggaattgtgattcagatgcctttttgtttttgtttttttgagacaaagtcttgccctgtcgcccaggctggagtgcagtggcacaatttcagctcactgcaacctctgccttccgggttcaagcaattctcctgcctcggcctcctgagtagctgggattacaggcgcccgccaccacgcctggctaatttttgtatttttagtagagacggggttttgccatgttggccaggctgtcttgaactcctgacctcaagtgatctgcctgcctcggcctcccaaagtgctgagatcacaggtgtaagccaccacgcctggcctattttatagtttaaatgatgtattttacatacaagtaatagagtaggggttgaataaaagctcttgttttagtcctcctaaacaaggagaagacttttgaaagactaggtgttatatgggattacattaataactggaattacaaaatttgtttaagaccaaggttagaagaaaataataaagataatgaagcctgtgttttttctttttctctcctgtaggaaatacagatgaagaggactgcaatagaagcttttaatgaaacaattaaaatatttgaagagcagtgtcacacacaagaacaacatagcaaagaatatattgagcgatttcgcagagaggggaatgaaaaggagattgaacggtaagtctacttagtacctccaagggcatcagtgagacaggatttcttttcttccccaataatttctgtcttgttttcttttaccccctcaaactgcacagccctactattggaaccacttgctgtttccactaatggcaccaaattgaacttcctctctcctctgctctttgttcattctcccaaacggataaactcctgcttatccgttaggacttcaggttagatatcatcttttctagaaactgttccctgattccggagaccaatttaggggctgtattttgggtccctacagtgcctggtcctgatccctagtgtaacatttactgaatgccacgcccactcaactgtaaactcattgagagtaggcatggtggcttattttccctggtagccctagtacctacttatgtatgggagtacataatgggtgctcatcgaatatttttttgaattgaatatcaactttggcagcagtctgagaataaattgtagtagaacaagactgtaggcaggaacaccagcctgacttgcacatgactgcaacagttgtggtcatcaggttaaacgataatgagggcctggactagagaaatagcagaaaagaagcgggaggtcatgggaatgctaaggacttcatgcctgaccagatatggtaggtgtgggagaagtcaaagattattcctagatttctggtgtgagagactggaagatggtgtttttcaccaaaataagaagtacatgaggagagtttagggttggaaccagtgagtttgaggttcctgtgagaacacaaatggagctcactagggggcaggcagctgattatttggatttggaacttggtatagaaaggatttgggaggcataggtgtgtagttgatggtagatgctaagaatgaaattacacagaaaggatgtggcaggagaagtaatggatttgataactaaaaggatattgaaatcctatcaaagcaaatttagtggagtattggaagactaagctagattatagtgggttgagtgctaaagtggataataaatacaagtaattaatatgcaatggaaaagcaaaattatttctcatattaggaccacagtattagtgtatttctgtgtgcatgagtttagagctaagcactgtgaggcagtgtagcttaatggttaaagtgctgtgagacagtgtagcttaatggcatgagtttagagctaagtgctgtgaggcagtgtagcttaaatggttaaaactatgggcttgaattctgaattagccatttattagctgtataaacttgggtgaattacttaacttttctcagtctgttttctcttccataaactgaataatatcttgttggaatgctagagaattaagtaatatatatcctggcacatgatgtgctttcagtaaatgataattatttatttatttatttatttgagacggagtctctgttgcccaggctggagtgcagtggtgccatcttggctcactgcaacctctgtctcctgggttcaagcgattcttgtatctcagcctcctgagtcgctgggattacaggcaccccccaccatgcccggctaatttttggtactttttagtagagatggggttttgccaaattggccaggctggccttgaactgctgacctcaggtgatccacctgccttggcctcccaaagtgctgggattacaggcttgagctactgcgcctggcctaattataattattattaacgatgaagaaacagaaaaggatttgtagttttgttgcagagggaagtaaagtagcatgataacgttttgttttatttatttatttttgagacggagtctcgctctgttgcccacgctggagtgcagtggtgcgatttcggctcactgcaccctccgcctcctgggttcaagtgattatcctgcctcagcctcccaagtagctgggattataggtgcatgccaccacacccggctgatttttgtatttttagtagagatagggtttcatcaagttggccaggctggtcctgagctcctgaccccaggtgatctgcccgccttggcctcccaaagtgctgggattacaggcatgagccaccgcgcccagcctatttttaattttttttattttttgaggtagggttttgctctgttgcccaggctggaatgaagtggcatgatcatggctcactgcagcctcaacctcctgggctcacgggatccacttgcctcagcctcccgagttgctaggactacaggcaagtgccactgcattggctaatttttaaaaatctttttgtagagatggggtcctgaactcctggactcaagcaatcctccccgctcagcttcccaaagtgctgggattacaggtgtgtgtccagcatatgaagttttaatagtaatataaagccacatattgagtgacaagggaataatgtagacagtcattaccataagggttcagagtatagcaaaacgttgtgtgttggaaaagcttatagctgtcatctgttgcgtgcttaccaagataatgtcagggaatgtttttgtcctttacatgtattgtcacatttaattaacagaaaaacccagtgaagtaagtactgttgtaggtacccatttgtattagtccattttcatgctgctgataaagacatacctgagactggggtagtttacagaaagaagagatttaattggacttacagttccacgtgactagggaagcctcacaatcatggtggaagggaaggaagagcaaatcacgtcttacatggatggcagcaggcaaagagagaatgaggaagatgcaaaagcagaaatccctgataaaaccatcagatctcgtgaaacttactcactacaatgagaacagtagtggggaaaccgcctccatgattcagttgtttcaccttggtccctcccacagcatgtgggaattatgggagtacaattcaagaggagattcgggtggggacacagccaaaccatattattctgcccctggcccctcccaaatcctttatctttacatttcagaaccaatcatgcattcccaacagtcccccaaagtcttaactcatttcagcattaactcaaaagtccacagtccaaagtctcatctgagacaaggcaagtctcttctgcctataagcctgtaaaatcaaaagcaagctagttatttcctagatacagtgggggtacagacattgggtaaatacacctgttccaaatggaagaaattggccagaacaaaggggctacagggtccatgcaagtctgaaatccagcaggacagtcaaatcttaaagctccaaaatggtctcctttgactccatgtctcacatccaggacatgctgatgcaagagatgggttcccatggtctggggcagctccgcccctgtggctttgcagggtacagcctccctcctggctgctttcacagggtggccttgagtgtctgcggcttttccaggcacacggtgtaagctgtcaatgaatctacaattctggggtctggaggacagtggccttcttctcacagtgccactaggcggtgccccagtaggaactctgtgtggcggcttcgaccccgcatttcccttccacactgccccagcagaggttctccatgagagccccgcccctgcagcaaacttctgcctgggcatccaggtgtttccatacgtctgaaatctaggtggaggttcccaattcttgacttctgtgcacctgcaggctcaatgccacatggaagctgccaagacttggggcttgtaccatctgaatccatggcctgagccctatgttggcccctttcagccatggctggagtggctaggacgcagggcaccaagtctctaggctgcacacagctcagggaccctgggcccagctcacgaaactcctttttcctctaggcctccagggcttgatgggaggggctgccttgaagacctctgacatgccctgaagacatttcccccattgtcttggggattaacttttggctttttgttacttatgcaaatttctgcagccgcttgaatttctcctcagaaaatggaattttattttctattgcattgtcaggctgcaaatttttcaaacttttatgctgtttctcttttaaaactgaatgcttttaagagcacccacgtcacctcttgaatgctttgctgcttagaaatttcttccgccagatatcctaaatcatctccctcaagttcaaagttccacaaatctctagggcaggggcaaaatgctatcaatctctttgctaaaacgtaacaagagtcacctttgctccagttcacaacaagttcctcatctccatctgagaccacctcagcctggaccttattgtccatatgactatcagcattttgggcaaagccattcaacactaggaagttccaaactttcccacattttcctgtcttcttctgagccctccaaactgttccaacctctgcctgttacccagttttaaggtcacttccccattttcgggtatcttttcagcagtgccccattctactagtactaatttactaaattagtccgttttcatgctgctgataaggaaatacccaagacagggcaatttacaaaaggaagaggcttaattaggcttacagttccacgtggcttgggaagcctcacaatcatggtggaaggcaaggagaggagcaagtcccgtcttacatggatggcagcaggcaaagagagaatgaggaagatgcaaaagcagaaacccctgataaaaccatcagatcttgtgagacctattcactaccacgagaacagtatgggggaaccgcccccatgattcagttatctattcccgggtccttcctacaacatgtgggaattatgggagtacaattcaagatgagatttgggtgagggcacagccaaaccatatcaccattttaaacagatgaggaaatgaaggcactgagaagttaaataacttgcccatggccccacagcaagtgacagcagagattcagatgtaggtaggctaattgcaaaaccattgttcttaactgttgtgttatgctacctctggaatatcaaatgtatagctttacttgttcagtcattgctggattcagggcccaaacaaggttattgggattctctctcatgttgtattttggctcagtttttctctgggttgattttatcctcaggcaggcattgccggtgaagtgacagtatagctgctgggatgagaactgcatattcataatttagcaatttgtgtggaaagagagaatttattttaacaatacagttctagcaaatgttctagaattgactctcattgggtcagtttgagttttattcctattcctgaaccgtcactgtggcctgagggtagggatgggatagagtggaatattcttattggccagtctgggccatgtgtgtttccatccctggatctgagacgggggaatgaatccttacctccagggaacatcagggtgctaataccagaaatgggaatggatatgggccaggcaaaaacaaatgttcaccacgcttaagatattaggacctcactgggtgcaatggctcacgcctgtaatcccagtactttgggagactgaggcaggcagatcacctgaggttagaagtttgagaccagcctggtcaacatggcaaaaccccatctctactaaaaatacaaaaattagccgggtgtggtggcatgcgcctgtaatcccagctactggggaggctgaggcaggagaattgcttgaacccgggaggcggaggttgcagtgagctgagatcatgccactacactccagcctgggtgacagagcgagactcaatctcaagggaaaaaaaaaaaggatattaggaccgtgctcacccagtaggatctgtctgcttgatttctattttagccttaacatgtcaaatatttttacagaattatgatgaattatgataaattgaaatcacgtctgggtgagattcatgatagcaaaatgcgtctagagcaggatttgaagaaacaagctttggacaaccgagaaatagataaaaaaatgaatagtatcaaacctgacctgatccagctgcgaaagatccgagatcaacaccttgtgtaagtagtctgggagtgtatggggagggagacgttagtgccaggttactaccagcactagagacactagaggtggaagaagagattagagatttgtaattgagaattggccagtaagatggtaagaatttaggaaagtgtccttggtagttgtagggggtaccagagttaatctgaagttaatatgtggagcaaaccagaatgtaggactcttgatccatacaaatgccttggaaatctcagaggctggctgtggcatgagtaaaatgctatatcttaacaagaacagattaatgtttgcctaaaacataaaaatcagaatctttgtttacatactagaactgagtggggaatttctatttcctctgaggggaaataggttctaggctgggcactgtggcttacgcctgtaaccccagcactttgggaggccgaggtaggcagatcatctgaggtccggagttcgagacaccagcctggccaacatagtgaaactccgtttctactaaaaatacaaaattagctgggcgtggtggcacattcttgtaatcccagctactcaggaggctgaggcaggagaatcacttgaaccctggaggcggaggttgcagtgagccgagatcacgccactgcactccagcctgggtgacagagtgagactccatctgggaaaaaaaaaaaaaaaaagatggtgaaaccctgtctgtactaaaaatacaaaaaattagctgggcatagtggtgggcgcctgtaatcccagctacttgggaggctgaggtaggagaatcgcttgaacctgggaggcagaggttgcagtgagccgagatcgtgccactgcactccagcctgggcaacagagtgagtctcaaaaacaacaacaaaaacaaaatgacattctttatttaaataacagaaatgtatctatagaaggcacttgaggtaatttgagtagtgaaacctaattctttagtatgagggaaaactatataatttagccaaatataggcataatagagataatatacaaatataaatggaaagatagtatcagaataaaatgtgtgaattatatttttagaaacataaataactgcttcataggacagaatgcatgagaaaggaagatcctggatattgggcttagttctgggtaacgaatagactgttttgaaatgcatctatgggtgaccttgatgcatgtaacaccactcaattcaaactactggcaggagaagacagagcagagacctctgaatctgggttttccatagacttcagggttctttgtgtgagaaagagggagaggatgaaatatacacctagagattggaactgtggcagaagagtttcagtagaggaagatttaaggtgattttttttttttttttttttttttttgtgaggcggagtctcactgtgtcacccaggctggagtgcaatggcacaatctcagctcccactgcaacctccacctcctgggttcaagtgattatcctacatcagccttccgagtagctgggaatacaggcatgcaccaccatgcccagctaatttttgtatttttagtagagatggggtttcaccatgttgaccaagctggtcttaagctccagaccttaggtgatgtacccaccttggcctcctaaagtactgggattataggcatgagctactgtacccagcctaaggtgatatttcttggggtaaacaattacaactacaccatgctgagtagtttttaataccagctctctcaagagatcattttagtttgctattgtggccaaaagtcaagccaagtgtatatagcatactgaagagctttgtaaacaaggcaaggagggttctcttatctgtaaatggggtgtgtctgctcttggaatgctcacgtggttctggtcacatcatgaagctgaagaaaggctcaaaaaggctatgctatacaccaaaacaatgaatggaagtccttctttgccctgaaaagcaataagaaatacaagg

SEQ ID NO: 14892 - DNA, 6569 bp, Human
aggagaccagcctgggcaactcagtgagaccccacctcttaaaaaaaaaaaaagccatacggctagctgcagtggctcatgcctgtaagcctaacactttgggaggccgaggcaggcagatcacttaaggtcaggagttcgaaccagcctggccaacatggtgaaaccccatcgctactaaaaatacaagaaaattagccaagtgtggtggcagttgcttgtagtcccagctacttgggaggctgaggcagaattgcttgaacccgggaggcggaagttgtagtaagctgagatggtgtcactgcactccagcctgggtgacagcgagactccgtctcaaaaaaataaataaaataaaataaaaataaaagagagcagctcttgacctgagataggtctatgaagcgcctggggcttgagagtggctgacagcgtttccccagaagcactgggtcagaaccaagcttcatggagctgtctcccccaggccagggcttcagtgggatcacagggattgccaccctcttctctccaatactgcggcccaggtggctggagatcctaaggcttaggggttttaggcattgactcactgggggtcttcacttaggatctgatactcaggtgctagctccacggcagtgacaactaaactcccgggtaacctgccgccccagagcagggggcccagcctcccaaaccaggtgtctgatccactccagcctagcaccacgggggcgctgagttcatctaggcctagttggtcaaatcctttagaatctcacctggtctcacaaggaagccactggaagcctctgagcttcccatccttgctagtgctctgctggctccacctggagccctttggaccaaggcattttacctgccagtgtagttcacttgagatgcgcatggccacaagactgttcgtagtctggctcctccacttaagaggcgtcggaccttacacatcacctgccaacctcccatatcctacccttgtgtccaaagccaggaaagaagaggaggcatctcgctagggttctccccgccacagcgtgaacatatgcacttgccaggctgataggcgagtcggggccccaagaacacccgcatgcagtgagttagacaaaacagctttatttgaaagacgtgggacagccaagttcccccaaccccgcggtcctggcgacgtcggtgtcaggcgtgggaggaccagtgtcctgcggagaaagaacaaggttaggggtctgcagtcggggtcaggagtcaggggccagacctcgcgagcgaccgcacccgggggggaggcggcagcgcctgtcggggcctgggtttcaccgccgcacatggggcagcgcgcggtgagctgaggcccccgggggctctgggcgccgaatctcacccgcggccacggccaaagccgggggcgattttcaaccaacgccggtctcgaagaccaccagcgagacgccagtggtcaacgcggcaggacctacctaagtgaagaggagagcgcaatggaggcgcggacgtttatagccactcttcgggtggattcccgagccgcggctggggacggaggcgccggcgtttatagtcgcttttcgggtgacgtagattcccgggccgcggctggggccggacgggcaagagcactcagagcccggtgaggacggggcaccgcggagccaatcacaggttgtcttataggagctcggcccgctcccgcttggggcggggctgcggagatctcgcggcgcttggcgtgctataaaagctgcttcccagtaggtctcgttcttcttttccgacaaaacacgtgagtcctgttggtcgctgcagcgggcctctgcgtgggcggcgggaatccgcggacatcgggtcgggtctaggctcccgagtccgcgctcctgggcgggagcccttgtctgggtctcgcggggggctgccagatgcgtaggccacactgactagttccttcttgtcgcttttcccagcaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggaggtaggtatcagccacgctcggggtcgggcccctgggcggcgccggagagcggtcctggtcactggcgccttttctccctttagtggatgcccgtcaccaagttgggccgcttggtcaaggacatgaagatcaagtccctggaggagatctatctcttctccctgcccattaaggtacgcgtcggtcgttggggcgttgagcaagtgcgaccccggagtcatttgggctggggttggaggattagcatctgccattgactcgcattaaagggcccagcgtctcgcgtgagaggttgaggttgtgttgcgggctggctgaggagaggattccacttagaggttggatggatacctgagcgaagccagagccacaaaaggcatttcagcgcatcttcccacattcgcagcgaattcatttccaaagaactgaaagagaagcagcgcttggttcatgccatccgagaggatgatgaagttcaggttgtgggaggacactgtaagggttagcaaactgtcatagtccgcgtgtacgggacagctgtcatctgcatccagcgggtgcagtggggaaaggctaatggcatatttgtcatgtgagcgttcgccctagcaaggtacggtggtcatggctaggccaaagctggacaaagcaaaaggaaatctgagtggaaagccacatctcaccaaacaagagaaaaagggcaaataggaagaaacgattgagatgcagaaatagggtaaccttacatacaagcttccaaaaacgaaacgaaggggacagatcggggggaagccaggtgagggggttcatgacttcttcggttttttttgggcggggtgggcggttacacagtttcgccctatcgcctaggctggcgtgatctcggctcactgcaacctccacctcccaggttcaagcgattctcctgcctcagcctcctgaatagctggggttacaggcgcactccaccatgcccggctaattttttgtgtctttaatagaggtggggtttcaccatgtggccaggctggtatcggactcctgaccttgtgatccgcccacctcagtctcccaaagtgctgggattacaggcttgagccaccgcccccggccgtgactttggttcttgaatatcgtaatggtattaagtttttttttaatgctctccctacaattttcttgtttgtttcaggaatcagagatcattgatttcttcctgggggcctctctcaaggatgaggttttgaagattatgccagtgcagaagcagacccgtgccggccagcgcaccaggttcaaggtacccggctgtcctggagggggctgcgctgggcttgccgggactctctcggctctgcatagttgcacttggcttcacccgtgtgactttcgtaacggggagagagagaaaagatctcctcaggacctcggatgggccttactgtggcctctctttccttgaggggtgcaacaggccctgggcggtgggcagtgattgggtgtagggccaccagctgcctcacacacatcttttcgcaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtaggctggtggcaggtgatgggcctgccgtggggcaggctccctcgggcccccgtctcctgactccttccctcaccaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcggtaggtggtccacacatggggcatagccatggtctctcagctccgcttaaccacacgggtccagtgtgtgcttggcgtgttttcagggaggcagagaaaggctctcctaatgcacgacagacccgcccagaatggcctctctgttcctaggagtgcgacaatttttgggttgggggacttgcctcaagcacaccactgaccctcctggggttcttttgttttgcagccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgttactgtttttttcccgtgtcctgcatggttagtggtggtttgaatctggggcgtggggccaatagatcacaccagacacacaggcaggttgcagggctttatatttcagcaacagtcatacagagccacacagcaggggcacccacagctgcctcaggaggtggcagcggcggcctcttttgcagcttttctctcttgcagcatcctctgcctctgtttggccaggcacttcctggcagaactgtaggcccccaggtcctgatctggggaagcaatggaaacaagctgggaaccgaggcctctgctacatgcaaagggggcaaagtcaagtgagcacaagggaggggagggaagatttgcaatggttctggcccccaggcctcaggaggatggtggggggttgggggtgggtggggcacgcacagcggtcctggtaggccttggccacctgggtgaactgctccacttccttgatacagttctgctggtagttctgtccttccctctgctgacaggctttgagccgatcctgcataatgttgataatttcttggtcgactttgctggtggagaaaaggagcaagagaggctaatcacaaggaatccttttcctgtaccctgtgagaacaattgaaagcaagagccctggggtctggctcctcccatgtcacccctaaaatctgggcatgccaccctgtggcatcccagggactagtgtcccagcagcacacggtgcagatctccacactcccagcatggctcacgtactagtccctcttccactgcatttcggcttcatacatgcacatgatgtcctcctccttgcactcagtgatgtctggcacgcggcggtactgccggtggtagtagtaatacctgttctttgcgtgctgccgctctataaattctgcaaagacaaagccacagactcaaacgcctcatcggtttggacaggcttttagctttcttatttctcataagccctttggaggggagagaggagaacttcctgagtgttccagcgtttagaaaacagcaattcgtctctctaagggatgtggccagccaggcaggcctgtgaaggcctaggctacagctgatggagagctcccgagtaccaggcatcatcctcagagttccacatgcattaccttactctgtcccccacacaagcctacaggcagctgcttctcacagatggcaaggactgggacgcagctctgccagtgcacctcccccagctgcacagggaccctgctgggtgcgcaaagaggctccaacagggagcctccagcaagcagaacttaccaccttacggcctcagcttcctcactgggaaatgaacgagctaaaaggagagctcgaacatccagacacataggacagacatgctctacaactgctacaaaagagagggagctgggtccgctgttgcacggtttccagatctttgggggtttgatttggagacttcaccctcttacggaagaaccaccagagcatgctatgcaccccaagtgttcaaaaagaactgaaccaggctggacacggtggctcaggcctgtaatcccagcacctgggggccaaggtgggaggatcacctgaggtcaggagttcgagaccagcctggccaacatggtgaaaccccgtgtctactaaaaatataaaaattagctgggcgtggtggtggtgcgcctgtaatcctagtactggggaggctgaggcaggagaatcgcttgaacccggggtggggcagaggttgcagtgagccgagatcgcgccactgcactccagcctgggcaacagagtgagactgtctcaggaaaaaaaaaaaacaacaaaaactgaactgggcattttcccggttcgttccagagatggtgaatttgggcatctcggccatcaccccgacacttggtcatctggcagagagacatttgagagaggcctgaggccagcggtgcagtggaggggtgcccggggcggcggggggcggagag

SEQ ID NO: 14893 - DNA, 17082 bp, Human
  misc_feature (1)...(17082): n = A,T,C or G
gtggcgggcacctgtggtcccagctactcgggaggctgaggcaggagaatggtgtgaacctgggaggcggagcttgtagtgagccgagattgcgccactgcactccagcctgggcaacagagcagactccgtctcaaaaaaaaaaaagaaaagaaaagaaaaaaaaaaagaaatgttctagagccgggcatgatggctcaagcctataatcccagcactttatgaggccaaggcaggaggatcacttgggtctggaattcaagactagcctgggcaacatagcaagaccctgtctctagaaaagaaaatatttttttttgactagctgagcatggtggcacatgcctgtagtcctagctacttgggatgccggggtgggagaatggcttaagcccaggaggttgaggctgcagtgagctgtgatcgcaccactgcactccagcctgggcaacagagcaagaccctgtctcagagagagagagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtttgggctccctgccctgtgcgccatgagcacgcagacctgcctgtggatgctggccctctccttggccatcctcttagaactctcgagacagagttcagcgtgccctgtaacacagagccaggcttctaaacgggaagcaggtacaggcaggttagaactggcctggtgcctggatcccttcatccccagaggccaggtgctccttgaaagaaacttgcgcagccttttcttctaccagttaactgcttatctgctcagcaccccaaggaacgagcccatgatctgtcccagctctcaaaacaagtaaacactgggatgtagcctcccacatttgtacttctaaacgatctggtgtcttgctgggagagagtccctacctggccggctggcagaattgtgactgacagggaccatgagcaacaccctcctccagaatcaggggagccgaggtcctacccctaccctcccatcaaagagcagttcccagacataaaattcacacaccatacagttcacccctctaaagcctgcaattctgtggttttttaggatattcacagggttgtgcagccattgccactgtctaattttagaatattctcctcgtcccaaaaagaacccccacccctgccctggacccattaccaggggtcaggcggtggttcccagctggagggagggtgggacatgaagcgtcgcggggtctccttcccctgaccttcagaatccaggcttccgggaggaccacagcaggggcattgatcacaatgacccacctgttctagacattaatgaagtagggggagaaaagacaggtgcccccatcctggagggctctactctcctgaaacactagctgctttgcactatggtgggcttcaggcattacactttccaccaagaccatggagagctttccacattccgtccctaagagacatccctgggctctgtcctgtctgtccccgcagtgtctgtgtctgatgaggcccgcgcagaagtgaatggcctgaaggcctctcgcttcttcagtctcgctgagcggctgaatgtgggtgccgcacctttcatctggctcttcatccgccctccgtggtcggtgagcggaagctgctgcaaggccgtggttcacgagagcctcagggcagagtgccagctgcagagggtgagtctgggcgaggggcagcacctgcgaggccacctgcagggtcccaggacacaggaagaccccgagggtagatcctggaccctggaaagtcagtagcctaagggaagtgaagatgcagaaaactgagagtgcagatatggggaacgcatctggaaattagctggcacagaggaggaagcctgagagccagggtgggctgtggagttctgggtacacgtgctgacagctggaaacatggggctgaggctgcatggggcagtgggagctcaagacacaaatctggccaggtgtggtggctcacgcctgtcatcctagcactttgggaggccgaggctggagaattgcttgtggccaggtgttcgagaccagtctgggcaacatgatgaaatctcgaaacctcgtctctacaaaaaatacaaaaaagttagccaggggtggtggtgcatacctatagtcccagctactcaggaggctgcggtgggaggatcgcttgagcctgggaggttgagcttgcaatgagccgtgactatgccaatgcactccagcctgggtgacagagcaagaccctgtttccctttaaaaaaaaaaaaaaaaaaagactgaaatctgggagtggccctctgcaggggagggagggccagacagcagggccatgggcatgggacccaaagacagacaagggagtggtggcccccgggcagttctctgtgctggaaatcacacttctttctcctttttttaaagactcacaaagcatccatattgcactgcttgggcagagtgctgagtctgttcgaggtgagtcaagttgttctctgcactgggactttgtgttcgatacatccctagccgagatcctggaactgaaaagcagcagaagggggtgtccaaggcccaaaacaaaaggcaagccttgcccagaaaggcctagctggagaagccaggggacacatgtgggcctggccacgggctccgatcctggctccatgacccgcctggcaggggagtgggggacggtgagaacagcagagcagatctcaaggaggcatcgaacctcgatgctcactcgtctgctggccctgctcctcgtgggcctctcctgctcgtgtggacctctctgcctggccaaaatggtgaaaccacgtctttactaaaaaacacaaaaattagctgggcgtggtggcgggtgcccataatcccagctactcaggaggctgaggcagggagaattgcttgaacctgggaagcggaggttgcagtgagccgagattgcaccactgcactccagcctggcaacagagtgagactcagtctcagaaaaaaaaaaaaaaagtatggaaaaggaggaagatggtgagtagagtgattgaacatcaagtaaagaataagggccggtcatggtggctcattcctgtaatcccagcaccttgggaggccgaggcgggtggatcacctgaggtcaggagtttgagaccaacctggccaatgtgttgaaaccacgtctttactaaaaaacacaaaaattagccgggcgtggtggtgggcacctgtaatcctagctacttgggaggctgaggcatgagagttgcttgaacccgggaagctgaggttttagttagccaagatcgtgccactatactttggcctgggtgacagagggagactctgcctcaacaacaacaaaaaaaccagccaggcacagtggctcatgcctgtaatcccagcactttgggagactgaggtgggtggatcacctgaggccaggattttgagaccagcttggccaacatggtgaaaccccgtctctactaaaaatacaaaaattagccgggcatgatggtgggctcctgtaatcccagctactcaggaggctgaggcaggagaattggttgaacccaggaggcggaggttgcagtgagccaggatggcgccattgcactccaacctgggcgacgagtgaaactgtctcaaaaaataaaaatgaaaaagaataagggaacaatgaactctgctgggatttattctaggatgaggagaagcagcagcaggcccatgacctgtttgaggaggctgctcatcagggatgtctgaccagctcctacctcctctgggaaagcgacaggaggacagatgtgagtggtgcctgctctgggtcggggggagttatgctggacaaaggcgtagttgatgctggtccttggatgcggttctgtccacaaaagggaggtggctcttgctgctcccggtctctcagcctccgggaaccactggtcagtcggctattcttggtacccccaaaaatgactccaccatttgagagagaagaggtgggaagttagcgtagtgtcggcccttctgggtcttggttctgagttcctcccaagacacagttgtacaaaggctcggtgatctcccattgacaggtgtcagatcctgggcgatgcctccacagcttccgaaaactcagggactacgctgccaaaggctgctgggaagcgcaggtgaggtgcggggctgggatgacgtggggagctggcctttctccctccagccttggggcaggactatctgggctcccacattggggggcaggactatctgggctcccacatgggaggccaggattgagggacaccctaagatcggttcagcactggaactggtcctaaaggacaggtacactgtgagaagagctgggaaatgcgttattcatctctgcctatccactcttgcctctcagccagccaacctcttaattttcaaatgcttgtgagctatagctgctgtcaaaatttgtgccattcttgaaagttgtcccataggtagaactgatcttgacaacaaaacttgaggctacttgagagcagaggggcgtggagagtcccttcctgcttcctcttcctgttagcgccttgcttgtcatgtcacctggtcaccaagtcatccagggctacaggcaggaaatcaagcattggtagactctcccctcacagctataaataagttgttagggccaggtgcggtggctcacgcctgaaatcccagcactctgggaggccaaggtgggcggatgacctgaggtcaggagttcgagaccagcctggccaacatggtgaaaccatcgctactaaaaatacaaaaattagctgggcgtggtggcaggcacctgatactcaggaagttgaggcaggagaatcgcttgaacccgggaggcagaggttgcagtaccactacactccagcctgggcgacagagcaagactctgtctgaaggaaaaaaaaagttgtcaggacgaatcaaagaaagctcctatttgccaaatggatagaagcttgttcttgtcaccccaccaagtgggtggcagagtgatctgcgctcaaatgctagggacaaaattacaaattgataatggcccagcccgaggtgtcatagcacattgtggtgttcacgtccaaaaagccagtctacagatttacaagaaggccagacgtgatggctcacgcctgcaatcccagcgctgtaggaggttgagttgggaggatcgcttgagcccaggagttcaagaccagctctggcaacatagtgagactccatctcgacaaaaaattttaaaattagctggatgggctgggtgcaagtggctcatgcctgtaatgccagcactttgggaggctgaggcgggcggatcacgaggtcaagaggtcgagaccaccctggccaatgtggtgaaaccccgtctttactaaaaatacaaaaaaattagctgggcctggtggcatgtgcctagagtcccagctacgcgggaggctgaggcaggagaattgcttgaacccaggaggaggaagttgcagtgagccgagattgtgccactgcactccagcctggcaacagagcgatactccatctcaaaaaaaaaaaaaattagctggatgtggtggcgtgtgccttgtagtgcagctactcaggaggctgaggcaggaggatcacttgagcctgcgaggtcaaagctgcagagagccgtgatcgcaacattgcacttcagcctgggctacagagggagaccctatctcaacaaaaacattgtttacaagaaatgcaacaacgtagttctcgtggaagttcaaggggcctcagtcaattctcacaaaagaggaaatagggccgggcgcagtggctcacatttataatcccaacactttgggaggctgaggcgggaggatcacttgaagccaggagttctctctgttgcccaggctagagcacagtggtgcgatctcagctcactgcaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataataattataataatataatatatatcatatataatattatatattatattctataatatataatatattctataatatatgtaatattatattctattatatataatatatattatattatatatattatattataattatatattatatattatataatatataaatatatattaatatatatgattattatatattattatattatatatttttatatatttatatattatatattatttatgttaattatatattatataattatattatatgttctataatatataatataatattatgttataatatctataatatatattatagatatattatatataatagatatttttatatataatatattacatattatatattatatgttttatattgtatataatatatattatatataatatatatataatatataatatatatatatttctctgtttttgggtggctagctggtaacttctgaaaatagctgtttttaataatcacagtgtttgctgggatgaagctgtgatgaggcaggtgctcctattcctgggtgtaaacattggcagaagcctttcggagagcactggggcgtatggccagagacttaacacagcttccccaggcattagccatgtaagaaactgagacctgagccacggtggaaaggccactgacatttcattatatatcttttctcatgtcatctattacttatacaaaaaggaataataattaaaacctgagccatccttgttcccgaagcttgtgaaggtttaagttaagtagggcagtgtgtccacatgcatttggtgcctgaatgggcctttgcttcagaaatggaaaactgcaacatggctgctgtctcacgctcatgtttgtcttttcttcctcagctgtctttagccaaagcctgtgcaaatgcaaaccagcttggactggaggtgagagcttccagtgagatcgtctgccagctatttcaggcttcccaggctgtcagtaaacaacaagtcttctccgtgcagaagggactcaatgacacaatgaggtgaggcattcaggccggggcttctaatcagagcggcgcggaagccagcctccaggggaagggagccctttccacttaaccccagttacctgtgacagggcggcatagagttcccttatcaccctttttttttttttgaagtggagtctcgctctgtcgcccaggctggagtgcagtggcgcgatctcagctcactgcaagctccgcctcctgggttcgagcaattctcctgcctcagcctcccgagtagctgggactacaggcacccaccaccatgcccggctaattttttgtatttttagtagagatggggtttcaccatgttagccaggatggtctcaatctcctgacctcgtgatccgcccgctttggcctcccaaagtgctgggattacaggcgtgagccaccgcgcccagccttgggtgttttttaaaaccagtaatgccaaagttatcgtggactttttggaagaaaatatcctactctgctttcttcagttacttttttttttttttttgagacggagtcttgctctgtcacccaggctggagtgcagtggcgtgatctcggctcactgcaagctccacctcccgggttcacaccattctcctgcctcagcctcctcaggagctgggactacaggtgcctgccaccacgcccagctaatttttttgtatttttagtagagatggggtttcatcgtattagccaggatggtctcaatctcctgacctcgtgatccgcctgcctccgcctcccaaagtgctgggattacaggcgtgagccaccacgcccagccaccttttttttttttgagacagggtctggctctgtcacccaggccagagtgcagtggcatgatttcagctcactgcagcctccgcctcccaagctcaagagatcctcccaccttaccctcctgagtagctgggactacagatgcacaccaccatgcacagctaattgttgtatttttagtagagacagggtatcactatgttgcccaggctagtcttgaactcctgggctcaagcgaacctcctgccccagcctcccacagtgcagtgatcttttttaagccacagaacacattgaacatcttttttttttttttgaggcaggctgtctgtcacccagggtggagtgcagtggtgtgttctcggcttgctgtaacctctgcctcgggctcaagcctttctcctgcctcagtcccccaagtaggactacaagtgtctccactctattcagaaaggcatttaccatattggggcatcatttaccgtattggggcattcccttgcgactgtccaccttctcccgctccctgcacgccccgagggtcagggttcatccactgtgggcagaccaacggctgtgggctgacttttcactttgcgtcaggtcgaggtctcaaagcgcttgtgtttgggagcaccaggaacacagtcgaaggatgtggggcctgctttggggctgggacccacggagcctcccgggcttcctgtgacatggcctctccagccttggttccagggtaaacccatgattccagagctagccagcttatttggtcgggcccaacaggtggggttgaaatcgcagacagggacacatggagaacgcccccaccagttcccacgtgcttctctttccgcaggtacattctgatcgactggctggtggaagttgccaccatgaaggacttcacaagcctgtgcctgcacctgaccgtggagtgtgtggaccggtacctgcggaggaggctggtgccgcggtacaggctccagctgctgggcatcgcctgcatggtcatctgcacccggtgagaagcccccttggcccagctggcagggacgtgctggcctttcccgggttcagggtcacctgcccttcatgtgctcctcactggtttggttttgttttgtgttgtttttttttttttcccgagaccaagtctcgctctgtcacccaggctggagtgcagtggtgcgatcttggctcaccgcaacctctgcctcccaggttcaagtgattcttctgcctcagcctccagagtagctgggactgcaggcgtgcgccaccatgcccgactaatttttttgtatttttagtagagacggggtttcatcatgttggtcaggctggtctcaaactcttgatttcaaatgatccgcccgcctcaacctcccaaaatgctgggattacaggcacaagccactgcgcctggccctcactggttcttgactcatgagccacgagtgtcccacctggtcagacatggagtgccacgctgagggccttttgcaggcaggggtggcagaacagccttcagcgtgtgggggccgctgtgtggggtgcctgcatccaggcaattcatcctggcatgcagtctcaggacccaaagtgtggcctcgctctggcaggcacaggctggactgccctgtcccctggctcctgagggcagcaggatgactgatcagggagggtggcagttggctgcccttctctgaagttgggttctaaagtctgttgccagagtttcctacactcttggagttagagagtttttcgtcccccactggtgccctgcagagcccactccagccacgtgggtgtctctcaggagcagcgtgcgtccttacacggcagcctgtccttttcaaatcagaccactgctttcctttaactaatgctggatcccctagttccgcctttggaaataacgtggaaatgattctcacaatacgatttgcatttcctaaaccagctgtccccagcatggtctacatttcccgaggaagtgctttccagaccgactcctctgtagagcctggtgggtgaggataggcttggctgcacacagcatatgtgtaagctacagagacttgtttctttcttgcacaggtaacccagaggcagagggtccaggctcaggtcattggcatgttttttgtttcacgaggaagcagaggagccccatctcccatcttaatctctgccaccaactagggtgctgcccttgtccctgtgacacctgtacctgccacattcacctttgcactgagcttagtcttgtgaccacatctcaccagacgggaactgggaggtgtagtctcttcgggcctgtgtgtgccagctcgatgcagtgtcattcccatggaaggagggagcaaaccctgccacaagcatccagagctgtcttcagatgcgctcttgggcctgaatccagcgtcccaggtcttccgaccagagacgactgaggaggtcgggcggccgcctccctggatctgactgcacatccatcactgcaacctacgacaaagctcctgggccacaaccggctggcagtgagagaataactgctaaaaacgtttcagggagctgagtccaatttcttccccaaccacaagacctgattgcagtggtccatataactatcaccacagctccctcaaatcaactctgccttattatcttttttttttttttttttaaatccggggaccaggcacggtggctcacgcctgtaatcccagcactttgggaggctgatgtgggcggatcgtgaggtcaggagttcaagaccagcctggccaacatggtgaaaccctgtctctactaaagatacaaaaaattagctgggcgtggtggtgcatgcctgtaatcccagctactcaggaggctgaggcaggagaattgcttgaacccgagaggcagaggttgcagtgagccaagattacaccattgcactgcagcctgggcaatggcgcaagactctgtctcaaaaaaatacaaacaaaattagccagacgtggtagtgggcgcctgtagtcccatctacttgggaggctgaggcatgagaatcacttgaacctgggaggtggaggttgcagtgagctgagatagcgccactgcactaatccagcctgggtgacagagggaaactctgtctcaaaaaaaaaaagattttaaaggctgagctgccccccacctctgctctcagaggtgccctgcccccaccagccatctcacaccccacgctgggctctcattggccactgacatcttgtctttttggcgtctgcagcccccacgctggcaggtgtagtccctgcgcctcttgtcctcttggtcaagtgaatgacgcatgcaacctgcagagtccccaggacagagcagccaagggacttggcctcagtccaaggggaaggtgccttgcggggggccgctggagcagcgtgttccctgatagttggcgctggttgacaacagagaacagggtgaccatcgcctagagacagtcaggattcctgcggccacacagtgccgggcacagactttccaacaacccttgggccctttgcctccaattcctagatctggtgactcacccaccttctgggtctataacatttctaccccactgatagagctgtcacgtgacaggcaaatctctgtccttggtgtcttttagcaaactgaatgctcagggcacttgggccttttgcagacatttgtgagtctgcctaacagccttgctgctttctgtctgccttgtggctctcatccctctttccagcactttctgacctcccctttgttattattatgatgattattttttgagacagtgtcttgctctgtcacccaggttggaatgcagtggtgtaatcaaagctcactgcagcctcaacttcctgggcttaagcaatcctcccaccttagcgtcccaagtaactgagactataggcacgtgccaccatgctctgctaattttttattttttaactttttgaagagatagggtcttgctttgttgcccagggtggtctcgaactcctggctgagctgtcctcctgcctgggcctccccttttttaaatgccccttgtcagccacaggcagctggctccattatgaagcctctgtttgtcaccaaagcccaacgccatggctccctccctaccttgaggcctcctaaagccttgggtccctccgccccacccctgccccaggaagtgggctccgccctgagaccccttctcggcattgcaggtttatcagtaaagagatcctgaccatccgggaggccgtatggctcacggacaacacttacaagtacgaggacctggtgagaatgatgggcgagatcgtctccgccttggaagggaagattcgagtaagcagcggttccattttccttattaatcttcgttgtcgctgtgctggagggtgggggtgggcattcagctttcctgctgtgggagggcctcatggactcagagagcagctgtctctgctgtgcccaaagccatggagcaggaggccacggttgcaccacgtcgccatctgcgctggtgcgctacgcgtgcagcatcggcgtgaacatcatccgggccagaccctgcgctgggcctgcatgcggcactgcaccaaggagcccccgagcgctgagagcccacaccccgtcccggctgtctaggtccccactgtggtggattacaaggaggtcctgctgacgctagtccctgtggagctgagaacccagcacctgtgcagcttcctctgcgagctctccctgctgcacaccagcctgtccgcctacgccccagcccgcctggctgccgcagccctgctcctggccagactgacgcacgggcagagtaaggagtggcccttcccagggatgcctgtgtcggggaaggtgctgacataggaggaggctgtggggaggaaaagagtccagcatccatttgtcctggttacttcttggggggtgagatacagcacggctcctaccttcagtgatgtcccagatttctgaccatgagcctgcacgccctatgtatgggtttttttcaaaactattttaaaaggattgcaaccctgagctccaagaaactccacagcagagcccacagagctatagagcgggagtgttcaggcggctgtcaccacagcccctccgtcccctccatcccctccgtcccctccatcccctccacccctggcctgctttcctccccagcacagccctggaccactcagctgtgggacctcaccggattctcctatgaagacctcattccctgcgtcttgagcctccataagaagtggtgagttttggccgggcgcagaggctcatgcctgtaaccccagcactttgggaggccgaggcgggcagatcatttgaggtcaggagtttgagaccagcctggccaacatggtgaaaccccacctctactaaaaatacaaaaattagccaggcgtggtggtgcacgcctataattccagctactcaggaggctgaggcaggagaatcgcttgaacccaggaagcagaggttgcagtgagttgatatcacgtcactggactccagcctgggtgacagagcaagactctgtctctaaaaacaactggccaggcatggtggctcacacctgtaatcccagcactttgggaggccaaagcgggcggatcaccgaggtcaggagttcaagaccaacctggtcaacgtggcaaaaccctgtctctactaaaaaaaaaaaaaaaaaaaaaaaaattagctgggcgtggtggcatgcgcctgcaatcccagctactcaggaggctgagacaggagaatcacttgaacccgggaggcagaggttgcggtgagccgagattgcgccattgcactccagcccaggcaacgagtgaaactccatctcaaaaaaaaaaaaaaaagttccagtagtttcttatctcacacatttttcacattgagagcagctgctcccaacccaagctcattgcacaggcagcagaacatactagaaaaaatgagggcatctccctgacccgtggtaacttgtgcgtgttgtcaagttgtcatctagctcaggcactggcacaccgtggccctcaggcggcatctggctgcttttgcgaatggggttttcttggcagcagccaccctcactggtttccacattgtctgctgctgcttttgctctggcggtggctgagctcatagtgcagcggacaccacgtggcccccagtcaggaaaatactccccttcccttgagagaacagcttctgccctgatgcagctgctgggatagagctatcctctgtctcactgagaagatggagactgcgggtgggtcccttgcgccgtcgtgcccggatgtgaccccctgtctgccccagccccactgggcttccctccacctgccccggcccctccgcccttctctctggtgagcctggcccggccctcgccacatctaagccccttcactcgccctggcagcttcccttcagcccacgttggtttgttccatgcagttcatgaagtccctaccgtggtccaggcgctgggggagagggcaggacagagagttcagaggtcaggtcgtgacgagagaaacagcaggcaggcgcgcggggcaggtggcgcgggcgggggcgactcccttcagggagcgtagccggggtcacctgggcatctgagtccagggcaaagggggcagccatgccagggcccagtgcagaccagtggggctgggggccatgagtggagtcatggcagtgaggggtgagggggacaagcacggggctgaatttgtacccggccagccatctccgtctcccctcctcagctgtgctcacagacttgctcctcccacctctcggcacccccactccctggtctcccacttccccgcttctgccatggcttccttttcctcagccaaatccagcagactcagcggtgtgggcttttttttccttttttgagttgggggcccaggctggagtgcagtggcaccatcctagctcactgcagccctgacctcccgggctcaagggattcttttgtgtcagcctcccgagtagcagaaaccacaggcaccagcacagcaggcctgggtgcttttctccagccagcattacgctgaccctccctccctcgggggcttcggcttcctgccctaggccatgcggcctaggtgttggtctcccttcccacccaccccaaggggccccggaattctggctttctgccactcctcagactccttcctgggagacttcaccacttccagaattcaggccacatctcaaccttgacct

SEQ ID NO: 14894 - DNA, 54180 bp, Human
  misc_feature (1)...(54180): n = A,T,C or G
tctcactctgtcgccaggctggagtgcagtggcgcgatctcggctcaccgcaacctccgcctcccaggttcaagcaattctcctgcctcagcctcccaagtagctgggactacaggtacgtgccaccatgcctggctaatttttgtatttttagtagagacagggtttcaccatgttggccagaatggtctcgatctctcgacctcgtgatccgcccgcctcggcctcccaaagcgctgggttcacaggcgtgagccaccgcacctggccttattttatttttttaaagctatctcctacaggaaggaaagcataatttttcacatttacttttatttatttatttattgagacaaactctcgttccgtcgcccaggctggagcgcagtggcactctcggctcactgcaacctccgcctcctgggttcaagcgattctcctgcctcagcctccagagcagctgggattacaggcgcccgccaccacgcccggctaatttttgtatttttagtagagatggggtttcaacatgttggccaggctggtctcgaactcctgagttcaagtgatccgccccgtctcagcctctcaaagtgctgagattacaggcttgtgccacctcgctcagctggaaggcataatttttaaagtggttatgacagaaattatattggaaaggggcctgtagtagaaacatagcctccgggtagaccaggaagaaaaattagattcagaaatggcagggttactctttcagctttactcttctccaactgggtgtcggtgctagtctacaaatgtgaataaacattaaagcagataggtatgcatgccggaatccgagaagcattcgtttcgtatataccaagtgcctgttgcgtgttcaggtagaagaccatagtgcaatggtggagacagattatgtcgacaaattattcaaatacagtgtactaaatatgcaatgtaattaggaaaaaacccgagggcaaaaagaaaggcatgacaatgcttcggggaatctggaaaggttttattggtgtgacatttaagttgggccttgaaggatggggagaagtttgtcagttatgtttaggaatgcaaccagaggaagcccagaagcctagagcgttaaggaattgcgcagcaactcagactggattgagtattgggctgtgtttgtcagatgcaataacagaatgagaggctaggaaggcaggtcgggggctggagagaacaggatctgcaaggttcttgtaatcagaaggcaatatggcacagaggttaagagaaccgcttccttctaagtcgcgctccatcacttgctagcagtatgatctagacactggcatgggcttgggcgtacccatttgcaacatgggaaaatagtttttttcttatacggcttaaatgactgagtgggtatcagtcagttagggcagcgtgcagctcatattaaggctaaatgagaatgtattatcatcacgaagccaaaccacgccaaagctcgtttctaggagggtcccccagcctcctcccccctgctactgtttgggaagagaaaagttctctcgggtcaggccgcgcccactccccactcctccgccctcctaggcctccgactttcttcagcgagcagggcccggccagggagtgggtagatgggcctggtgggcagcggagacgccgccgcttaccagggctcgggtcccgctcttcgtcctccgctgttccgcgggccttgaagccgggcggcagggccggtccgatcaggtctcttgccatccgcggtggcggacactggtcacagatatgagtctatccacgaacgtcaaccctatccaaaaagaatcccgcgatcagcagcgaagaatggcaggtttcccggcgccgagaaatgacgtaaagcctgtggttggctgagccttgtagttcacggtaaaggaagtgacgcctaatgcttgctccacagtcgcgtgctagactccggacccgccagtggtatggctgagccgactagtgatttcgagactcctatcgggtggcatgcgtctcccgagctgactcccacgttagggcccctgagcgacactgccccgccgcgggacaggtggatgttctgggcaatgctgccgccaccgccaccaccacttacgtcctcgcttcccgcagccgggtcaaagccttcctctgagtcgcagccccccatggaggcccagtctctccccggggctccgccccccttcgacgcccagattcttcccggggcgcaaccccccttcgacgcccagtctccccttgattctcagcctcaacccagcggccagccttggaatttccatgcttccacatcgtggtattggagacagtcttctgataggtttcctcggcatcagaagtccttcaaccctgcaggtaggctatttttccacgtgagtcgacccctttacctttttcccccgttctttcctctcccctttctctgcttcctctctctactctgccttgcctctgcactcttggagtctggtcattagcatctcaaagcaaagtgagacccccgtctctacaaaaaaaataaaattagccaggcatggtggcatgcctgtggtcgcagatgcatgggaggctgaggcaggaggattccttgaacccaggaagtcgaggctgctttatcaactaagtttatataatattgtaaatcctttgttctcaaaatatgtctgactagaatgttttcctgttgactgttaattccatttagcagttatttattgaattccgactatgtaccagaatctgggtatatagcagtgagcagaacatacaaaaaatattatggagcttaatattatctctcttgtgtaggaagacagacaataagcaaaataaaatattgtgcattagaaggttgagtggcatggagagagataaaacaaagaagaatggtaagtagtgcaggattttctttttttctttttttttggagacagagtgtcgctctgtcgcccaggctggagtgaagagtagcgcgatctacttcactccagcctatgcagtctctgcagagaggctcactgcaacctctgcctcccgagttcaagcaattctcatgcctcaaactcctgagtagctgggactacaggcccacgccaccacacccggctaattttttatattcttagtagaaagggggttgccccgtgttggacaggcctgtctctaactcctgagctcaggcatccgcccgcctcagcctcccaaagtgttgggattacaggcatgagccaccacgccgggccaggtagtgcagttttaaatgtcattgttagtcataaggaaggtgacatatgagcgaagactttagggaggtgagagatcacagccatgcatacaactgggagaataggggtacgggcagaaggaactgcaagtgcaaaggtcttgaggcttagaagctatacatcagaatgggaaccagtgtggctacagaggactgagtctggagtataattgtagaagatgggggaggagggtaagacctggtatgtctttgtagatcgtgggactttgacttttactgttgtgaggtgggtagtacagcggattgacatgacctgatttacgttttaagaggattaatgtgtctgttggtgagaactgactgaaagggaaaccggttaggaagctattgtagttacttttctaaacaagagatattggagacttggaccagggtgaagcccaagggatggtgagaagtagttggattctagatctggggataccttggagctcttgtgggttcagttacagaccactgcagtaaagcaagtcacacaattattttttttttggttttccgttgcatgtaaaagtatgttttcctgcagatcctatggggcaaaaaagttatttttacattataccatagtctagtaagtgtgcaataccattatgtcttaaaaaacaacttacataccttgattaaaaaatactttaggctgagcagggtagctcacacctataatctgggcactttatttatttatttttttaatttgttgagacagagtctctgttgctcaggctggagtgcaatggcgtgatcttggctcattgcaacctccacctcccaggttgaggtgattctcctgcctcagcctcccgagcagctggtactacaggtgcccgccaccatgcctggctaatttttgtatttttagtagagacaaggtttcaccatgttggccaggcttatctcgaactcctgacctcaagtgatccatcctccttggcctccgaaaagtgctgagattacaagcgtgagccactgcacccagcctaatcttagcactttgagaggcagaggcaagaggattgcttgagcccaggagtttgagacctgcctgggcaacaaagtgagacccccgtctctacaaaaaaaataaaattagccaggcgtggtggaatgcctgtggtcctagaagcatgggaggctgaggcaggaggattccttgagcccaggaagtcgaggctactttatcaactaagtttatataatattataaatcctttgttgtcatttcaacagtgttcacagcatcttcaccaggagtagattccttctcaaaaaagcactttctttcctcatccataagaagccacttctcatccattaaaggtttaccatgagattgcagcaagtcacatcttgtggctccacttctttttttttttttttttttgagatggagtcttgctctgttgcccaggctggagtgcagtggctcgatcttggctcattgcaagctctgcctcccaggttcacgccgttctcctgcctcagcctccctagtagctgggactacaggcgcccaccaccacgcccggctgatttttttgtatttttagtagagatggggtttcaccatgttagccaggatggtctcgatcgcctgacctcgtgatccacccacctcagcctcccaaagtgttgggattataggcgtgagccactgcgcctggcccctccacttctaattgtagttctcttgcagtttctactacatctgaggtgacttcctccactgaagtcttgaattcctcaaaatcgtctatgagggttggaatttcttctttcaaactcctgttaatgttgatcttttgacctccttccataaatcatgaatgttcttaatggtatcttgaatagtgaatcaaaacctcctttctagaaggtttttaatctactttgctcagatccattagaggaatcactatctatgaatcactgtggatttctttcaagaacttttcatccagacacggtggctcacgactgtaatcccagcacttcaggagggcagagcaggaggatcccttgagcccaggagtttgaggctgcaatgagctatgactgcacctttatattccagcctggctgacagtgagaccctttctcagtagttgcattcacaacttggctagccgtttggcacaagaggcctggcttttggcttgtatcagctttcaacgtgtcttcctcactaagcttaatcatttctggctttcgatttaaaatgagagacatgtgactcttccttttgcttgaacacttagagaccatgatagggttattaattggcctacttttgaatattgcgtctcagaggatagggaggcctgaggagagggagaggagaaccaccggttggtagagcagttagaacatacacagcatttataaagttcaccatcttatatggccacgattcatggtgtctcaaaacaattacagtagtagcatcaaagatcactgatcacagatcagtataacagacgtaataaaaatgaaaaagtttgaaatatttcgagaatcaccaaaatgtgacacaaagacagcacattgttgttggaaaaatggtgctgatagacctgcttgatgtagggttgccgcagacccttagcttgcaaaaagctgtgtaaaacgaagtgcagtgaaatgagatgtgcttttataccttaaaggtggggactgcatgatttactgaaagataggatatatgggatgcaagataaagaggagagaaggataatttaaagtttttttgccaaacaattggaaggatggagttgctattaactgagataggtaagaatgtggatggagcagatttggaaggaagtccaggaattaaagttggaatatatttgtgtcaggtagagatattgaataggcttttagctattagtctactttcaggggagatttgtggctggagctataaatttgggtgttgacaccatatagatcatatttcaagctacaagagtgttaatttaaaaccattctccaactttgcagaaaattcaattctgcattccataaaaaatgatgagttcatatcctttgtagggacatggatgaaattggaagtcatcattctcagtaaactattgcaaggacagaaaaccaaacaccacatgttctctctcatagatgggaattgaacaatgagaacacatggacacaggaaggagaacatcacactctggggactgttgtggggtggggggaacggggaggtatagcattaggagatatacctaatgctaaatgacgagttaatgggtgcagcacaccagtatggcacatgtatacatatgtaactaacctgcacattgtgcacacgtaccctaaaacttaaagtataataataaaaaaaaattcaattctgcattaaactgaatctgaacaattagtgttttatttttattttattttatttatttttttaaatagagtctcttgctgtcacccaggctagagtacagtggcaccatctcggctcactgcagcctccacctcctgggttcaagggatccttctgcctcagcctcctgagtagctgggactacaggcacgcactaccacacctggctaattttttgtatttttggtagagactgggtttcaccatgttggccaggctggtctcgagctcctgacctcaagtgatctgcttgccttggcctcccaaagcactgggaatacaggaatgagccatcacacctggcccaaacagttagtgtttattgtatggcagatgctggaaatacggacttggctgagtcagatgagatatgttataagtatgaatcaaaatacagtgtgactgatgatagaggcatataatagctgatttcagaatgtagaggaaattgggaaaagcttttggaagaagtgtcttaggagatgtatagaatttgggaagagatgtttcctaggtagagaaagaggtgtcagtacaaggcaagttctggagattgcagggttctggtgtgactgaagcagagtatgtgaaaggtatggggaagggtagggtaagaaaataaattagaatctcatggaaggtctctaggaagctgtcttagtccctattgtgctgccataacagagtatgacctgttgggtaatatataatgaacagaaatttatttggctcatagttcttgaggttatgtccaagatcaaggggctgttgaggaccttcttgctgcatggtgacatcaagaaaggcatcacatggtgagagagagtgagagaaggtcaaactcatcctttattattgttgctttttgagacagggtcttgttctgtggcccaggctggagtgcagtggcacatatatggctcactgcagcctcaacctgctgggctcaagtgattctcccatctcagcctcacaagtagctgggactacaggcacataccaccaagcttggctaatttttgtattttttgtagagacagagtttcgccaggctgctcaggctgatctcaaactcttgggctcaagtggtctgcccgccttggcctcccaaagtgttggaattatagatgtgagccatcatgccagcccctccctcaactttttttttttttttatttgagacggggggctgggtgcggtggactcacgcctgtnnnnnnnnnnnnnnnnnnnnacatcctggccacatggtgaaactctgtctctactaaaaaaacgaaaattacctgagcatggtggcacatgcctgtaatcccagctactcgggaggctgaggcaggagaatcgcttgaacctgggaagcagaggttgcagtgagccaagattgtgccactgcactctaggctggccaacaagagcgaaactgcatctcccccgccaaaaaaaataaaataaaataagagacagggtcagctgggcatggtggctcacgcttgcagtcccaggactttggaggctgaggcaggcagatcggttgagcccaggagtgtgagatcagcctgggcaacatagtgagaccccatctctatacaaagaataatttttttaaaagagacagagacagggtcttgtgctgttgcctagactggagtgtagtggcatgatcatagcttactgcagcctcaaactcctgaactcaagtgatcctcccacctcagcctccacagtagctaggactacaggtgcatgccatcatgccaagctaatttttaaatttttttgtagagatggggtcatgtgaggttacccaggctggtcatgaactcctggccttgagtagttctcctgtctcagcctcccaaagtgctaggattataggcatgagccaccacgcctggtccatatgcaaatttttgagccaggttgtgacaggattggagaatttttttttttttttggtgtcagtatgtaaggtttgttggaagagggggcttatgaactggaagacaatataggagtaatctggtggaagatcagaatttctgacttggggcatggtaataagaatggaaaagtacagtgggatttgagaggagatatatttcacaaggttctgttttcctggtgcgaaattgatgctgaaggagcagtgttggggattttactggttacatttctaatatttgaaataaccgaaggaatttcatcaggttaggttgtccatttctgcactttgacgcctaaagtttctgtggacatataatcacaccagtctttctttgtttgaaaaatagtcatttggtagactaatcttaatctttgttattttgtttgaactagtattcttcctagaagggtagtttactagtgtttttactgaaatatttgtaacatgctgtagtagataaaatttaattataatttaaataattacattgttgcaaacatttatggatctttttttttttagttaaaaattcttattatccacgaaagtatgatgcaaaattcacagacttcagcttacctcccagtagaaaacagaaaaaaaaggtatttgaaagatgttcttgaatttgaccccttggtccctatgttactgtttcatatcttgcatttctgtcataactgtcttcagtgttttgcttccattattgacacagtggagccttgctataaaaaggaattttatggttaaacatgttttatgttttatgttaaacatgaatatagcaaattgggattcaaaaataatacataactaaatttttgtttcttttctgtggttttagaaatagatatatatttgatacttttattttaccttatttttttttagatggagtttcactctgtcgcccaggctggagtgcagtggtacgatcttggctcactgcaacctccgcctcctgggttcaagcaattctcctgcctcagcctcccagagtagctgggactgcaggtgcgcaccaccacacctggctaatttttgtagttttagtagagttggggttttactgtgttggccaggctggtctcgaactcctgacctcaagtgacccgcccacctccgcctcccaaagtgctgggattaaggcgtgagccaccatgcctggccatatagttgatacttgaacaacgcaacagttagaggtgcagtcagaagtttgtgtgtaacttttgactcctctaaaacttaactactaatggtctactattgactggaagtcttaccaataacataaatagtcggttagtatagaaatgaaatggtgtccacatatattttataccttcttgacatacttttttttttgatatttctaaggctatgtggtttatctgtgagtttttccaaattgtcacaaatctccaaaaaaattttccaatatatttactgaaaaaaatccttttataagtggacccttgcagttcaaacctgtgttgttcaagggtcagctgtagttatttttttctaaaagatgagctgctgtttttattctatttattttcagatcatttcaacatattctgtactgagtcttaattagataaccaatttgcaatctgctcataatttatattagcactatttggattaaaaaagtttaaaattatgcctgggtttcactaatatatttgttaaaaacaaaatgaaagaaagaaatagaataatctcttcattggaaatatactcacaagcttctcccacacgaaagggttattggaaacatcaaagtgtgtattactagaatgatagttatgtttttattattgattacagatttttcaccaaaagcctaattcctctctgtttttgtttgcagaaaagaaaggaaccagtttttcactttttttgtgatacctgtgatcgtggttttaaaaatcaagaaaagtatgacaaacacatgtctgaacatacaaaagtaggttttcttagttgtcctgaaactgatgtagcaattgtgcttcttctatctgtatatttggtagaaatgccaagcttgttttcctttaaagtttatagtttctgtagagatatagtttgacaacttgacagataggggcagtgaccctggggtttgaaagtggggatcccgctgcttcagggacgaggtaagatggtagcaaagaagggagctctgacagctttttgtatgtgtgtacctctactgcttgggaagaggctgtcctctcctctagttaccttgtgcatcttaatgagttctttcccctttaagtctgcccttgaccattaaaccatactgtgtaatgtggctgtgcctatcaccctcaaaggctggtccacaccttgtcaggtactagctagaaaactttaaccaaaatgtttaaaaggtttaaaaggaagcctttggttttgaaaggttctttttctgtttttgggaatgcccctcaactttaggaattaagagcatttcacaggtttattgatgtatgcctttgctcaaatggagaagtaaataagatatattattgtgccacatactctgagagtgtcattcctttgcctaaaggcagccctgttttggagtcatttttgtatgcagagataatactatacagatgggataactatgtaatacagccagaatatgtctgtgtatgtatagtggggtaaatttaacatggaaaacatttgttaaatagttttttttttcttttaaaaactcatagtgccctgaattagattgctcttttactgcacacgagaagattgtccagttccattggagaaatgtaagttctgtttttttatcctatttttaaatacatgctctttttattgatctgttatcttcacaactgtttatttatatacctaataataggtaacactaatggagtactttgtaaggattttgacatcatttattcaactttttcctcacaaacaactatggttgtttatattggccccatttaaaatattttaaaaaatgaattgcccaaggcctgagaattgattcttggacctcagtttcttgactccaaattgtatactgctttactacaccatgctgctacagattgtcacgtctactcatatctttagtggcctctctaggttttgattggtaagtcattcatttgggtgtttaatgtcatttgagagaatgggtggcatatctactttgtaatcaaaattatgttaccccttttccctctattaatagcactaattaaatacatgatagattcttcttcctttaaaggaaaagttataacacaaatagatacaacctgcttacttggttttaaaattgtgtccaacataagtttacttgtagaaacaaagtctccaagttagtcaaaagcatatgatattgcctcctgatgttcagcaggctttttccccctagatgcatgctcctggcatgaagaagatcaagttagacactccagaggaaattgcacggtggagggaagaaagaaggaagtgagtagagttcagaactggtgaaataactgttttactgtgacaaggcttattaatgtagttaaattcattgaattcccttagaatgttggaactagggaagaggaccataaggcatattatgtaagactattattgaacgtagttttaggaagacctaataagaactcttcatttaagtagcaaatgtgtcataatgggactgtatgttgctctttgaggggggctactgcatgtcacctgtcagatgttcagtggttgaggcaataatgggtgggtactcttaccaaaaagtgtattatacagaagtgtattatcacagaacagtacatctggcacatgactacccatgtcagtggatttaaactgaaaccttaaactaaggtgagctaagtacaaatgtaacctgctgctcaaaggagtttgaagtatctttcttgatctttaaggatagttcttcttgttttcatcccaggcttaccgctaaataagatgcacaggtgctaaggataagagatacaggtgcttgttcttaacaatgagaagatcaggaattcattcctatgattaaagaaatttgagcatcaccatgtaacctgtggttttacacttactaaggaagaaagtttagttgatgtctagctgtaatatacttgaaattccactagggcactgttatactgccttctcagaaaatactagaacacttcatcctgaagcagaagactatgcagaactactgtaatgatcagttgcacttttaaagtcaactgctcttttcctggaattaaaaaatgaagagagcctgggatgaaaacaagaagaactatccttaaagggcaagaaagatacttcagactcttatgagcagcaggttacatttgtacttggctcgccttagtttaaggttcactttaaatccactgtcgtgggtggtgatgtgccagatgtactcttctgtgaaaaagttagatgctgccctttaaggctttagaggtaattctgaggaagaccagcagaagcacgaagattcagaactgagaataaatataattcaacgaaagtgtatcaggtattaatactgtgtacaaaggaaagagttggataagggtgaagggacagttagaggaattcaatttttttttgagtcagagtctctgtcactgaggctggagtgcagtggcgcaatctcagcccactgcaacctccacctgctggtttcaagtgattctcctgcctcagtctcccaagtagctgggataacaggcgtgcacccccacacctggctagtttttgtatttttagtggagatggggtttcgccatgttggccaggctggtctcgaacttctgacctcaagtgatctacctgtctcagcctcccaaagtgctgggattacaggcatgagccaccacacccagctgaggaattcaatttttaaacaagtcaggtccaaccagtcaacgggacttggtggacataatatagcatttcaagagcatctgtggctagcaaatgaaggaatctaggccacctgtagtagagtatattagaatacctttttctttgatctctttggcaaaatcttacttatcgtgtaggcttgttttaaaggttgcctgacttactactctctccttacttttcaccacctctatgtcagtgctaccagagtgccagtctgtaacaaaagagcttgtaccagaatgtaaatcagtatattacttcctttgttgataagaaaaaaatgaaaaaataccagctgaactaaatatcatgcttagtgacgtagttgatttctactctggtgtgtgtggattggctggttgccagtccctgaaacacactaccctaaagcattatttactacctcctttgcaaatacatagcttatttatacaaccatagtacatttgtcacattacattgtagttggccctggtcttatacatctttaattctgctgtgctttgcacagtgcctagaatttagtatgtgagaaatacatatttgttgactgaagtacttaaacagtgtagtgtgggaatacttaaccttggcagtgataagggagccttagccaattgcaaggtcaaacttagaagttgaaggagtgtggaccatgctgtggtttaaatgtgtcccccaaaagttcatttgttggaaacttggtccccagtgtggcagtgttgagaggtgggaacctttgggaggtgatgggtcatgaaggcagaaccctcataaatggattaattcattcatggattggtggattaatggattaaaggagtagtgaattgtcaagggagtgggcttgttatcatcagagtgagtcaattataaagatcaatttgcctgtctcctgtgagcccccttgcccctctgctgccttgggcctctgcagagagttcccacccagccaccaaaactgtaagaaataaacttcttttctttataaattatccaatcttatgatgtattcagttatagcaacataaaatggactgagaccatgaagtagtttgacataggaattttgaagcacggtatctgaagttccttggcttctgtaggtagcttctttatagatacaaggttttctcctcatgacaccactccccaagtagctggactttttaaaaaatgttttgtttgttctgcttgtttcttttctatctattggttgtttcttcttcctcctcctcttgttgttgttattcttctttttcttcttcctcttcctcctcttcctcttcctcctcctcctcttctcttcttcctcttccttctcctcctcctcctcaccttcaccttcgcctcctcctcctcctcctttctcctttcttcttctccttcctcctttcttctcctcctcctttcttctccttctccttccttccttcttctttcattttttgcatagagcagtaatcaaacaagaagttaactccacttcgtttctgatatgtacattataaagagctgatgacgatggtatggaagattgtatcctgctggatgggatggaagtggcctaactgctaagacactaggttttttccccctactacttagcctggactttgatcagttagaggttggttcaacttattggtgtcagtcccttttataaatgtttaattctcttgaggggaatggtagcggttactagtcagcattgattgtaaagcaacttaaaagttatctaactaaacagttaaatttctgaagctttgagtttactgaagggtataaggaaggtctgaagtgacttcctgatttgccaacttcggttcttctatcttgtggtggtataaattaaataatttaaactgggaaatgtggaactgctattaaattaatggtaaccaactttactcttttctacgatgtctatagcactttcactctcccactatcctctgctattcccttgctcagcatataagaggaaggggacttcatctagtctggaagattagggtgtttcatgacaaaggcaggggtagctgaattcagaactaactaggaaaagataaggagaggcagggattagtggtcagacagaggttagcatgttcaaggaactgtgagtataggtaagagaaaatagaagctttacaaagatggcagttgtggggatggagagaactaggtggatgtagaacatttgggaggtgaaaatgggcagtgtttggggattaaatgattgtgaggttgaagaggagagaggttttaggagacttccaggtttctaggcttagcacctctatgaaaggtggttcttattactgaggtggggaacactggaagaggatgggctttggaggtattgggttggacattgttgagtctgaggagatcctgaggcatctatttgaagatgttgagtaggcattgggacttggaccagactagactggagatagttttttgagtcatgaaactgggaatatggaacagattccccacagagacagggtagagtgaaaagagaaggtagcctaatattgaaccttgagcccttccaacatccgaaggtctaatagagaataaaatccaacaagcctgctgagtgggaaccagagaggtagaagaaaacttcctctggaagccagtggaggggaaaattttgagaaggaagatatggttagcagtgcagattgcgatggaaaggtcaaataaaacaaaaactaaaagtgactgatgttgagacatacacagggcctccttgatgaggattccagatgattactccttggcctttctcctttgagctctgtgccatctgtcttcaagtctcacaccctccccagggattgattgcctttgtcactcgcccttggcatgttagatgctgcagtggaattgtgtatattttgaattcattcagtaccttttcactttcagatttctaacggccaagcctgagcaaccaagtgatacccttggtatctacaaaaataaaaagttagccaggtgcagcggtgggcacttgtagtccaagcctctcaggagaccgaggcaggaagatcccttgagcccaggagtttgaggttgcagtgggctgtgattacgccactgcgctgcagcttgggtaacagagcgaaaccttgtctcaaaaaaacaaaacaaaacaaatttccagtgcccttcaccttcatgcagtttcagccacttactttcatgaccacatcctggattctaaagttggacatactcctctttccatccgtccagctcactgtgatctctaccagggcttggaatagttgaggcttcccatcctctttaccttgtttttcttttatcttccttcttccttcacttcctacccagcctatttcacttcggctgctcttgtcgatatctcagcttccttcttccattatcctccattgcactcatctggcaaaatcccagctctggctcagttgctacatcctgttcaagaaaaccacacaattgaaatgtagtctgcaagtgaacacttgggcagtgctatctgacttaaggagttgacttgaccaaagagaagtttagggtattttctttgtatttgttgttttgtggtgcaaaattagatgttcaatatgcatatgtttcttagttatgtagatgactgtgtagtgtaaaatttaaaagtttgttaaactgattttatttttaatcagctgaaatgcctatgagaataaaactccatagaactggaaaccagaatcctataatgtgggcttaacttgtcttttctgattatttccatattatttgcttataggggctttttgtctcagtcaaacttgttatttatcatatctcatacagggtttgtgaactttcgcccttttagttttgttcgtgctgctgcttctagaagatcttacctactccatctttaaagttctgctcattgctcttagctcatctgaaatccatccacttttgggtatattttttctcatctgcctagagaaatgtcttgcccttctttgaatatggtatctcctttctgcctctttagcacagatatcctttattatgaccctgttggtgaacttctttgcatatgtgtcttttattcttgaattaagtgtgagctctgaaatgtaagaaccaacttttacctggctgcttctatcccatagtgccatagttatagggaatgcttataaatgttagtgtgtgtaaatggtgcttgaagatatttttcttatgggtataattctgttttggtacacacaagtaagtggttggagaagtcttactgagacttgtatttataaatcatgtttgagctgtatctttgttgtttttagagaaattgggcagaaatattttgatatgattaataattatgcttggaaattatagtgtaactaatagtacttaaactgctgtggttttgaacattaaattctcactacatagggtagggtagaccatcactgggacaaaccaaattcatccgtattttaaagtattaatggcttttccctacacgaatgtgaactatgcccccttgtggtttcgtgaataaatgattaaaggaaaaaatttccactggctagagaaactttggaaacattaatatttgaagatgaaaactagcataggcagcatgtatttatttaaagttcctgatagaagactagtttgattttctaatgttagcaagaaatctcagcaacctttgaatatatgttaacagacattttgcttatctttgcataacttcttgacaatagtttagtttgaaaattagaggtaaacattcagtatttgaaaggacaaagattttgctatatgtggctgagttcaccaaaacaaacactagtaacttcttgcctttaaggttctcactgtagtgtgaaatgaataaatacacatgaggtggccataagactacaagtaactgaagcattaattttagctatgtagggataatcctgactggtcaagggatatttgagtttttggaggggagggccgtctatttgtttttcaagacttcctataagaggcctccctcccccagtttatcttaatgtatattgtacatatagtgaaattcaccctttttagtggatagttctgacaaatatatactgtcatataaataccaccagaatcaagatatagaacagtgtttcttcacctggaaaaattgccttatgccctgatggcagcctcccctccacccactggcaaccactgatttattttttgttcttatattcatacttttgcagcaacatcatataaatggaatcatacagtatgtggcctttttagtctgactcacttatttttagtctgcatttgaaagttatccatgttgttgcatgtagcagttgtttgttttttattgccgagtattactcttttccatagtatggatgtatatcagtttgtttatccgttctcagttgagtgttgtttccagtatttagcctttatataaagtcttcataaacattcacgtataggtttttgttttgaatatagggttttatttgacttggataaatatccaggagtgagattggttggtcatgtggtaagcatatgtttaactttatgagaaactgccaaactgtgtaggaggatagttttaaatcaagataagcctatttgagcatggaaagtattcagataaaaggagatggtagggtgcagtggtgcttgcattagctagtcatgctctaggaaatggaatggcaaccttactaccatggcttagtgcaaagaggtgtcattttcccaaggttaaaaaaaaataaatccagggctgctgttgctgcatgacagtaccatggacgtaggctgtctcttgttgcaccggagtaggcggctctcctcttgcctgtcaccagaatgttcttgcatatgcaaatattaagccacagaataggcagaaagaagagaaaaagacaaaaggtacacgtagcctagtttccccccttttcactgggaaaacagtagctttgtttttatttccaaccaggagataatttatatagatctcattggctagaagtgggctgcttgaccaccttcagtggcagtggagttgatgggatgcctgaaacaaaattgttaaggaatgggggagaatagtcagtgtttgctttagttcttggtggcacagtggaatttcaaaactataagtgaattttggaagcggctctgtccttctgaataaaggattggtttgagcaagcatttaataggcttgctggtggctctttttatgtaggacaggtgggggctgaggggatagagtctagctctggtttccagaggtatgctatgacagcaggcagaagtgccttggaagaggaatgggcaaaatctgttgagggaataagtgaggttataggtttgtgaaatttagaggtgtttaaagagaatgaggaaatggggtgaagatggcaattttggatgaagtttatttatacctgtgatgttgctttgtttagtaagtgctctgaaaattctttgggcactgggtgagttcatctgaggttcttccatagtttgtttctcaggttcttgctctttaatatattctgaagagttcatatatattttttctgtatgtatattttattagaggatatgggaaatactgcttttcttttggtatgtttgatagatttctcaaaaatgcataaatactatccccactagcaattttttaaaaacctattatgggccgggcgtggtggctcacacctgtaatcccagcactttgggaggccaaggcaggcagatcacttggggtcaggagtttgagaccagcctggccaacatggcgaaaccctatctctactaaaaataaaaaaaattagctgggcatcgtggcacgcacctgtaatcccagatacttgggaggctgaggcaggagaattgcttgaacccagaaggcagagactgcagtgagccaaggtcgtgccactgtactccagcctgggcaacagagtgagactgtctcaataaaaaaacaacaaacaaaaaaaccctgttacaaaaatatacttactttctacattcctgtcattctcaatttttaaaaaatattacttgaactcctaaaaagagtaagttccacattggtgtggcagaatagtccttatttcatgaatttgatctttgtgtgagagctacattctttccgatgaagccactatattctttgacatgcaggaaaaataaggtctttatgtagttgctctgttaggaaaagcttgtgaaagatttcacagagtaagaattttaaagcttaaagaaaactgaaggtttgcttggcatatggcttccttatctttgacaaaagtacatctttgtccttacttctacatctctgtatttttcaggttagtcagactcaggggtaccgagtgtatttaatttaataacttttaaggctttccattaatagcctttcccctacctccccaaaaaagccaccaaaaaaagttattctttcttaattcctatcctatgtagtaccaatgctgtatgatttggctttagggaaaatgagtggtagaggtttgtttccaaaaccttgcttttattatagaaacagtggaacatttttcacagcagactgggagtccactaggtggagtagttttacaatttatttcaacgcttactgtggctctgaggaaatccttttgtttccctggttcatgcagaattccaacacaggagatctgctctaaagaatgctgtatctttttgatgttcagaaagaaaagtacaatagtgtagcttgtgtggaagcagttgtggtttaatgagagtgggaagagtaactatgttttatagaacaggcagaggggaaaagccaataaatgggtcgtgatttgagcataaggaaaaaattggagagaataatgtgaccagaatggtctgtgctaagataatggttaggacggtttgcccatgtgttggctctgtagtgcttaaagattgtcactggaggcataaggtataggcaatgaggaaggtgaagaagaggtaaaaaatgaaagaagagaggaaggaaaagagcatagtttcaggaccatttcctcttagtgaactgaggaaagatagaagtacagggagaaaatgattttagtagataaaaatatagaaaaaccaactgtgaaaatttcccttgtcacggtctttataacttcatattatccattctctaacaggagatattggactaagctttacatgtatgtaactgcaatgtaagacataatttatgttttttcaatagtctttggatttgttatttcttgtactttaggaacctgaactccttcatcagaactccttttttttcgttattcatttatctcagcttcatgttggtggagtggggcttcctactgttgtttatgtgtgtaattaggtcttgtgtttctgatttttcttttttgcgataatgtgctttttagcaaccatttttctctctagttttaaatatctggattctgtgtaaataagaatgtaataaattttggaagaggattttattgatttcagcaccaagaaaaataaaatcttacaactttttaaaactctaatcttacttttaggaacatgatacttaattttaggaagacaagtttccttacctttaggaacatgatatttaattttaggaagttaagtttctttacctttaggaacatgatactgcagtctgcctgaaagagaaaattagctgttttaaaaggcttccatcaaaggagtttctacacatcacatctttgatgtttcacttagggaactctttcttatatcttacctaaaatccacttgctataacaagtttaaattctttaccaatgaaaagcagttacctagcatctgctctctggtacgtagtacactgtagtgccaaattttatcatgtaacatatagcccaacatggtaagagtctgcaatactctgcaaaaatgttgaagaaacttaagtaataagtaaatttgagaattgtggagggtgttgagtagctgtgagttacatgtctcgccactgtgaggcctgtaaaaatcattactgtttttctcatttctacttctgcatattctcttcagtttgagaacaactggaccatcctctctgtaaaactatttttattgtcgcttctcatcttcttttaaaggttgcaaatagttcctttcatctttctttggaggttttatttttcatcctattaatcatctttgagtctcttctgaatcccttccaagtcttttttttttttttttcttctcagtgttcctttagtttagaagtacagaactggacacagtgccctgagattatctgactgcttttgagtatcctggaggaagatttcacactcgtacaagtgccagagtctacttcttataaccttagattatgtttgctttcgaaaaatgtagtcatgtattgctgactgtcagatttttatctcctatgaccttgatcttttccttttatgtttatttatagtttgtacattaatcatctttttttatggagtctatttttcttgactggatatatattgcttcacactgtcctcattgaaattcattacattttttttctgattacttaaccacttacccaatgtcatttccattcctgtctttcagtatggcccacccataggctttatatattgtctgtgctattcaagtcagtgttgcaaatgttaaaaaaaaaggcagaaggtagagaagtgtcctagaagcaatggcagaacacatttgttgatgtttctccaaacttactctgatcagcagccagacggggtagtagagagctgtgttcccttccttctatgttttttatactcctagaatctattgccctcttcctgaaagtttggtgtctgcatctccacacagctgtgcagagaaacaaagaaagcagttcatctggcacacttctgtcagatttcatcttaatcactgctttgtacatatctctccctgttcataactttctgtggctctctatcacctgctgaattaaatataaactttctagtttggtattcaagacacattttggcctgagtctccctttccagtctgattgcctgtaactgtgtttcataccatattaactacttgtcattgtccagatatctctttcactttttttttttctgtgagacagagtctttctgtgtcgcccaggctgaagtgcagtggcgtgatctcagctcactgcaacctccacctcctgggttcaagcaattctcttgtctcagcctcctgagtagctgggattacaggcatccgccaccatgcccagctaattttttttatttttaataggatggggtttcactgtgttggccaggctggtctcgaactcctgacctcccaaagtgctgggattacagacgtgagccaccacacccggcctctttcactttctgaagtcttggtttgtttgcattgtttggcctacttaacatactctgatttctgttaccatttaagaccaatttctttcatttcttttctttatggatttttccaattagatatagtctttccattccacccctaccccccagtctttataccctcttgggtacttttgtcttatgttatcactatttgtgtgcttttcttatcttcctggtagacagtatattttttattttattttatttatttatttatttatttatgttttgagggggagtcttgctctgtcacctaggctggagtgcagcggcacgatctcaggtcactgcaacctccacctcctggtttcaagagattctcctgcctcagcctcccgagtagctgggattacaggcgcccgccaccacacttggctaatttttgtattttagtagagatggtatttcactacgtaggtcaagctggtctcgaactcctgacctcaaatgatccgcccacctcaacctcccaaaatgctgggattacaggcatgagccaccgtgtatattttttgagaactgtctcctcctcgtcttggtaacttcgatatacctagcatgtatttgcataagaaattggatagacttggccgggcgtgatggttcacgcctgtaatcccagcatttggggaggctgaggcaggtgggtcacctgaggtcaggagttcaagaccagtttggccaacatggtgaaaccccatctctacaaaaaatacaaaaattagctgggcgtgatggcaggtgtctgtaatcccagctacttgggaggctgaggcaggagaattgcttgaacccaggaggctgaggttgcagtgagctgagatcgcaccattgcactccagcctgggtgacagaacgagactccgactcaaaaataaataaataaataagaaggaaataaaaggtaatgactagaataaattgaatagacttaaaaattttttttacagtatttataggtacatgccatatagatgaattaaatcagtttgagcacattgtatgatatatttgatttaaattccagtgtacacttgtctagttgcagactgctagcaaagtttgtggattagcaggtggtccacactttgagtaacattgttataagtacttttttccctcttaaaaaattgtagaagcagttaaaggtttataatttgctgtgttaggtgttaaacaaaattgctaaattcagcaattgcttgattgcttatttaaaattgtactctaaaagccctattataattaacttttattattttctagaaactatccaactctggccaatattgaaaggaagaagaagttaaaacttgaaaaggagaagagaggagcagtattgacaacaacacaatatgggtaagctccttatgcttatgaataatgaaaaggagcacaaaacaaaatcttaaaacccttatgtactcaattatgaaatctttgcttttgtaacttatttacttaaaaagataaatttatttatttttatttttatttatttatttttttgagatggagtctcgctctgttgcccaggctggagtgcagtggcgccatctcggctcactgcaagttccacctcccaggtttgtgccattctcctgcctcaacctcccgagtagctgggactacaggcgtgcgccaccacgcccagctaatttttgtatttttagtggagatggggtttcaccatgttggccaggatagtctcgatctcttgacctcgtgatctgcccaccttggcctcccaaagtgatgggattaccgcacctggccccatgcctggtaatttttgattggatacttgacactggaaattttacattattgggtgctgtattagtccattttcacgctgctgataaagacatacccgagactgggcaatttacaaaagaaagaggtttaactggacttacagttccacgtggctggggaagcctcacaattgtggaagaaggcaaagaggggcaagtcacatcttctatggatggcagcaggcagagacaggagagcttgtgcagggaaactcccctttttaaaaccatcagatctcatgagactcattcactcagtatcacaggaacagctcaggaaagacccaatcacctcccacctggttcctcccatgacatgtgggattgtgggagttacaattcaagatgagatttgggtggggacacaaccaaaccacatcaggtgctgtatatttttgtgtttctataaatgttcttgaacttttttctgggaagacaactgagttacttagaaacggtttcatccttctggatcttgcttttaagattttgttagatgaaaccagagcagtgtttagtctgaaactaactactcactactgatgtaatatcttactgggtatcttaccccatgccctgtgaaatatgaggtacaaacaggccctagttatgactcggagtgaagatgaggtgctgataactctgatccttttgggtcgtttttttcccccaaccttggatagtttcctgacaaatacatgccaatcagtcttctgctaaatagtccagggtaaatcctctgcaaatctctagagttctctctctttctgtagttttttcctctcaggtacatcctgaagctctagatgtcttgctctctctggtgtctcaactccagttcctcaattcagggattctaccaggtcccatctggattcctcttctccgcagtctggaaactctttaaggctgtaagcaagggcagttgcagggttcactattcatttattttctgtctttcagggctcacttctcttgttgcttcatgccctgtgtcatagagaccatcgtttattcattttggctagttttttggttatttcaggtaggaggataaattcagtccctgttactttattttggccagaaacagaagttcttaatggtgtcttttataaataaaaatttcaattttcatgaagtctgatttattaatcttttatttttatggtcagtgctgtgtgtgttctgccttaaaaaaaacttttgcttacttggagatcataaaactatttctttatgttttcttttagaagatttattgctttgtgtttctggtatatgtctagaattaattattgtacatagtgtagggtttaaggacctttaaaactttttcacatatgaattacagttgatccagcactaattgttataccatgcaaaccccaaccaaaagtaacctggtataacaatattaatgtcagaccaaatagatgttaaagcaagatgtgttattagggataaataggaatattttgtaatgttaaaagagtcagtgcaacaacaagaagacataccaattctaaatctgtatgtgtctagaacatagctttaaaatatgtaaagtgaaaattttgaaacacaactcttgagcagagagacaaaaatcctatacaaaatgttagcaaatcaaatctggcaatatgtaaaaatatgtaaaaatatgatataacatcatgactaaatgggatttattccaggagcatgtttatttatcacattaacaaagtgaaggaggaaaatgctattaacttaatgagtaaggaaaacagttcgataaaatgtaccacctgttcataaaaaagacatattagcaaactagtaatagaaaataatttctttaatctaataaaggatatctatcaatactctgtagccacatcgtacttaatggtgcaatagtgatcactcccccacctcccctaagattagaagcaagataaggatgtccagtgttaccacttttataaatgaatttagcaaggttgccaaatacatgtaagatcaatatttttaaaatcaactctatttctataaagtagcaacaattaaaaattgaaaatttaaaagataccacttagaatagcatcaaatgcctaggaataaacctaacaaaagatgtgcaagattctacactcagaactacaaaacattgctcagaaaaattcaaggcctgtataaatggagcaatatataatagtcatggactggaaaacaatataattatcttaattctcccccaaatccaattaattacagtcaaaattccagcaagttttttttttgttttgttttttttggtggaggagggatgggggagattgataagctttaaaattacaatgtgtcacttaatgacagggatacattctgagaaacgggttaggaaattttgtcgttatgaatatcatagagtatacttaaacaaacttagataatacagcctactacacacctaggctgtgcagtaaagcctgttgctcttaggctacagccctgtaccgtgtgttactgtatccagttgtaacacaatgctaagtatttgtgtatctaaatatagaaaagtttcattaaaatgcaccattaaaggcaaaaaatggtatacctgaatgggacacttaccatgaatagaacgtgcagaactggaagttgccttgggtgagtcagcgagtgagtggtgagtgaatgtgaaggcccaggaggctgctatacattactgtagacattacaaacattgtacacataggctacactaaattgttttataaaagtaattttttactttatgatgttatgacattactgggaattatttagctctgctataatcttataggactactgtcatatatgtggtccattgttgatcaaaatgtcattatgtggtgcatgattgcatatgaaaatacaaaggatctagaacagcaactaagaaagctcgagtaatgaagatagtgtggtgttgtccaaggataaatagataagtagagcagaatagagcccacaaacagatccactgagaaacaatcacctaacttatgataaatctggcaatataatgcagtggagaaaggatcgtgttttcaacaacctattccttttaaactttttgtgtctctatatttaaagtgtatctcttatatattatgtaattttgtcttcttagtaatccaaactgaaaatctttgccttttaactagtgcttagttcatttacgtttaatgtaattcctaatatagttgggtttttaatttgttcttcctttcttgccttcttttggatggaatcttttttttattaatctctccattttatattcatctacatttttatttacattatgccttttgtaactatttttagatggttgattacataaacttttcttttcaaatgattgtcaagtcgtggtataacagaactactcccttgaaggtgaaatagagtgcaaataacagatacactactttctcaattaagtcttatagatgtcattagtgaaggatcttcttaactcattacttattagtgaataccttaatgatgatcattcagaagctagctgtggtcagatgctgtaagagaaaagataacggggaaggcatccgtgaatgggagctcaaagaaagtggcatctcttcattatccttatggggccagtgggctggaggcagaaactagacctgttttctttgcagtgacactgttaggttcttagcctgacatctgtggatggacataggagattggtccatggctttctgcaaaatttggactatacatatatattaatttttgtaatgagattctccaagggttattatgaccctaaagggattaaaaatctctggattgcagatatataaacatgttgatttaacaaattatttcaaaaatgttatgatagtaaactaccatttattaagggcttaatgtgttatcttgctctgtgaagtactgtatttatattatctgaattctatgtccctataattcccattctgtttaaaggagtaaacaggcttaggcttacaaatatttgtacagcagacacagcccataactgacaaagttgagatttagatgcagatttctaattatttactgcatcctccattattaatgaaaaatgaattttgcccaataaatggcaaactgtcaaaagcctatctttgcaaaaactcagtcccaccaatgaataccttgtgttattgtctactatgaaggaacctttttttaactgtcttccccgcccccgcacacacacacacagtttaaattagaagatgctcacataaatacgtgctttcttttttttttttttttttttctggagacagagtcttactttgcccgggctggagtgcagtggcacaatctcggcccactgtgacttccacctcccgagtttaagcaattcttgtgcttcagcctcccgaggagctgggactacaggcacctgctaccgtgcccagcttattttttgtattttagtagagacgaagttgcccaggatggtttcgaactcctgagctcaagtgatccgcccaccttggcctcccaaagtgctgaaattaaaggcgtgagccaccgcgcccggccaatacttgctttctttctaaaagtagttgtagctgttgagagggcacttgatttgagctggctgtgaaattgcaataggcttatgtgttctgataggcctataaagcagagaaaatagtacctgtgttacctatttcagagggttcatgaaggtccaacaagtcatatttgtaaatgcttcagaaactttaactccttaaaaatgagtagacaaggccaggtgtagtggctcatgcctataatcctggcactgtgggaggctgaggtgggtggatcacctgaggtcaggagttcgagaccatcctggccaacatggtgaaaccttgtctctacaaaaatacaaaaattagccgggctgatggtgggtgcctgtagtcccagctactcgggaggctgaggcaggagaatcgctagaacccaggaggtggaagttgcagtgagccaagatcatgccattgcactccagcctgggcgacagagtgagactccgtctcaaaataaaatgagtagacaagagtgaacatactttataaactctgagaaacactttgagctgggcacagtggctcacacctgtaaccccagcactttgtgaggccgaggtgggcagatcacgaggtcagaagatcgagaccatcctggccaacatggtgaaaccttgactctactaaaaatacaaaaattagctgggtgtggtggcacgtgcctgtaatcccagctgcttgggaagctaaggcaggaaaatcgcttgaacctgggaggtggaggttgcagtgagccaagatcatgctactgcactccagcctgggtgacagagcaagattctgtctcaaaaaaaaaaaaaagagaagaaaaaagaaactttcatgtacaatagaagaatgaaataatgctgccagttaaattggcctttaatgataatacgacacagcccaatttcagagggataacaatatgggtagaaatttgcagcgtagaatcaagaaggtgtggtatattgtggggtgctgtccttctaaagttctatcataggcttccctgtctttgaaagtcactggaatttcttttattttcgtctctttaatgtactaggctacaagtgatcagttttacagctaggtttcttttgtatctagtagtctttttcaaaattttcttggaaggtcagtgccttttatattaaaaattgcaattttcttactccagcaagatgaaggggatgtccagacattcacaaatggcaaagatcagaagtcctggcaagaatcacaaatggaaaaacgacaattctagacagagagcagtcactggatcaggcagtcacttgtgtgatttgaagctagaaggtccaccggaggcaaatgcagatcctcttggtgttttgataaacagtgattctggtaagctaaacaggaaaataacgtatttataagtgtatagacaatgatgctgaagttgattattcacagccttgcttgtggaaagtttaatatcaaatgtataacaatgcagaatgatgcttttgtttttgtttttaataggagcatcttgtttaaaacgtcatttcagaacatcttttctgagtcttgggtgggcacatggggcagggaggctataggagaaggactgtatttgctggataattttcattagtatgaggtaatcttagaaatttcttaagattgttttgaatgtattaatgctgtgcattcaaatttgcccaaatatgtggattttccctttacctataaagcagcaattctaacggaagtcagtatactttatgctactgagcatgagcatgatctctgggcaaaaaatactaattcattatgtttgatcagtactgttcttcagagcatagattatatttatatatgtttgtccttgaatttcctctaaaacatatagggcaagttaacttgcttattagttgaaaaataaaagcattaaaatgctggtgtcacatacagatatcatttagcctttgagactccatttctcttcctgaaaaatgaaatgtgtatgtaaatatttttactacatttttctccagtaacattgtgaggctttatctaattgcatatgctttgtactgcaaaggaatacccaaagattattagtgagtgaattgacattagtgacattgtagatttgattgtaggctgtttagcttggatgatgttggcttctatgataatcacatggcaagtttttgaacttacgagtggcaagaaaagagaggataactaattcgttgactgaattaggatggaaaaagatcattgcataagggaacattaggctaagtagaagataaaatttaataacattaatgatgatatattaatatcaactaacactgaataaggcacttactgagctctatatgctttatatagatgaagtcttcttatgacagccttttacacatataccgttactgttaccattttagaaatgaggaacatagagactaagtatgtttatgccattgaaagtaatagtaaaaaatgcagttacttttgcatcaacctaatagtttatcttagtcattctgctcattagtggcagaatgagaatttgaacatatgagtctcactccaccagtacactacacatcctctaaatatgaagtctgaatttgtataaaaaaatattgtttgagtctaggatagttgagatgtgagagagagcaagaaaaaggcagatgatattttgagccagtgctgagtgtactcttgggcactgattttttgtttgttttctttcaaaaaattttagagagagctcacatgcttcttcagacttgtaatgtgtggccttgatgacaaaagaccatctgtactcaaatataagcttttatgtcattaaaacacttaaaacacaaatgtgaagactaccattataatcagtaagttactaatttgaaaattatgtaaatcttttactttgtgcaattttctaaatgaacacttgaaggactctaagaccgatattggatagtctttgttgttcttcattttgttaacttagctttggtagatggttaattctgttttccctttttatttaaaaaaaaaaagtatttcagtatatactaatctggtaaaacaccaactaaaagacgattgtatcttgcttctatttaagcttgtcttagtcctcagtagatgccttagacatgagaaacagtggtaaatcctctcatccttattggtagaaataattcagttggattctgaggagcagttgaaagagagatctcaggctgggcatggtggctcacgcctgtaattgcagcactttgggaagctgaggcaggtggatcaactgaagtcaggagttcacgactagcctggccaatatgatgaaaccctgtctctactaaaaatacaaaaattagccgggtgtgatggtgcatgcctgtaatcccagctactcgggaggctgaggcaggagaattgcttgaacccccgaggtggaggttgcagtgagttgagatcacaccattgcgctccagcctgggcaacaagagcaaaactcggtctcaaaaaagaaaaaagaaagagaaatctcaaataattttgttttggtttaaatgttgaaacccttacctataatgagggtcaaggatgggaacatgcctatttcgagtgtcaaagatgagaacctgtatcttgaatataaaaattacccatatagactacaaatttataattttgaatatttaaaaatttattaatttttataatattgtattataaccaaggaaatcacaatgccaatgatcaaattatggtagcttaagtttgtaggaaagctgtcatttaaattcaccttatcctttacctgggatttcctctggactttgacattttccaaatctgttttagaccaggggttcttaacccctgggcacagactggtacctggtacagttccttagcctgttaggaaccccaggggggagcggggatggggaggcggggagcagcgagcaagcatggcttcatctgtatttacacattccctattgcctgccttactacctgtgagctccgcctcctgtcagatcagcagcagcattagattctcataggagcgtgaaccctattgtgaactgtgcacgtgagggatttaggttgtgtgcttcttatgagaatctaatgcctgattatctgtcactgtctcccatcatcccaagatgggactgtctagttgcaggaaaacagctcagggctcctactgattctacattatggtgcattgtacaattattttatatattacaatgtaatagtaatataaagtacacagtaagtgtaatgtgctgaatcatcctgaaaccatccccaatccaccccccaccctctgtctttggaaaaattgtcttccacaaaactggtccctcgtgccagaaaggctggggaccgttgttttaggccataggttctttaacttttcactgcaggtatagctacagacaatctatccccctgttttcatatgtcctaagtcaggcttgtccaaaccatggcccatggactgcatgcagccaaggatggctttgaatgcagcccaacaaaaatttgtaaacttccttaaaatatgagattctttttttttttttttttttttgagacggagtctcgctgtcgcccaggctggagtgcagtggcgcaatctcggctcactgcaggctctgccccctggggttcacaccattctcctgcctcagcctcccgagtagctgggactacaggcgcccgccacctcgcccggctaattttttgtatttttagtagagacggggtttcaccgtgttagccaggatggtctcgatctcctgacctcgtgatccacccgcctcggcctcccaaagtgctgggattacaggcgtgagccaccgcgcccggccaaaatatgagattcttttgtgtgattttttttttttttaagctcatcagctgttcttagtatattttatgtgtggcccaagacagttcttccaatgcggcccagggaggccaaaagattggacacccctgccgtaaatattctccactctccaatatatgttttccacttgtttggaggcagcttctcttaccttgggcaagagccagccaaccttaaaatctggttattcaagttgtcagtggcaggccagcggccagcactgtgataacaagacccactgttctcatatggcagttgatacttttcagcactaagctcactttaataataaagctctccctattgcttccattttttgcctttttctggctcagaacttaatccagacatcagcactcacattttaaacaagactcaagttctagaggatcttcataactttcagatcatgcttggaaaatcattgcctgggttcaccttttctgtattgtatttggtgccatgtgtactctcagtaattgtgcagctactttgaattgagaattgacattgttttgatgggaaagccttttatttaaagaagtctcccaatttatcagttttgagtgtggcttattgtctgtcattagatttccttactagcatatttttttatttccttgtgtattctgctgactggcctaacttaaggattgttttttctttgtttattttggtatctcattagttagcatccagttcattttgttgccattgtttaaaatatatatgcaacaagtttatggctttcctagcctgtagttttaaacagtaagtcagttgtctcagctaggaagaaagtgggtcagtaaggtagcattgagcatctgtgactgaagtgcctcagcatccacaagacaaaggcaacccaacttattagtcatttgttgaaatacagctattgtcgtagaacactgggacgtaagtctaactatgcactcacgtaacctaggttgttttaaaggtaggcattaaaataagaaaataaactggcccagcacatcaggtgtcatggatacccactggtaactgtcttctttgagagctggagactataaagcaaagtccctatttttgagggtgactttgaaaatatattgcattttttaaagaatacttaattgcaaatcttgggctagagcatataattgtgctttgctccataaaggcaataggaaatcgtgggatgggggttggtgggcagggggtacggataagtaagtaaagaaataagttacaggaagaagccagataggaagcttttacagttggtgtttagagcggacaaggcattcaaagggcaatgttattttgctactttcctttcagtggggatttataaggtcctgcgtttggcttacccagcactgtaatccactataatgccgaggatttcaaaggagtctccctgccttccagaaactcatagtctaagaataatttttagatcattgcattagatttttttagggggggatggtgggaacatgatgtgtgtatacgagagaggtgagatttaccctaagaaaagtgtcgctaatgttttaatggtaaaagaaattgtttgagctcgtattttataaaaatgctaaagtctggttctgtcagatcaattgctgctatctctatgctggtattttcagtttagaaagatgttttagctgtttttataaaatgaagtttcttgagtattattttgtcagccagtacaatgccttcagcatagtctttacctataggtgctaaaaatgcctgcattagaactactaggtagatcccagggacttttctttctttctttctttctttttaagatgaaaagttactgtaggagatgttctgagagtgccaaaaggacagtatttttcaaagtgttattacatatggtttgtcccttaaacatttaactgagtggagaagaaaaaatagggaaagagttgtttatttgtgtgaatttgtaacttaccctttaggtaagtcaagtatagtgagctttgacactcctaggaacaagtatacctagcactctaattgtggtttccaaatactattctccaggtaaaggaaccagagcctgttggagaaatgactgattctggggttgggacagggaaaatataagctgaacctagagcatctcatagcgccagaaagtaagaaaatgctaaaaaaatgtgaagatgtgggtatgtcagaaggatactagaaagagttcccaagggccaaagttggaacaattggtgccacaaaataaataataataaattataaccctcagaatagaataaatacccatgagtctatactgatatgagtgcctaaataaataaataaatgtgggggaggagggacaggtctttcttacaaaataattctaattattaaatgtagaagaaatgagagaaatagcaagtcagcattagagcaccacagtaataattgttttgggcaagatccactgatgaatggtaaaattagtggtgaaacgttaaaatgaaacaatatttgttatagcctcaaaatatctccccccaaaatatttattaattataataattattaattaccatggttttaacatatgtcgaaaattctttgatattccttacttgagttgaagcttaattcttcttccctggagtgtgagctaaacttagtaactcatttcaagaaatagaataatgaaagagaaaaatagtaactttgtagtagagaaagcaggcagaccataaagtggtcaaggtcaacattgccagtaataagtcctactgatattatggacctgggttgtgatgagaagggcacatctctgtggtattccttctcaaaatccatagcctcagtctaatcttcaaaaatgtcagacagacccaaactgagggacattctaaaaatacctgacaataatcttcaaagtatcaagttcaggaaaaacaaggaaagactgagaaactgtcacagatttaaagaagattaaggagtcatgacaaccgaatgcaatgtagtatagcagattgtatcctggaacagaaaaaaggacgttagtggaaaagctggtgaaattacattacagtctatagtttaaatactagtgtggtaccagtgttaacttcttagctatcataaagtactttggttatgtcagatggtaacatcagggaagctggatgaaggatatatggagactctgtactatctttgcaacatttgtataaatccaaaattgtttcaaaatacaaagtttaaaaaagaagggaggagggaaaggacattaaagccttgccctcggcttcatgaattggattgtgaagaatacagttttccagagtcaatttccctttgtttttatttttttctgttattttctgattataaaagtaatatagaaaatgtgggagctgggcatagtggctcatgcctgtaatcccagcactttggaaggccaaagtgagcagatcatttgaggtaaggagttcgagaccagcctggccaacagggtgaaactccgtctctactaaaaatacaaaaattagcctggtgtggtggcacgtgcctgtaattccagctacttaggaggctaaggggagaatcgcttgaactcaggaggtagaatgcactgcactccagcctgggcagcagagtgaaactctgtctcaaacaaaaacaaaaacaaaaaaacagaattatcaagatgattgaagctgagtaaaataatagagaatggtggtcagaaaaggggatatgtgcttttatctgaagtgatcagtaaaggcatctctaataaggtgacattaagacatctgaatgaaatgcgaggctgatacctaagggaatagcagtcaaggcagagagactgccacagtcaccccagcctttagtgaccacaaccctgatcagtcagcagccagcaacatcaagacagtaccctccatcagcaaaaatatcacaatcccctgaagtctcagatgagttttagcattttttagcaatgaaatatttttaaattaaggtacattttttaagacataatgctattgcacacttcatatgctacagtatagtgtaaacataacttttatatgccctgagaaaccagaaaatttgtgtgacttactttattgccatattcacttgattgcagtggtctggaaccaaatctacaatatctccaaggtatgattgcatatcaaataactgtttggagttttactataaaagggaggaaagaaatggagctatagctgggagacattattagcattattgtggaccataaagacactttgataggatggcttcattttaagaagactttgtctgtgggaagcattctagctcactggtaacaatttggatttggagtcagatagccaggctttaaatttgacccaactgatttatagttatcttaaggaaaggttactcaaattctctggatttttgtttcatccctcatcacatacctcataaggattaggtcagatcatgcttttgaagagcataatattcaactattactgtactttttgttacctctctttgagtcttggaaataaatgctgcagttttttctttcatcattcagccaatgaatgggaagtctccatactaacactgtggtggatttctgcttaatctactagtaattcacataaacttcatactttcctttccctttattaatcaaggagtaaaggtaacttagcttaaaattgacaaggagtacttttataggtgtgatggtgtgtagtgaggagagaggatttagctccatccagcagaaggtggcagttgaacattcacatagaaagatattcccatttcctactggcatgctttggtttcccctagactgacttggtgaacattaaatgcttagtcttgaaacattttatattggttttaggttgagttggttaattaaatagacaaattacttattgtcttcagtgaggccttatttttattggttgtctagaatagagttactagattgttagagctgccaaaaagaaatgtaataggtggtgtcctggggctacaactaggcttgctgggcctggatcaaacactttatatttggcaggcactttagtattatgcttggtaaattctcatggttgccttgtttatttaagttcttagaagttttaaataataaaaactttgagtgggctggtcacagtggctcacacctgtaatcccagcactttgggaggccaaggcaagctgatcaacttgaggccaggagtttgagaccagcctggccaacatggtgaatccgcatctctactaaaaatacaaaaaattagctgggcatagtggcacacgcctgtgatcccagctactcaggaggctcaggtaagataattgcttgggcctggcaggcagaggttgtggtgagccgagattatgccactgcacttcagcctgtgtgacagagcaagactctgtctctaaaaaaactttgggtggattaattccagcattactgtttgactaagcctatagaatgctttgaatattatttggatccccaaaaacagtcttaaaaacagttaaaagcataggtattttaatacttcatttatttctaaacctaattttcagaggcagtgatcccaatccagtgaagttaaataaagtttgggtcttcctactacctgtaaatgaacagcaaagactatgtaattaagttaatttagagtatgctcagattgtataacctgtgaagcatgctaagtaactgagctctatatagcttccttttccctcactgtctcctctggggcaaatggtttcttggcccatgaagatgtctaaaccaaggggaagtgtttctggccccctagaattagtcttttggaaagattaaggaaatgatcagaaattacttaattttcactaacaaatgagggaatgggggatggacagcttttttatggtggtagatgttttgaatctgacttcttttcccttcagagtctgataaggaggagaaaccacaacattctgtgatacccaaggaagtgacaccagccctatgctcactaatgagtagctatggcagtctttcagggtcagagagtgagccagaaggtaagtcatggtgtgtgttgttacagggttttgttttgttgctttttgccttttgtgcatgctgcgcattaataacatccaggatgtgcatcctttatttggttttcaaattccttttccatttgaatcagaagtaaagttaacatgggttaaaggaactctggagtaataaagaaatgtgttgctactctgggaataaaaaggcaaaaaaatacaatataggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaatacaatataatgaaagaataggaaggaaaagaaaatatccactaacagaactgaagaaaattctaaacgaaatggcaaaaagaaaattcatttttttctctctgctctgaagaacccttgttataacgtgtttatagcatctttggtagatggagagagatcttttatgacaaagagtgtgatacaatttttttaatgcatatagggcattgttcttcctagagcatatttacataaattatctcatttggaaaacacaacaaccttatacttgtgtctgcattagcttgtgcattttaaaggtcggaagaaattgaatcttttcaagagtctttctgagaagtcagtaactttcagaatacatgtcttacctttaaagatgatgttacggatggtaacgtgtgaggcttcattgtgaaatttaattgtgataaaccagtttaatttccttcagcatctctttcagggctacctgaaagagccatgagtaggctcttgatctgatgcagtgtagcagtttttaatccaaggtttatatcaataatccagcatatgtttaatgaataaatctatgttccactgttgtggacacctggctctgtgtggtcattttatttagactttaccagccgtgagaaaattcatgtctatgtctcaggacaagatgtgtaatcaaagtaggagctgtgctgagaataagaatacaggtctaaaagtgtttatatagaatgaagagaagattcaaatgtaattggatgggccaggcacggtggctcacatctgtaatcccaacactttgggaggctgaggagggtggatcacctgaggtcaggagttcgagagcagcctggccaacatggtgaaaccccatctctacaaaaaatacaaaagttagccgggcatggcagcacgtgcctgtagtcccagtacccaggaggctgaggcaggagaattgcttgaacccaagaggcagaggttgcagtgaggtgagattgtgccactgtactccagcccgggtgacagtgagactctggctcaaaaaaaaaaaaaaaaaaaaaggaaatgtagtttgatggagatggcagcacttttaatgttgactaggctagagataatcaatgtttatgtatttggaagatgttgaataaggagccgttaggctttaatatgaaaaatggtgtttacatgtatctgtaacatgggaagttttttcttttttaagtgggccatggcttactatggtagcttcttaatagctacttgaattttgaaatataagctactttggctttatcacagtattccttaacagatggttgcctattttaattttaagaaaaatagcatttttttgtgctcttgtttctcatacattggtgtgaagatggagttattctttaaacacatattacatttcctgcttatcagttgtattcataacaggtgatagcaaagaaaactattaccagaattacagaatcccataaaaacaggctggactaatgcttgcttctctgtttcttaagatggaacagtatttttatactcatgtcttcattttgagactgccatcattttaaattggaagaaaggaaactggaagggatctttgagatcacctctttattttatagaaccttaagcatagaaaggataagcttggtcgggcacggtggctcatgtctgcaatcccagcactgtgggaggccgaggcaggtggatcaccggagttcaggagttcaagaccagtctggtcaacatgatgaaaccccatctctactaaaaatacaaaaattagcctggtgtggtggtgtgcgcctgtaatcccagctacacaggaggctgagacaggagaattgcttgaacccagaaggtggaggttgcagtgagccaagatcgcaccactgcactccagcctgggtgacagagtaaaactccatctcaaaaaaaaaaaaaaaaaaaaaaggaataagcttggcaagctggtatgtagcagacctgacatataggtttggagtcttaaaagtccgaagaagccaactttcattgccttccattatagtctttctctctttggcatttactgtcatcctgcacaataatgcgtagacttttcttttatagataacaaaggatattatctgttaaactatatataagattttgtatgaatgtattttgactaattgttaaaatgtcctgctttaaggaaaaaacccttgcttcacattcctaagtcttaagaattattttatataatttgaattcagctttattaagccatccaggtcactagcaaatttctagctttcagtattaattctgggctctaggatgggatattgacacatagggagttttaaataaataataccaaggaaacaaagtggtcttttaaccatgaaatagtatctagaaggctgcttatttacctggattctaaatatataggaacaatctgtttcttcctgagtttaacaattgtgtcttcataattaagatctgtcttgacttaagaattagcatgaaagtgtttggaatcttaaacatggatagcatttttctggaaagatatttaaacaaggaaagtgtccctcaagtaagactgaagcaaaggaagaggtaatactcacatcagggtctgtaagaatcactaagatacaaatttaataagaaatacttccaaatgggttggtttaatatctattctgcatgttagcattttagcatttttttaactgtgttagaatttaagcacagttttacaactccccaaaattatgtttcctcaaactgatttggctataatgggggagatttccaaattaaagactatttcagaaggccacaaaccaaaaagggtgttaaatgtttgatagaactgaatgagctatatttaaaatttaattggtgaacattacattaatatatgatacttatctgggaaatgttgtaaatctcaagaaagagaaaaatataaatgttagtcccgtcctcatttcttagcagaaaattgacaattataagctctgattcatttgactttgtgttcctgaattgagtgatcgatacttgaggggaagggaataatagaaaatagtgtcctggtttttcttatttatcatctctattttatagatgaagagatttaggtagagataagtagcttgcccaaaggtcacacagctagtaaatgatggaactaggatttgaacctaacagtctggcaccagagtctgcttttaacacttgtccctatacttcttttcaaatataatttctacattcagtcctatgtaatgtttgagtattatgggttttgccactcttgtctaggcaattgaaccctgtctcccaacttctagaatagaattctttatatcatatcacactgattcatagtaagtaaatagtataactattggggagtggggagaggtgaagattctgagcttaaaatttgtgaattttcaactgttcatatggtttttctcctttattctgttaataatggtgaaatgtcaattgattttcaaatgtcaaaccagcctgtattcccaggataaaatctacttggtcatggtctattacccttttaatacattgatggatttgatctaatattttattaaggagttttgcatacatgttcatgagggatattagtctatggttttcttttattgtaagagatttggtatgagtagggatctatttcctcctcttttttaagggtttgtgtaggatttctaccagtttttctttttgtttcttgtttgtagaattcagtagtgaagccatctgaacctggcattttgtttttgggaaagttttaaattatgaattaaatttcattaataggtccaggactattcatattttcctatttcttcttgagtgggttttgatgatttgtgtttttcaaaagaatttgcttcacctaagttgttaatttattggtatatagttcataatatttcctgtgatatctgtaggatctataatgatgtcctcctcttttatttctcaagttgttaattgatttttttctctttttctcaaaaagtcttggtgcatttattaattttattaatcttttcaaagaaccaacttctggttttgttggtttttctctgttgtcattgattttcactctaatccactgattttcactttttagtatttcctctttcctcagaccctacacattacagtagaagcatagataattgattttagacttttctcatttctaatttaagcattgaaagccataaatgtaccttcatgaactgctttagctgtagtccacaaatatgatacattatgttttcatttttatttatttcaaaatatttcctaatctctcttatgatttgttctttaactcttggattatttagaagtgtgttgtttagtttctaaatatttgggggttttctagctagttttctgttaatgattttagtttaattctgctacagtcagagaacatatctctatactttcaatttcttcaatttattgatacttattttatggcccaacacaaggtaaatgttcatatgaacttgacaagaaaatgtattaggtcgggtgttctttgtcaatttgagttaatcgttagtgatattttgtatccctacgaattttctgtccaatttttctttaattactgagattggaacgttcaatattcaatcataataatggatttgtctaattctcttctcagttctatcagttttcgctgcaatgcatattgaaaatctgttcttaggtgttattctttgtcttattgacgaattgacccctttagcattatgaactgttccacttcatccctggtgatgttcactgttctgaagtcttttttgtctgacattaatacagactttcggcgttcatgtgattggtatatgcttggtatcttctttcatccttttgacttctttgttttactttttaggagttggtctgcagtttatagtatgcagcttaacttttcatcgtgtactttcaaatgatatctacttcacatgtaatttaagattttacagtgtatactacttacatattccttctgcctttttactattgttgtcagagattttatttctatagatgttataaattgcacatacacttaatatttttgctttagttttaaaattttgccaatgaggagaaaaagtcttttatatttattcacatatttactttttccagcacttatccttcctttgtatagatccaagtttccatctggcattatttctttcatagagatcactttctgtagctcttcatggtagtcttctcaatttttggtagttacagcttccaatttgaaaaatactagaatacattataaatgccttgcaaaaatctttcatagttttaagttattaagtgaacaatattatggctaggaggattattatggatttgttggttgcttttgaaaggtctacctgttttgttttgttttgtttatttttgtgtttgtttttcatcacacttagaaactcccatcaagactgaagcagacgttttggcagaaaaccaggttcttgatagcagtgctcctaagagtccaagtcaagatgttaaagcaactgttagaaatttttcagaagccaagagtgagaaccgaaagaaaagctttgaaaaaacaaaccctaagaggaaaaaagattatcacaactatcaaacgttattcgaaccaagaacacaccatccatatctcttggaaatggtaaattatttttctttaggttctaatctttgtgttctcacatcataaagatagagccactggggtgtgtgtgtgtgtgtgtgtgtgtgtttgttttaaggttaccagagacacattgaccttggagactttgtatcttaattctgtagctacatttggcatatagctggtatattcagtgaatgtggaataatgtaatttttacaaccacttaaaataaatttaggtttcactagttggtaaggaagtatctactgaggtttattgactttcttttaagtttccagtgaaagcacagctaaaagtacaatggcaagctgaagggaaaaaaagatttttagtacaaatgtctattgagaaccatacagtaacaaaaaggaaaggcctaaggttttctgacaattctcatttgttatcttctgggattgtcttccttccctccctcctccacctattttttttttttttttttttaagagttgaggtcttgctttgtcacccaagctggagtgtagtggcgtgatcatagctcactgtggcctcgaattcctgggctcaagtgatcctactgccccagcctcccaagtagctgggactatgggcatgcactaccatgctaattttttttctttgtacacctttatttatttgtgtttattctgtgcattcgtggctttattctcagcattatgtgctcaaaaatctaatagctttcttcaaattataaagaggaagcaatgcatcttcaagttctcagtagtggacatgaagctgtttgaaaatcaaagattttcatgtctaagcaatagaagtattttacattttttagtggagttataaaacttgacattctgtgaaaagtctgtttggttttgacttacaagttaagtacttattttgtagctaaagtgttcagtggctacactcttgaggtgctacatgtagcacagttgcttcctattaaaatggatctgaaatatacgctccattttgtatacatagtaaattacattttaaaaagttaccttataattggtaaattaagtgagctttccactgaaagtttctgtatgatgtttctgaactctatcaataacaccagaaaataaaataaattcctttttggcaaactacatgtgattccttgattatgtgcttgttctaaataccagggatttttagctttcttttaattacaataagcacaaaaatggaaagttataaaagtcaaggaatgttggaagtttttactgctattttcattgttacatgtaaatagatgtacttaccaatttctagactgcttatgaatttgggtttgggcaatcctctttgacataattttagattaaagaattgcagactttttagccgggcatggtggagcatgcctgtaatcccagctactcgggaggctgaggcaggataattgcttgaacccgggaggcggaggttatggtgagctgagatcgcatgattgcactccagcctaggcaacaagagtggaactctgtctcaaaaaaaaaagaatcgcagacgtttaaacctattttcctgtcctatgctagatactcttagagaggactccaaatataagcgttagtactgtttaaaaagctagattgtcttggctgggcatggtggctcacgcctgtaatcccagcactttgggatgccgaggcgggtggatcacaaggtcaggagatcgagaccatcctggctaacacggtgaaaccccgtttctactaaaaatacaaaaaattagccgggcatggtggcgggtgtctgtagtcccagctactcgggaggctgaggcaggagaatggcgtgaacccgggaggcggagcttgcagtgagctgagatcccgccactgcactccagcctgggcaacagagcgagactccgtctcaaaataaataaataaataaaaagctagatagtcttgatataaattaaaaggacatgttcttgcatcgttttttagcaaaatagtgaatataatacatatttcttattgttctgtcttctttatatggtgagggtacatgcaatattttagattgtatttcccagatataatttatttactacctcatctttttttaaattgtgttttagcttctagctccggacattcgacatgaaagaaatgtgattttgcagtgtgttcggtacatcatcaaaaaagacttttttggactggatactaattctgcgaaaagtaaagatgtataggcatctggtgtttcagcatacataactgaagcatgtgaaacagtatcatcctcgttagtagaggaaaaccaaaacccttttttccgtcaaaattggatttgtaattaaattgtaagcctcgtaggatgtatgttggaattttaagtctttcctttggttctatgcaaataaaaaaataactgattttttaagactgtgtctgtattgttgggattgaatctagtatttgctgggagaattttttctttgtatttattttaatgtattgttctcatgtaagaatgactgatgttgtgttagttaagaattgaagataggtttagcagtaaagaagaaagcttttaaaaggattgattcagctaagcaaagttgggcagagaaatacagccattttgtttttaatgcagaaaaggaagatgttctgtagcaagggggaatattttaaaaataaaccagatcaaattaatacaatcagaaggtttcgaaatgtaaatattccttatttaagacatgtttaaattcacctactagcacgacttacatagctcaaatattgaatgtttaaaatattaatacagatggggcctctttatgtttagataaaattgaagtacttaattgaagctttttaaaaattgtaaagtaaatgaaagctattgagatctttttgtctcctataataccagggaatttgagcttgtgttctagtcattgtactagctgtagctattggtctgtccttttgacatacagctaaaagggactaaatttgtaaaaaattagtttgttatagttgaagattaacttttcctaacattgtgattattgaagttcatgaatcttgctgtcaaggaagaaaggtaagaaagctgatagctcctccatgttggtaaaatcctctccagaatcttggaacacctggcatgtgaccctagtgacgtcacagacctgagatgaagattcatgtttagccagtgttttccagccttgtacccaccatacagatctgtttattctgtttcaccctactcctccagtgagccccatattttgggaaattatctgccttatacattaactaattcaattcatgtaacactgttgagtgcttactctttgtacctctattgtgcctatattaaaggtatacaaataaataaggccatgtctgacttcaaggaactcagtttaattttgatatattcaaagatgtgattcccaaccaactcaggatgaagtaactagtgttacaactgagttgatattctaaaatataacacagtttgtacttttattactagttagcatacacattttataggcttatgggttaataaatgaattcatggactcctggactactttcattgatgaccatatctccagggatgttgttgatccccacactgccttaaggtatattatataaacagttttattttccgtttttcttgtttcctgataatcaatgtatttaggactgaaaatacttctgagtactcccttggcagtatgtctgacagtctttagctatggtgactattgtttatttttaacgggtatttcagattccaagtgtatttaaaatttctaaggagatataatatagcctgtatggtttctattttatggaattatatggtcaatatttgtaaatattctatgagttttgggtgggtagaggggtgctttgcctgttttgggtacaggtttttttggatttagcttgttaattgttcaaactttctgccttctacattcctatcttattgttcgtttaatcagtttctgaaatgtaagcattacatgactattggtgagttgtgccttttataactgaaatactttactttttctcatatcctctataattgacttctattttccttaatcaaaccagctctgggaaatttaatacatttatattaattgagattattaaaacatttggactattcctggctgtcttactttgtattttctatatatcatgctctcttgtttttattttgtcatcttactggcttgttatttttttctccttgttattcctccagtggtttggaagtaattaaacctattgctatttctttagtgattaccttttttctttaagtttagagttaattagtagccacatcttccatccatctcccaattaagtcagtaaccttagcattgtttcacttccccacctcagcctctttttgtgatgtaatcagatacgattttagttttagattaatccctgggatcttggtgcgtatgtgtaaatagttattaggccactgtgagttttactgttttcttctgattgctttctcttgcatcccaggattagttttctggtgtgctgctgcatatcttcaagtaattaaatgttgaatcttcaatttaaagttttttaaattgagttatggttttagactcaaaatcattttcctttggaattttgaagctataacaatcatttgctgttatccagtattgttgattaaagtcacaccaatccgattacctctctttatttattgataagtaacctattttttcctcatgaaaaacttttggggttttctttttatgcttggagtcctaaaatttcaccaatttgtgtctagatctctgggacatttgtcattcatgctgcttacccccacggtcctttcatctgagtcattgtaccattcttgtactaaaaggcaattttaaataagatttttaaaattatttttcttaggtggatgtcaaacctattaacttaccctctacactatacttctgtattttgtcttgatctatttattctgaaagatttcttcagatatcaccttccagaccactaattcactctttgaacatatccattaccttattattcagctcttctatttcattttaaatttagtaattctttattttttagagacagggtctcactctgttgcccaggctggagtgcagtggcatgaccatagctcactgtaatctcaaactctggtgctccagtgatcctcccacttcagcctcctgattagctgggaccgcaggcacgcacaccactattagcctggctactttttaaatttaaattttaattttttgtagagatggagtctcactatgttgcccaggctggtctcgaattcctggccccaagtgatcttcctgccttggcctcccaaagtgctgggattacaggtgtgagccacctcgccttgctagtaatttgtatttacatattaaagattgctgtctctaattcttttttctcttctttttctttctttctttttttcttttttgagacagagtttcactcttgttgcccaggctggagtgcaatggtgcgatcttggctcaccacaacctctgcctcctgggttcaagcgattctcctgcctcagcctcttgagtagctgggattacaggcatgcaccaccatgcctgactaattttgtatttttagtagagacggggtttctccatgttgattaggctggtctcgaactcccgacctcaggtgatctgcttacctcggtgctgggattacaggtgtgaaccaccatgcccagccccagcccctccctcccccgcccccaccttttttttttttttttttttttttgagacagtgttttgccctgtcacctaggctggagtgcaatggcactatctcggctcactgcaacctccacctcccgggttcaagcgattcttctgcctcagcctccagagtagctggagttacaggtgcgcaccaccacgtccggctaatttttgtatttttagtagagatggcgtttcacgatattggctaggctagtctcaaactctcgacctcaggtaatccacctgccttggcttcccaaagtgctgggattacagacgtgagccatcacgcccatcctctaattcttgtttcatacatgtagtacccttacatctcagaggagatcaatcag

SEQ ID NO: 14895 - DNA, 7353 bp, Human
  misc_feature (1)...(7353): n = A,T,C or G
tagaaaatggggaagaggaggggcttggtccctgttccaggcactgggtttgagggctggacacccgagatccctgggaacccctctggctatgggaggacctggccccatcagacttcagagtctctccctggcaggtgacccaggcctgcccagacggaagccattcagacccagagccacgtgtcctgggtctccctgccccgggccacccgccaccacaccccagagcttgctcaccaccgggaggcgctcttgtcctggaccagcctagcctgggttgggacctccagccaggccagtcagcgagccaccagccccaccagagtggaatgacagccaggactcagctggcagcgggcaggaggccagtcttgtggtgatatcccagccgcaactctcttcctgcccctcccctgtcctgacggcagcccccagctctgtagctgagccaggcttgcgggccacgcggggtcccgggtttaggcaccccacccctatctgttccaacagactctccctctcagcccatggcacagatggcatctgagctagcagcacgctgctgcttcaggcaggggttgataggaggtccaggtggaggagtgggttctcaggactgccttggcccccctgcaccgctgccctccttctccctgcctctcaggtgcctcccggctccctgggactcactccctcaccttggcctctgcctgggatgctacccggccacccccaccagccctgacaccagtgctgcccactagcccctgctgctacataggcatgcgcctcccccagtctgggctccttgacccccgggcactggggaaggggaacaaggaagcagtccacaccagcccactcccagggctcgtgcgcccccagcaagggatgggccacagaatccaggaagaagacgggctccggcccccagtggtcgccagcagccccgtagaagctcaccaccccaccccatccgactcactcctgctctcatgtacatttcccagctccccacccgggctcaccttcagaccagcggcagcgctcacccaccacgcctgccagggaagctcagtcccaacagaatccagagagggcccaccacatgtgcctgcctgtgacggcctgtgacagggccccagccagggccaacgagctggaggggcccaaggagctgggtgcagcgctggggtaacaggacagccccacggggtgctcccgagtctggaccagactcggggtggggaggcccagactcggcggggggcagacttggggtggggggattgctgggggaagttggggcctctggcaagggatagggcctgtgctcaagcccaaaggtgccccaggctgaaatgggcacccaggggtcactatcagagccccaacagctggccatgggggaagccatgcccagcaaacctggccctcgggaccctgcgggccagatcaagtttctctaccttggcctgagcttctcatcaacacttcacttgctgggcgtttcaggaccaaactctcagggtggaagtggggcttgtgtccccttctggggtggcagggctcggaaagggaatgatggtaggggctgtgagatgtgggtcctggcccccagtgggaagtcaccagaggcctcggaggcgggcatggctgaggaacacagcccctgccctatcagggccgctgggttggtgggccctgccagcaggaggagggtgggcaaggtccnnnnnnnnnnnnnnnnnnnntgggcaaggtccctgccagctctgtctctgggaccagtgggcaggggcctctgcctcacccccacgctgcctcagctggggcagcaggcccaggcctcttgcataagcgccctgtgggggacgaggctgcagctgtgcctggccaccccatcccccagcatcacgagtgttcagtgggctgtccccgggccctgggtggaggccaagcctggcccataaataggggtctcctcagtgccctccgctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaaggtgaggggctttcctgcgtcatccccaagggctacaggaccctgtcaggggaagggcactttccggctgggtcttccccctgggaggagtgagcgaagtcccgcagtgccgggcagtgccggccagggactgagcgggcgcgcaggaaggaggctgggtagccgcccgaggaggctgcccgcgagaagccctccctgggcaccgcgtcccgtctcccctgatgggccacgcagacaccgggccacacacgcgcccacgccagccagacacgtccacccctgtgggcacgcgacccccagaggacacacgagcgcacgttccacacctgggtgccaggacacgggcgggtggggcacagggatggcgacaaacactccgtgcgcggtgggggttgggagggacgcgcaccgcacagacagccggcgacgcgcgctctcgcccgggagctgctcggggaagcgccggagcgcgggtccccgcgccgcgcgcccctccctggcgtcgaggagaaccccagcggtccgcagagctgagccgaagacccgccccgatccccgccaggaatgcgacgtcctctgccgcccgctgtatgggccaggcgctcagccagggcacagaatcgggaccgggggcggaggggccgaagctggctggtgggcggcgtgcgagggtgagggactgtcctcgggaggggcgtggccagacgggggtgctgggtgtcaggggcgtggccagcttctggggctgaggcgtgaggggcggggccatctccgggggagggggaagtggggcgtggtcatctcctggggcggggcgtgaggggcggggccacctcccggggcggggccggggcctgatgggcgtggtcagctcctggggcggggacgtgaggggcggggtcagctcctaggggggcatggggcgtgaggggcgcggtcagttccctggttgtggacatgaagggcggggccagctcctggggcggggtcgtgaggggcgtggtcagctcctggggcggggatgtgaggggcggggtcatctcctggggcggggatgtgaggggcgtggtcagctcctggggcggagatgtgaggggcggggtcatctcctggggcggggattgaggggcgggggtcagttcctggggcggggcgtgaggggcgtggctgctcgggggattgggcgtgggggcggggccgggttggagaccggaggagtagacggcagaggcgcccccgcaggtaggcgcaggtgggtccggagggtcctggccgacgcgggtgggggtcgctcgccgcagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggtgggacagcgggcaggtgggtttctgggacggagaggtccagggacaccctcgggcctaacccctgaccctgaggtcacccacctacaggaaaaaccagtgtgagacccgaaccatgctgctgcagcccgcggggtccctcggctcctacagctaccggagtccccgtgagtggggcctccaccggccccctgggcccagcctgggggcgacacttgccgggacgactctgggccagccccctgccgcggagatccatggggtgggaggtgatggctgccccaccagcgtcagaggcaaaggccaggcctgggcgtgactacccatgcacaagtgttagggacagagagacccttcctccagggggttggatcctctctggagcccaccattgtcttgtcaggccccttccctgccctctggagttttccccacataagcagccccccaaggcccctccatatgcctcctcccaattctcctccccaggacccaggggtttcctcactcccacctggggaatggctcccacggggaaacctcttcacttccggttctggcagcgacttctgcggctgcaccaggaatcctggttttctgagcctggctcccccagattctggtttggggacagggttcacaggctgtgcaggcgagagcagggcactggctggagagcagccgggtgggggagcatcccgggccagccgaggggctgagtgcccccaaagcccacaggtgcaccccttccctgaagcagaggtgaggtttggggggctgagtccccgacagggttgtctcttgggttcccagactggggcagcacctactccgtgtcagtggtggagaccgactacgaccagtacgcgctgctgtacagccagggcagcaagggccctggcgaggacttccgcatggccaccctctacagtacgtgccccgtggacgccgcccacacgcaggcctgaccagagggggctccccaagacccagggcagggcacacagcatcccccccgctgaggccagctccgtctccaccctgtcccaggccgaacccagacccccagggctgagttaaaggagaaattcaccgccttctgcaaggcccagggcttcacagaggataccattgtcttcctgccccaaaccggtgaggggtcctaatctgatggggagaggatcaaggtcagattagaggcaggcaggcagtctcctgactgggggaggcagaggggaggaggtggccccgccctgctcgaggcctgggccagggacagagggggtgagtgttcaagtcagaacctccctcccgcagccccttcatgaggagccccctccatgggggacatggagaccaggcgcccactctgtgccaggccccagcagctcccaggatgtggggcttcagcctggtggggggcatagggtagagggtgcccatgggggatacaggggaaccaaccatactgggctcaggcacagcctcctaggggtggacagcctgctcttggcagaggtggagaaagaccctctctttgtttccagtgcccagggagaggtgggaggtgatgggggatctgtgcagtttgggggctcagtcaagacgagctctgcgttacgggaggaacaggaagcccagtgggaaaattggcctaagtctggggttctgacgacagcccctggcttctttcttggcagataagtgcatgacggaacaataggtgagccactccattcattcattcattcattcattcattcattcattcattcaacacacatccacccaacccactctgcgatgggatggatcagggccccaggacagcctggtgctgcagacccatccttcccgatggctgcagtccagggccgggcgggagacactggggctgcccacattgatgggtgcacaggtgtgaggctcagaaggaaaacctgtcccagtggctggaacagggctgactcctgaaggctcatggttggggggtgcaggtgcgaggccccaggcagacaaggccaaggggctataccacagggaccacctggcagcaagggtgtctggctcctgggctaggaggaaaccagggtgggggagacaggatgggagggaacaggggatggaaggggagggccaaggacgctacatggatgccgtgggacagctcggagagcaggctcagggcggattcacccaccacccccaggagggaggcctaggctggagctggagtctgtggaccctggggctgggaagggtggagtctgtagaccctggggcagcggggatccaagccccagggatggatcttgctctctcagcggggctcagtggggctgggggcagagaaaagtccccgtagcccgcacctgctccatcgactggagtggaggtgggctggggtagactgcagtcctccatcctagcctttcggtcacacccctcaggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagtagagctggctcctggctgtctgcgctgtcatcacccgtcctgggcctggccctggccacccggacctccccctctaaaatctcagcctgacgtcaacaaaggaacaggccctctagtgtttgctcccagtggggtcttgagtcaggacagctaggagggggtgtccctcactgtctcccacccaccccacacagtcgtgtgcccctgccccacagccccacacgtcgagccataccccctcagctgccactgccaccaggccggtgctgagctgggggtcagtgactcatctaatcccttaggcaggtgccctgcacccccaaccccaccctgtcaccccctcagcagtaaaggcctgaggctcgaggccccagaggagctttggacctgttgggtatcttgaggtgtgggattaacgcactgagattgggcagagataagggtttcaggggacaaaaagaaacatttgtttgaaacatgccagagtgtctccaccccgcatcaggacagactgacagagtgggctggggacaggctaccccatatcccttctggctccctgagcgccccctgccctctgacctgggcctccagatcacagccttgtccactcaccagagccctggcaccacggccacaccatgcccggccagtgccctgcccaaccctgctcccttccagattcccacccaggcagccattctcaggtacacaatgtgcaggactcactgtgacctgcccaccaggcccccccgaggcagaccctgcagaggcaccaagcattttgaggctcggaggtgagggtgagcttctgggtggccttcccggagaagggggcttagggctgtgcctgagctcaaggtaggggggattccaacatcccagaggggctgcagaaggccgaagaggcaggatgggtgagctgcaggccccctcgcccagaggcccgtcagaactaccctcagctgccaggcatccggccccaccccggaggaaaggcaacggatggctggggttgggtggagggagccaggccagagcgctgcagggtgcaacttgatcagaagcctgtcacagtgggtgcagtcccaggccagccgccccagggcac

SEQ ID NO: 14896 - DNA, 135030 bp, Human
  misc_feature (1)...(135030): n = A,T,C or G
aatctggcataactcccaccgttctggtttggaaaattaggggcccttattccagagaaagaactgagaaaggagcaggtagaaggcgtgagggtggcacggggcatgagctcaatccttggcaaggtgaattccagacacctgcggcaccgtgggggcggtgtgtctggggacggtggtggtcagcaggatgggctgggctagggatccgcggtgggcacggtgagagctgagtgggcagagtatggaggatgcagtcagcccgtcaggaacgtgtgtgggttgagaggctgtgctgtggggacggctcctcggacccctgggtggaggagcccggatgcaccggccagagggacagcctgaaacccaatgcagtctctaggagggatcaaagcaggagccacagagacggaaagaaaataaagaccaaaattcatggatgagacttggcccctggggggccctagatgaccttgatgagagtattttccctatggggtgaatgtggaagccaggctgccaggtactgaggtgggagcagcaggaggggaatacaggcggagtcagacgacctttctaactcttggctgcggtgggcaggaggaaaactggtggaactaacaaggggcgtgagatgaaaggtgttgtgtggttcaggtgggacagagttgaatgtgttcgcttgcttgagggaaaccagccggtagcaggagaggttgaagcaagagtggagaggggaaggtgcgctgggtgaggggcgaaggtccacagggcagcggcgggcctgagggtaggggaagcgccgcctggggagccggggcgggctggggtctgttctcctgaagaaggccagctccgcagtgaagaagaccgtgtaggtttcttggaaggtggaggcactcgacgacagagctgagcaaaggcaagttagacagcgcagcgccaagcccgagacggtcaactgggagccgccacacacaaggaacagtgatttctccacgcccacggctggtgtccacgacttcggcccggccccctcttctgacctccttcccccaagtacaacactgcaaacgccaagctgccggctctggccctattggaggggtctcagtaacggagggcaggtgccagtctcgcgccctagttcgttcctctgctacaacgccaagttcgaggccacagtgccttctggaagagttgttgtgctgcttgggagcactgcacaggagaaacgggggctggaggtaaagacaggaggctcgggaggcggcgacgtgggcgagctggaatagtctagaagctgagcagaacaaaggcggtgtgactggtgagcctcggagggatcctcctccctgctagaatatgcatgatcctccgcgagtcttcgcccgccaggagcagggacgcgtccgagccaacacggggcgcgcgcccagacgcactttcccggctcggggtgcaagagagccaggcggccgcggcgcagcggaggggctgcgggcccggaacccaggccggtcagcgtgtaagcgccccagccggccgggctccgtggggggtcagctccctgacccctacagcgcggtagcgcctctccgagagctccgggaccagcggcccggccgcccccaaagccagcctccctctcccttccccgcaccgggatcccagaccagggagggggcgcacgtccgacggctgaggaatagcagggcgcgagccggcccggcaggtgcccatcgtcgccctctgggaccccggtggcgcgctctgtcctccgcgccacgctcagccaccaccccggctgtttgggacccggcacccagccgagcgcgccgccccctcggggacccgctgggcggggctgagcgaggcttggagtgcgggcgaagggacgtggggcgaacccggggcgctgcgccacctcggctgtctccagcggagaccggcgccctcgccccccgtctccgttcattgtgctgtattcatccagcagattttgaaacaattctcgtgtaaaaaggcattttactccgcgcgtcttccttacagccatttagttgggagtttgcggtgggcagggggagggagaagaaacgcctgctctgaatcggaaaacaccgaagagaccagaccatctctttcagcagcaggaaagagaggagccgtcgcaggagccgcacacgtctccaactctctattgctttttgcgcacattcctaacttcctgacgtccatcccagcgggcaggcatggggtgtttgggcggcaacagcaagacgacggaagaccagggcgtcgatgaaaaagaacgacgcgaggccaacaaaaagatcgagaagcagttgcagaaagagcgcctggcttacaaggctacccaccgcctgctgctcctgggtaaggccgaggggcgcgcggcggctcccggccccagcggagcgcacagccaggagcggcgagcgccaggctgggcgggcagggccgggcgagggtcgcgcgcacctctgggccgcggagcccagacggcggccggggcgagctcctccagccaggaacccgcgtgtaggaaatccccgtgctgggggaggaggattgctcagacccggctagtggtgagagatggcagcgatatccggacacagatcacagcgttctttctgtttgtttgcaggggctggtgagtctgggaaaagcactatcgtcaaacagatgaggatcctgcacgtcaatgggtttaatcccgagtaagaatgttcagtttgcttccaaactgcatgcaaacttcgtctctctcccagacgtcccaaaagtgctttctctaaacaattttaatttatttgataatggagtagacattcaagggggaaaaaattagatatttgctgttggatttggtatatttaggcaaatccttcttctgctagtgtctaatgaaaaaaaaacttgcttaacaaaatatgatttataggtattcttggagtgttgatctgtattactggtattgctctgagcacacttaaccaatatctcgatatatttttttcaatataatattatttgtttgcatctatttcagtttataactgtcaacatattatccatgggatagatctaggtaaaatacatttacaggtgtaactgcatgttatatttatatgcaatatccatagcgattttgcctagtttttctgtaacctgcatagttgtttaaagctatagatttttaaaaaaatgtgtgcattcaagtttgtttagagtacaaattagaaaagaagggtgctttcctttcccagataaaacctttgcggatgtcttgggggttgatactgacctctagtgaaaccagtctaggtcagtgctgtagctggaaatttaaaatcccactcaattgattggaatcagtgctaagagtaaattaagctaataacaactctctttcaatacagggaaaagaaacagaaaattctggacatccggaaaaatgttaaagatgctatcgtggtaaggacttttttaaatgattgtttactagaaaggtcaagtgctcttcattctaaaactgtgtagacagaaattacatattgtagattatcatacatggagcctaaatgtttatccatattttttttcttattccattttagacaattgtttcagcaatgagtactataatacctccagttccgctggccaaccctgaaaaccaatttcgatcagactacatcaagagcatagcccctatcactgactttgaatattcccaggtaagaaatgcttactgaaatattctaactagtgaaagatggaaccatttttaataaggtttcttattgagaatcaatattgatactaattcattattaactttcttcgaaatccagctctctaaatgcataagaggaatacttattctgtaccaaaatatttgtgtttgttaaaaatattaactacggccaggggcggtggctcacacctgtaatcccagcgctttgggaggccgaggcgggcagattgcctgaggtcaggagttcaagcccagtctgtccaacatggtaaaaccccatctctacgaaaaatacaaaaaaattagctgggcatggtggtgtgcgcctgtaatcccagctactcaagaggctgaggcaggggaattgcttgatcgagggaggtggaggttgcaatgagccgagatcacgccactgcactccagcctgggcgacagagcgagactcccatctcaaaaaaaaaaaaaaattaactacaatgggattgcaagaaatgcttttatgagtgtatggggaaggctgataatcgggaaggcagcatacctttaagaaatactgatggtgctttttttcctgtctgtattcttaaactaacaattaagcagtttcccagataaaaacagtagaaattacatgagtagagaaaaatacttatggtaggtaattgcttccatgggaattacagaaagagcagaattcagtttactttgaagatgcacagccttcagatcaattgagaaaagaatgcattgtataaaaaatgatagcatggatcacttctgaatgtttatcatattaaaatgcagtttggttcacatttgcattatttagggctgcttttcctaatcacttggatggcagtattgcttatgcaaaagagtgacatcaatcttagttttctctcatttttcagaatatacatttctttaaaatatttggtcatttcataaagcatgtttcaaaggaaaagtatttgttaagcttctcagaaagtcattttcatttttgttacagtgcaccagaagtgagtgtgtatgtgtgtgtgtgtgtgtgtgtgtgtgtgtgtatgtgtattcatcaataacagtctttcaaaatttgtattgcctggcatggtggtttggagacatttttcattcttagaatcctctctttgaagggaagcatgtggagaaaccaatatgtaaaacagagagaccccgccctgcctgcaagggctgtggcccctggctcaccccaccccttctctacagagcaccattgtcctgtgggctctgtattgggatggctaataagaatgactttgtttcttcgtttgtttgtttgtttgttttgagatggagtctctctctgtcgtccaggctggagtgcagtggcgcggctcactgaaagctccgcctcccgggttcacgccattctcctgcctcagcctccctagtagctgggactacaggcgcccgccacctcacccggctaatgttttttgtatttttagtagagatggggtttcaccgtgttagccaggatggtctcgatctcctgacctcatgatccacccgcctcggcctcccaaagtgctgggattacaggcatgagccaccgtgcccagccaagaataacttttttaaaaagcttttattttcatcctttaatatgatttttgcttctgataagcatgccagtgtagagccagtgatatctgtagaatttctaaaatggaggagtgaggagtggcacactggctggaagaaggggctgggcatctggccccatgtctttaactggatggcttggagagggcaaggggttgacgtggcaggggaaggggtcggcagaagatgctccagccacaccaggatcctctgctaactggaggtgcagatgtcctcccggttctcactgatgctatgtacactggcaaaatcacccagaactacatggtcctggttgaaatcaggagtggtgttccctttcaacttcagatttagacatttatagaaaagcatctgagttcttggatttatcctatcatgtttgcctagaagtaatcgtaaaacatcttatatatttggggggaaatgctattcttaacatctagtgagaaattaaaattaagatttattaatcggtcccatgtcttctttctcctgttcataacagtctcacggttgatgaggcatcccatattcaaccccaaatccagaaacaattggtaactcccacctatattatctaaggaatccaaaacatctaatttgtgaaagtgtttttggagctaaatcatgaacatttttaattaaaaacttgagaaaccatttgctttgaatgcatgtattttcagatagataaattaaggttacttaaaagttattttcagaaagcataattaattatcattacagtaaaggagaatttagcaccagcagatgcaaatgtaattacagtgctctttcagaggtaatacttttgtgggggttagttttactggtgttttttaagcctaacattctgttgtcttaaatgtctatgcacatgtcaaatgagagtatattttatatatatatttatgtatatttatatatttttaacatagccccgacttatgacttatataaatcaggaaattaatgttaaatatgcaacattccttctgaaaatgctatttttaattttagtatgcacagaattttagtgacatttatttcatagtgcttggaaatatttatattacttattaaattatgtagttcttggtttcatattttgatgatcctcattcagaatgatatcaagacaaatctgacttatatgctccattggaaaattaacttttatttaaaagaatgtatgttttttataaacatacaagtagagctaaatcaagtattttaatagtaaacaaaacactgttttactcagtccagtacttttttgagattgaatccttgagaaagcctgtcagtgtcatggttcaattatttgagggtcttaagttaattttcctgtaggggtaagataacttttgaaacaaatacattatattaaagttaaaaattaattttagggttcttcaatttaagaaggaaaaggagaagaataacttatcttagaaacaaacatcttgagaattttctctgagaatattgcacatgggggaaatacgggtgggttgctctttgggtcttttgctctctgtggtgtctttcatttgaatttcagttgaattccatgaatctgaagttgtaacagaaagcaggcaaatgtggttagtacctatcagccaagggctgctgtggggaggtcagagagactcagaggctggatcttatcatcagccttacaggccaggtgtgtccagacacacgaagctttggagggttctaagcagtggagccatgagatctcattgtgtttcatcaagatcactctggctgtggatggagaacggattgtggggaggcaggagttgaaggagggcaaccacttcggagactagtctaataatacagtggaaaggtaatgggagagcttgcagtgggaggggatcatgggggtggagaaaagtggcctgagttgggatttattttggaaacaaccatttagacttgtcggcatgtggatatgagtactgaggggaaatagatcaatcaagaatgactctgagcgtttgggtctgaatttctgcatagaaggtagaaacaggttgggaggaggcaggtatgaggaggttttgttttcctggtgagttggagatgactattacgacatctaagtggagacaccaggtggacagctggatgcgtgaggccccaggaggagccattgcagaaggaagggatgtcagcggtgggcagtgctgaccggggagtcaagatggacattaaggttaaaatggctttggcggcttcaaggtcaccggtgaccttgataaggacccaggtggagggtattgaggagagaatgtgatgtgagtgggtgcaggtggcggcggcagattaggctttctggaggttttgctgtggaggaaggctgaggagccaggcagcagctgggaaggtaggcaaggtcaagatgaaagatacaaaaccctgtctgaatgaaaagggctggaatcacttggtaaagcaggagaaaatgacaatacagaagaaagaggctgtgtatggcaggagtccagtcctcgagaagaatggggtccggaacaaaaaaggaccagaccaactccccacttgagaaggcagagaacaggtgcagacgcaggtatgttttcagatttggtggcagagaggtgagggagggcttgttagcaaaggcttttcaagcaaattgtgaaagcaaattggtagcttacatggggatgatcgtctagttttgcaattatccataaactggtattgttcaggttataatgaacagtgatggatgataaaattcttgtgacctcgagctcacgtgatacagttattcccttcacaagccagaactgtaaaggggagtttcataccaggtcaaagcaaaaaataaaaaaactccagttatcttcacagcaaaccggcaggatatttgctgcagaataatgtgaaatctttggagacaaggtcagcatatgttaaattttaatttcaaatgaaataacacaaacatattttacaacacataaatcaccatagaaaagtactgggattagctacaaataatgaattgacagttgcctgattagagtttttctcatgaatacacccaaagcttcaggttatctttgttcaaggcttgactccccactccgtaagcccctcactagttggcactatgtcttagcagccaaattttgcatagcagccagcagatgcaatgatgcaaaataaatagtcttaagtgattatgccaaaacatagattagctgatcatttatgaaataggaaaaataggccgggcatggtggctcacacctgtaatcccagtactttgggaggccaaggcaggtcaatcacctgaggtcaggagtttgagaccagcctggccaacgtggtgaaaccccgtctctactaaaattagaaaaattagccgggcatggtggcgggcgcctgtaatcccagctactagggaggctgaggcaggagaataacttgaacccaggaggcggaggttgcagtgagccaagatcgtgatattccactccagcctgggcaacagagcgagactccgtctcaaaaaaaaacaaaaaggaagaaaagaaaaaagaagaaaaatgttgtggttgcctcctccaaaaatcctttagcactataccaagcaaaatcactgttgaattcaattgagttattcatttgtttcatttttattcttaaaatgtggatactttattagctcttttcaaattgtattttgctagttttttctaaggggaagaggataaatcaggctaaacaagaaacagaaaagcagtctgatctgttggtcagtactttgccattaccacctggtgtttcctaaattattacccagagagcagaggtcagtgttttgccttcctcccaggtgagagctactctgtcactttccaacagcagccccaagtcaggaggcaccctgtgtggctaacgtctgagtgttcggtcagtgtgcaggcaaaggaggccacagtggcctgggccaaggccccgagagccagacggcctggtgtgactctgagcaagtggcctacacccactgcagcttgggccctgcatagagagccaagtgcggtgcccagcccagggagtgccatgcagagctccagcggctgctgccgtgtgctgccgcctctccttgggagatgtgtgcagaatctccagaatgcggtcagattcttccgcacaatatctgtgttccctctccaagcctgtgtctatctcctgctagaaggctttgtgctgtgggttttcgtgtgtgtgtcttttttttaaccaaccaagctgaagcccaccgtgtaaatcaggtcagcatgagttcctccacggcagcctctacttgggttccctgcaccctgggtgaccattcctgcccagtacctcatcaaacccacctcccagtgccatcagaaaatgatggggctggctgtgttcgctccctgaggaccaggcctctttctccaccgcctcctctccccgcagctcgctcttggagtgcatctcctgctgggtgcgctacaaacaatctccatgtgcctgctaacttaggttatgatagaatcctctgaatccacttcagtaaggacctgtgggcacaagaagtcaggggacaggccaattgggatgtcacacagtgtgaaagaacatgaggtccccacacatacagcaaaacagcaaccacctaattcaaaatggtactgaaattgattgccccacagccatcctgttctttgccttttgagctagtgaggtctggtgcatgttttatgggagaaaggcaacatttgagctggtgtaaaaagggcacagtaaactttcgccttctgcagtacactgaacctcttaaagacgcttgtgtctggcatggaaggaaaaagtaccatgttttccttccagtattttcagatgtaattaataaatggaaatttattataggggcccacttaaggtctcactgcccctctgctgggtctgtcttgaatgggagtcactgggagaagggtctttgggcttggcgcttcccctgggtcttcataggggctgaggcagggctggtaaggagcccctgcagggggacacaagggtggacagggtgcagacacccccaggcctgggattctgtggacagcatggtgtttgtatcttgaaagggggtcttaaggggaggtgtggggccagcccaaactgtgttcaaattctagccctgccagaccctttgtatgtgaccttgagcacatgacctcattgctatctgccttttctcaatggtacagtagagatgatggcaacacctacttcctgtggctgatgtgaggattaaacatgttaatatctaaaacagtggctgggacatgggcggtacagctttaaaatgagcaatcctgctctgctggaggaagtggagcagagctagcgccattcttggcctcgcctcagttgctggggctggttggtggccccacctcagtccacacggcccccaggtcccgtggtctgacatggcttactgtccactcccctctggatccacggggagtcagtcgcaccccttagctgtcaccgcctgcacctccacctcaagccagcatttataggcagtcccttctgtcccatgccaagagctgacatgcctaacacttcacagccctcctgggagaaggcacccctagttttccccaaaggaagtgaggcccctgactgctcaggaatcctcatccccatgccctctcagagcacaggttctcatgtgggagtcccccaggctctctggcaggttaccatggacctcccttcctgcctgttctctgttaccagcaggccccagagctcggctctccttctctttctctaccttattttcagttggattttctttgctaacattggccttgctctttcccaccatttcggcttggcctgtgtcctggccttctgatcctgtggctggcctagtctcaggttctttgaggctgcctggaactcccctggattttgcagatttctatgggattttttgcctctctccctaggcctgcagtttctgcccagttttgctgcaagttccaataagctgcagcctcattcttttgtgctcaccgcagtgcacctttgcttcgtgctgtctagtggtagaaaggtgaaatgcaccctgactgcacccctcacagggagatcatgctaaaataaatacttcacaaatagttagatgtcctaaggcatgttctctggtttttaaaaaagtcctaggaaagacctttttttaaaatgcacaataatctttcttgttctaatttgcacacctggttgctggaagcagtgaacgcctgtgtcttaggctcagggctgccgtattgattctatagggcctaacagaagtcccactttgcagaggaaaacagtgatgtgtgttgaaaatagatggtgcgtgaggcctcagggaccatttggcctgacagccccagctgaggacagggaggcacaggaggtggagagggagaggcaacatggaagttgatttcatttgccagctgtccatggagcttcccagtagttggcgaagatggaacgtggcttcctgagctgcctgtctttcccgtgaaaggttgacatcacagagtagtccataagcaacagttttcagtggggccacatggaggtcccgaagctcttctgccagcactgtggaggggaagcgggtgacatggaagaggtcacgtggactgcccttgcttcagtaattattcagtacacatattatccatcttgtggacaccaagatgaataaggaacagcacttttctacctctggcagggatacaggcttaagaaatacaggtgtgtaaggctacatttaaggaagttcttggggccacctggggacacccatgcagctggcgtcacactgagctgaatcttccttgaatgggacgggcttagagggcaggtggacatagagaggacagtgcttcagggtgggtggcaccttccctgcagaccaaaagcccagtcaggccacggcgggttagggagagtcctgcgagcctggccaaggggcctgggcttcctcctcaaggctggggagaaccattccacggttttctttgggggagtgacaaaaatgcaaggtttttttggaaggatcacttccgaattcataaagagaccaggctttgtatctgctgtggggatggtgctctgggaatttgtctgtcattggacaaagggcatttcctgtaccagaaacctgcttccaggtctcacatggcttatgtcatgatattaaggaggagggaaacccccactgagaataagtattgtattattctgcacatctgagatgctaataaaaggaatttttattattatagtaaaacatttcagttagatagattaaccgtattagagcttcaataaagatacttttcttaaattccatttttttctttgcaatattatcataagaggtactcctaatcaatgttagctttttattttgaagtgattttaatctttacctgaacaatacaaaagaagtaccgaatactgccatgtgtccttcacccagattcatcgatagctaatgtgtggccacattcatgctctcactctctctacactaacacacatttttgtgaacgatttgagagttggttgcagacatcatgcccccttgcctctaactacatcagtgtgtatttccttagaatgaggacatccacttcacttctgtaaccacagcacaggtatcaaaattaggagatttaacattaatacgatatctttttttttttcttttttgaacagagtctcgctctgtctcccaggctggagtgcagtggtgcgatctcggctcactgcagcctcccaagtagctgggactacaggcatagcccaccaccatgcctggctaatttttgtatttttagtagagatgggatttcaccatgttggccaggctggtctcaaactcccagcttcaagtgatccacctccctcccaaagtgccgagattacaggtgtgagccaccacatctgaccatcattttgtaatcaacaaaccttactcagattttaccaagagtctcaataatttaatgaaataatagcagtaacaataataataaataatgatattggtaactctggtcagtaatctaatccaggatcagccatgacatttaacttccatttctctctatgctagaacagttgctcagccgaccttttttgtcatgaccttggcctgacattgactttgtagaacacccacactcagagttcctttgaggttttgtatttggagcaacagcagagaagtgatcatgaatccttccttctcagtgcatctgtgatgttaactctggtcactagttaaggtggggtctgcttctatatagatgccctttttcccttggtaatttataagtaaattccaggaatgttttttgaaactgtacaaatatcctgtttttttgtttttttgtttttttgagacagagtcttgctctgtcgcccaggctacagtgcagtggcacaagctcggctcactgcaacctcctcccttcaagttcaagcagttctcctgcctcagcctcctgagtagctggaattacaggcacctgccaccatgcccagctaatttttttgtatttttagtagagacggggtttcactatgttggccaggctggtctcaaactcccaaccttaagtaatccgcccaccttgacctcccaaggtgttgggattacaggcgtgagccaccatgcctggcccaaatatcctgttcttatcaaaactcacactctagttttcacacaccagtaggcttgagcaataaatatgtaagggagaaaactgctcaatcttttgactttctaaataccatgattaaaataaaataggtggcctatgcctgtaatcccagcactttgggaggcccaggcgggtggatcacttgagtccaggagtttgagagacaagcctaggcaacatggtgaaaccctgtctctacaaaaaatacactgggtgtggtggctgccacctgaaatagcaactccctgagcctgggaggcagaggtcacagtgagccatgatccagccactgcactcctgcctgggcggcagagtgagaccctgtctcaaaacaaacaaacaaacaacaaaaaaaagaaaatggatgtaagttctgtgtagctaggtggggtgggctggagtcaaaagaagcaggcatatctatgaaagctgaatataatagactgtacatactgaagactttatttttgttaataaaagcaaatggttaaaagttgttttacatctattcttcaaatatctataaaatcagttgatgttccttatggttaacagcacaggctgccccataaaaatacctgatgaaaaaacaattagaaaaagaaaatggagatggtgaggctgctttgtcatcataaaaaatgcatcatttcatgctcttgataataaaagcacatggaggaccagccacaacagcgacctctcaaactcaccagcacaccaagaaatcggggcttgagccacatgaccatttttatctaaagtgttttttcttacagaaaatgaattaaaaggccacaaagtaattaaggcaactttttttggtttttaaattttttgatggatatataatagttgtacatgtttatagggtacgtgtgatattttgatgcaagcatacagtaagttatcaaattagagtaattggaatatccgtcacctcaaacatttatcattcctttgtgttaggactattctaattccagtcctctaggtattttgaaatatacaataaattattaagttacagttgccccatggtgctcctcaatactgtatcttattccttctgtgcatctgtacttttgtgcccgttgatcattctctcttcacccacctccccactattcttcccagcctctagtaagcatcattctgttctctacttccatgaggtccactttttagctcccacataggagtgagaacatgtgatatttgtcttcctgtgcttggcttgtttcccctaacacaatgttcgttctatccatgttgctgcaaatgacaggacttcatttttttccactgctgaataatattccattgtgtatttgtgtaccattttttttattattatttcttggataggatgtctttgaaacttcaaatcctttgaaaatgtgaggctgaacaaaaaagatttttgtttccaaagttcgcctccagtttgaatgtattggaagtttgttgttcatctctaaggacccttgctcttttcagaagaatatggcgttaaacataccttaagtattagagcattttgttcttatcgttgctagttttatgtaactgagagaaaatattttgaacgtcttagcactctctcaggaatcagtagaaggagcagagcgaggaggctattcttatgccaaattaagacttaaatgagtcaacacgtgtggtttgtgagaaaagcacactaggttttaagaggcagaataatgaagttgttcttgaggaaggttcctttgaaacactggctttcttattttttagttttgcatgagaatgtcatccatgaaggtgtgggggttttttcacctttaaaataatctcatactttttttatcctgtcatcttcatggcataaatggaattaaatcaactgtatgcataacattctcactacacaaagcaattccatttttaatttgtgtttgtatttgtttggataggaaatatttgtggatggcataaaatccaaaagatataaaggagcagggagggaagaggctgctcctgcccagcacccccagagtccccagagacagccagtgtggtgtttcaacagaatggttggccttaaactgacttcgagtccccaaagggcgatcttctcaacctacttttatcttgtagtgaagagaatctgttataaaatgttaccgtagttaatcttgttagtatggggcaaatatctaacctgaattgccaagtaaatgttttccaagtgaaatttaacaatagagtaaattagctggaaactgcttgggtgctgagaccaaatgccggagtacttaattgcaaaaatatagaacgattttattagacaaccatgaaatactggtgttttaaagcgtagaagctgcagacttcctcactgagggagatcataaattgaacagttaagccaggcaggacgtttggagggcatttgatgtaggttcagcgtggctaataacctgggatggcatttggtagttcttcgggacatttctttaactttacaggtccttgctacatgtcatctttctcacaagagtttcctgttcaatctgtacccaacctgtattcttccttttggctttaagacattttgtccctcccatacccatttgtattttacagacccagtttgatatttctgcccaggaagaaatccctgacttccctcccatatgccatgcttgcacacttgcattctgtgcacccttatgcttgcacacttgctctctgtgtgcctttacatttgcatgcttcctctctgtgcacccttatgcttacacacctgttctctgtgcccccttatgcttgcacacttgcactctaggcacccttatgcttgcacatttgctctctgtgcctttacacttgcatgcttactctgtgtgcacccttatgcttacaaacctgctctgtgcacacttacacttgcacacttgcctctgagcacccttatacttgtacccctgccgctgtgcacccttttgcttgcacagttgctctctgtgcaccttatgcttgcatgcttgctcttgctgcttgcatgcctgcactgtgtgcatccttacacttgcatgctgtactctgtgagcccttgtgcttgcacacttgcactctccacgcccttggccttgcacgcttgttctctgtgcacccttagctcatacacttacattctgtgtgctcttgcacttgcacacttgctctctctgttcccttagtttgcacaattgcgctctgtgcatccttgcacttgcacgcttgctgtctgtgcacgcttacacttccatgcttgctctctgtgtacccttatttttgcgtgctccatcccaccaggtcttgctcttaccatcttcaaaaccctgccttgcctgcttttttttcttcctctacctgaaacactaagatttccaagaacacagtttgcatgctgtgtagatgtccttatttaaatattgatttgccaaaggttagtcttgagtacttagtaagttcttagtaagacccaaataactatagaaactagttatttgcccccttttaagtccctccaattaacaaggctagacttatttagaaagcacatttatgtgtcatatttgacattttttatgcctgacctttgattcttaaagctcatagtatgatgagtcatgtagtttttccactaaacatgcctttactgaggacaggaacttgacatggcatttggcatatagttatgctcagtaaatgtacataaagccacgtatttatcaacaccgtactcaggaccatgagttacacaaaggaagtgttagttatgacctctggcctcaaaagccttaccacttagtgaaggaaaggatgtctgtaatatataatgtataggccgggcaccgtggctcacacctgtaattccagcactttcagaggctgaggcaggaggatcacctgagggtcaggagttcgagaccagcctgaccaacatggagaaaccccgtctctactaaaaatacaaaattagctgggcgtggtggcacatgcctgtaatcccagctactcaggcagctgaggcaggagaatcgcttgaacccaggaggcagaggttgcggtgagctgagatcacgccactgcactccagcctgggcaacaagagcgaaactccatctcgaaaaaaaaaaggccaggcgcagtggctcacgcctgtaatcccaacactttgggaggccgaggcgggcggatcacgaggtcaggagatcaagaacatcctggctaacatggtgaaaccccgtctctactaaaaatacaaaaaattagccaggcctggtggcaggcgcctgtagtcccagctactcgggaggctgaggcaggagaatggtgtgaacccgggaggcggagcttgcagtgagccgagatcacgccactgcactccaacctgggcgacggagcaagactctgtctcaaaaaaaaaaaaaaatatatatataacatattattatatatattatatatattactatatgttatatataatatattatatatattatatattctatattataatatagaatatatatattctatattataatatattatatataatatatataatatatattatatatatagattatataaattatatgtaatatatattataatatagattatataaattatatgtaatatatattataatatagattatataaattatatgtaatatatattataatatagattatataaattatatataatatatataatgtgtaatataaaattaatgaaaaataaggcatgtagtttaatgctaactcatgtggtatagactagacattctgtagccattcagaaaagaagattaataaggactattgtgctcagacaaaagtcttcattgttgcacttcgtacagtagggcttcctgggaaggtaaaattgtcatcagcagagcctagtcaggaagccatatccccatcacaaaatcaaggccactcctagcatagcagcatcagtttctcaggtctgggggacagtaagctttggctagagctcaagaatgagcccttggtctacaaacttgttccatgatgttcagaaaaatgaagagcatcatcttttagcttaaagtgaatccacagttgtgggagttagtttattacacatgcacgtaattacttagtgtttaaagaaacgttggtaaagaatatgttcaaacaaattgaagtatatattttttatttcatgaagcacgtaagtttatggcaaaaagataaacaaatgttggttgcttcagtcatttccatttccattttctcatcccaagtggaggtaaaatgatccttactacaatcttgcttatcctacctatttacacacatgtctaaaatatacacacacacatgcacacacactggcacatgcagaggctgaatcatgcacaaaatacgtaaatgatgaacatttttttaaaaatattaccaaatattgatgggatatggcagtgttgtttttgaaaaatatgtaacatgactttaatatttttatagttttcagaattagaatcataggaagggaaaatgttttaattagataattcaactttttatgtgtctgtagtggtgtactataaaagcaaattataaagcattattaaatattcataataatttttaatattacctgcattatgaatttaactaaaataaagtgagttgtacatttttaattgagttgtttcaatagctggaagcatcctgaagcattatattaatttttgaactatttgaattcaaactgagtatgatttgaaaataaattaataatttaaaaacaaaaataaaaatattaccaaatattaaacttacctcaatgattattcttcagaaacatctgaaaagaatgatattttcatagcaaaacctttagaatcatctctgaaaaaagaaaaaagggaaaacatattttctcttaattttcctccctactgccaccacccatgtgagaatcatatgagtttgaccacccattattcttgattgtttctagagctgtctatgcaatctcagtcaaacgagtaatttttaaccagagtatttgtagaaaaataacagttatttgagttttcatttttattaaaaataatgttaaagattttatggcattattatcaggttgcattttttttaatccacaggagtgtaccattaccctaaagaataccttttaaattattgggaggttcctatctccattttctcaagcttaaataatctccttaaataatctaaattttagatattatgtaagtgttctaatactttacatattgaatgaagatatatcattttaaggtatttagttttaaatttaagttttttaaaaatagttcttaaggtgttatatgtttactttttttcttaaatcacgtggcatcagctgacatctttaactgcttgaaagaattaagccaataaatattatcatggccaggtgcggtggctcaagcctgtaatcccagcacttagggaggccaaggcaggtgaatcacctgaggtcgggagtttgagaccagcctggccaacatgatcaaaccctgtctctactaaaaaaatacaaaaaattagccaggcgtggtggcaggcctctgtaatcccagctactcaggaggctgaggcaggagaattgcttgaacctgggaggcagaggttacagtgagccgaagtcgtgccactgctctccagcctgggcaacaagagtgaaactctgtaaaaaaaaaaaaaaaagaaaaaaagagattatcattagtgtttcttatttctttggttaaaatgttatagtgagtagtgtgttatatcatcatgtgaattttcataacttattggaagttaatgttaatgttaacattaactaattggaagttaatgataatgaaattaatcattatcagttttatatgaacaggcatttcatttttttttctaaatgatgacctgatatgtgtcaggaactatgttcagcattggaaatactaagctgaattgtgtacacccacgggaattctcacagggctcacagagcttaaacccctaggacacactgtcatgttggcaaggggaaggtggacacagccctttgggagaaatagtggtgctatcccagggaaggtgaggggtggcctggcctttgaagaatgggtgaattcagcaggtagaccagggacagtggcaagtgcagtatggccagcacagccctgtgtgcaaatttttttgttgtttgtttgttttgagatggagtcgcactctgtcacccaggctggagtatagtggtgcgatctcagctcactgcaacctcctccttctgggttcaagcgattctcctgcctcagccaccccagtagctggaattacaggtgtgtgacaccatgcctggctaatttttttgttttttttagtagtagagatcaggtttcgccatgttggccagcctggtctcgaactcctgacctcaggtgatctacctgcctcagcctcccaaagtgctgggattactggtgccccgcccctgtgtgcaaatttggacaccgcagaggtgctccttctcagaagtcccccacatcatacaaatcatttcaagagcatctagccctacaggaagatcatggagagacattcttggacttttttattacacttgctccagtgtaaaattttatggtatgaatacagtatgactattatagcagaaataaataaaaataccaggacagataatagaaaagagttgtaagaaattcaggaaatgtatgtgcttcaataaaaagaatgctttaaattgtcctagttgattttattgaaggtaaatttgaaattccatacttagtatttaagtcaaattaccactcatgcttctcttgtggttctctttactgagaaattcaggagactgcatctttgcaggtttctcacttcaattccatgcccatcagtttgcccccagtgccgtcctgttccaggtgatcatagggccaaatagagttgatgtctccattgtgttttgaccaagcttccccatctgtgctcttttggtggctttgcctctaatcttagcatttcagctggaagcgcacttaggtgtgtctgatccaagacttcctctacagatgagcagggcattagcgcaactctctacgagacttgtccagggtcatccagatgtgctgacctggaggcaaagccaggactagaaccgagtctcccgattcctcatccagttctcttcttgtcgcttccattcatgcagggtgcgggtctgcatttatacagcggagtttcattatctattaggttgaactattaaaaattgccaatatttggccaattttgagctctgatatggcagtttcttacggttcaacccgttagattaaatgtcacctgtcagtctctcattacagtcccttacatccctgtcctgcgaagacagcattgccatcgagtggtaggtatcctccctgcggacagaggccccgtcacagtgggcccagccctgcccttctatgctacaggctcaggtctgcacctgcctttgtgcttcactctcagcagtgacatctgctgcatccctcacttgccaccatcatctctactgggagccttccctgacctctgagatgagaggcagccagttctcccaaagacacacagcccctgggttgtctggcaccaaggtgtccccttaccagggcttgcacgtctcatgtccactgcccacccatagttacccattttttgtggctaagcacataacatgctcacttacctacaattgcaacaactagaagttagagcagtctgtttaaaaggctttgtgtaaatcaccctgaaagattcctggtatgtgttggagcaggagataaacgggatgacacactacataaccagtctctgaaatggtccccacggtaggcttgatattgtttcttaaggctcttttttgaaaagagaggaaacaaaatagtaccaaaaatctcataataggccagatgcagtggctcatccctttaatcccagcacttggggagtccgaggttggaggaacgcttgagtgcaggagttcaagaccagaccagcctgggcaaaattatgagaccccatctctacaaaaaatcttgtataaaaataaaaaaaatagccgggcatggtgttgtatgcctgtggtcccagcttttcgggaggccaaggcaggaggatcacctgagcccaggcagtcaagactgtaatgacctatgattgcagcactgtgctctagcctgatgacagaggaagaccttgtctcaaaagaaaaatctcacaatagttttacgcatatgattatataaaaacaatcgcatctgagtaatttcggtgactagagtaaaagttccttaacattatggttaagagtgcagactttgcaattggtctcacctctgcctcttcctgtctatgtaaccttggttgagttaattagtatctctatgctcagtttcctcatctgtaaaatggggataataataataatgcctagcacatgaagctttttgggggaattaaatacaataatacatctgaagtgctgggccctgtgcctgacacaccttaaacattcagtaaatgtgagatgtcatcctggtcacccttcaccatgcgtaatgttatgtgtgtgtgctgccttttcagacgttgccgagtgctgaagccacgcacggggcccagtttgactcggcacgtcttggtgtggccgaagaacaagcctggctctgaattaagagtcaggctgtggtgttttcagggaactttctctgccttctgtcagttttcaaggcttggcattgcatgggaagagtcaacaaatactatattctgcagaaagtattgtggtctgaaatagtgtagactaaaatataaagaaaaaccaaattgggattttaaaatgcatgagcgcccatctaaaagagccacctacgccttggttttcctcttttttggtgaagttgataaattggcttgataccaatgaaaatggcgaccactgcttgaacagcacttcatgccaagaactgccctaagctgtataactgcagcaatcttatgggtggagaatggtggctcatttcatatgtgagaaaacagaagcccagagaacataattgacttgccccgagtcatagagctgggtagagaatggttcagaatttgagcccaggcagcctgaccccagagcctgtccccctgtgtactgtgaggtgacctttctgggtttaagaatcacgggtccaggttatacactgtatcagccttgttgcagctacaagcttggtgtggtcacttcaccatccctcattttgatttttgtttgcagagtttaggtcgatagacattgcgggtatatttctaagtcttattgaggaaataatcagtccatgagtgcctgtagctcactacatgagccatctatctggagatgggcagggctcacacagcacaggccatctttcagttctgcacctgatggacagcacctcttcctgcggcagagcctgagtggccatcgctcggctcagcccagtgcgaggcagagagtcctgctgaatctccccttgactaatggcttctttctaattcctgatttactgaagacagcctttctgtcttgaaggaattactctgtggcatttcccagtcttagcaagtggttctggggggccctgatgaaagcactgtgttctggcgaactgagaaccaactgtggacccttgctttgtttgagggccaggggtggccaggagggtttctctgcagagtccacacctcacccatatgcacacactgggaggaaatatttttcaaccattggtttaaccattgaatagttagctttgtagtacttactcctctgagattttacgcagatgatctcacttaatccacacacatgcacgcccccgtgtagtagccaccatggcggtcccctgacggggtagatacgtggcccgtgtcacacagcatgtgcagcagggctgggacttggcgccagggcctacactctgagccacaatgtctaagccctacctcacccaaaaagattcctctaagtctgtgtcagattagaaatgaagaggggacaaagagaagtaccacggacagcaagaaaagaggaagatgcacatcagaactcataaagcaagtccctcaagaggcattctgtgtgggggcaaattcccaggggttcccggtgtctacaacacaaatacagtgactgacgcaagatcctatgtcctcaaggagagagaggaggtgaaattccagtgttttcatttcgtaagaaggcagagatgtatggaatgcttcaggaagatttccattcaagagtttatgtgggaaaaaagttttattgctgaaagaatgatgtccctaagtatccagacatttctgatttggatggctaggctcgccagaatgtcattaactgggatgtttgctcacctagcgtttaactgtcatagttcaagcctagagaaaaggtgtctccggatgggagtgatttataattcgcccctccattgtcatccatggttgcccaactgatagctaaaaaatcaacagcatccgcctccagagcgcctctttgctcaatatgaccttgcgagtttccagtgcaaatctgactctgctggcttctatgccactttctcttttttaattcagttgcccatgctattctttgggtttctctagccactttggctctgacgatacaaaatgtctttgtagataacaacaagatttcaacttgcttattagaaaaaagagttacatactcttcagaagtttttttaatatataaagaatatgttaacaaaaagagggttcacacttgtaagagcgtcacactctgtggtgtgtagaataagaaataacttccataataagaatttatgccaggcaaagtggcttatgcctgtaatcccagcattttgggaagccaaggtgagaggattgcttaagcccagcagttcaagaccatcccaggcaacatagcaagaccccatctctacaaaaaaattttaaaattaactacccatgctggtgcacacctggagtcccagctacctgggaggctgaggtgggaggattgcttgagcccaggagtttgaggctgcagtgagccgtgattgcaccattgcactccagcctgggcaacagagccagatcctgcctcaaaaaaaaaaaaaaaaaaaaaagaatttacaccttgcaaatgcaacagtcttctcttcatccttgtactttgtcaaaaactttaaaattgtgtttttggaaacatgcttctcttcacgactaagacttgttactggattgtgtgctgcgggtccctttccaactgacaagcttctctacccttcgagctgatagtcatttgtgctttccaagaggtcatcccaagaatgcaacgaaaaaaatcaatacatcataaaagcatgaaggttgtagtatcaatgtaaaagccattttaactttcctcaacatcagaattggaaggacaaatacatttctttccacttttctatccctcggtcctctttaaaaaaattaatatatgatatgtatgaataaatgcagagactgttagtgtgattttgtagatggtggcagagagatgggagatggtgggctttggccaagttttcagcacatcattggtagaaccaagactggaagctacatctctttcttccaggaccggtatcattactgctcatgtgtcagacgacactgaatttggtgagaatttctcacttctaagggataatgaaccatacaaaaaaatcacagtcagctccctgtgttactctagctgacctgctttaggaactctgccagtgctggatctgcactctctttgaaggcctcctaacaggtattcagatgactcgttaagctttagagtgctgtgtgtccagaatacagcaatacatgctacttgacatgagaatataattcaaggcatgtaaacagagatacattgatcttctaagcaatatcttcatttgagcaggacagttggcatgttgatgaaaagaggcttcaaatcttaacagttacaaataacttttccttttgcctgtaatgtaattagcactcttgaagtattttgctggatgcctttcttcatgctcttcttagcaagttgtttagtcaaaatcaagtaggtaaactagatgggtatatacatatgttaaaagttgtttggaatttcaacctacccggaagagcagaccctcgcctagcactcgttacatcctaagagctggagacatacgagctcctgggatcttcatgacacccccatcaggaggagactaccagcatccctgtcttacagactagaaaaaggcagtgcagaggtgaaggtcacacaactagtcagtgatgggttgaggtttggagtcccagagtctggttccagagtctatgcccttcgcccctcactgggctgcctctgggtacagaatcagcacctccccaccagcttgtgttgtgcctgagattccatggcatcactcgctttcccctgcaagttaccatgtcgcctccagacatgtgctcttcggagagggactctcatacttacccatacatatgtatggtgaatagtgactgttgaggaagggagggagagctgttgttcgatttcctgccttaagagttgaaaagtttttcatttgaccactagtagttttcaccctcagaacagacaaccatagttgaagatcagagaagggttaaatcctcaggaacatctgaactatgacccacccattcatggttttataggtaaggttacttgtgtgctaggttaagtcccatttactcctgctatttttagttatttcttcaaaaatggtgtcagctgcaggctgagcgagcatcccctaggtccctattcaagtttccagagcctggagtaacctctgtaaaggccgcatgatgttacagagaaacaccacaaaaacagtcttagcttctcctcctctcacaggtattagtgacgaaaccttgggaaatgtgactcagtatctggagctttagttgcatcctcttgtataaatgaaagctaggcaaggtgatctctgaaggcccatgcaggctctgagaaccaacagaattatgacaaaggtgttatggggtcagtgtggtgggtgcatagaaaacaaaaatcccctttcttaagaacccatttttatcagttcccatcatggattgggagatacattccaggaagaattttatagatagtaaccttatctataaaaccatgagtgggtcatggttcagatgttccagagaatttaacccttctctgatcttcagcaatggttgtctgtttcaagggtgaaaattactagtggtcaaatgaaaaacgtttcaactctgaagacaggaaaacaaacaactgttctcccaccctgcttcaacagtcactgttcagatacatttcaagaagaatgtatctcccaatccatgatgggaactgataaaaataggttcttgagaaaggggattgtggaaactgtgaaaagagccagagacagcacgtagaggtgaggaaggggcaactcttcctggcccagcaacagtggcattcatagagtggagaaaaatacactgcagtgtgaagaatgggcctcgtgctactgcgaaatggaaagcaggagactgcaaggggtagttagcatggaagcagcattctcgtataccaaatctataccttgctgatagtttgtcattgcacccagaatgtccattattagatttcttcccaccagtggcaaataggcattatctgtgctactaactgcacattacatatatgtggtaatgcagattgtgaaggcaggatggaatagcagtcatttgatggcctgtattgagactgatggatagactttcttacagacaagaagaacctgctgactaaagcttgtgtggcgggggttaaacttcctggagcagcctgaaaaggagaattatctggaataatggggtgtcctttcagttcactctgacctagctccaagataagcttgaccatcctacaaacaatcagatctaatagtccctcagttctttggggagtgaaaatgcgggtcaatgggaatggaaagatgggagttattggctcatgcactcattcaagtagaatttcctgaacacctcccctaggctgggggtagtctggaaactgggggatcacagtgaacaagatgcagtccctgacctgaagaacacaatttatccaccaaacttttgctgagagtccatcattttcacttgaatactcttgcagttttattcatttccttgcctcatactacaaaaatttaattgtgcagtcattaacaaaaattaggatggaaaatatcaacctggggttgttttttccactcatatggagaaggcttcttcagcttactgagccagtaaaagatgtctgtcatcatttgctgttgattgtggcatatataccattgcaacatgcatcattagcgcagttagtaccttgttacagcttttggctttatattcttactgtgtcttagggtctcagatggtttgcgttacatttctcagatgtaatacaagtatatctctgtgacaagtttctatttttaatttttttaacctctttttatgtgcagttacctaaaattattctgtagggacttgactccaatccctgaagtagaggcatttttgcatagtcacgttcctgctgtcttgtccagggacttttcctgtgtgctgtgtttatatatttgattcctaacacgtaagacctttttcggagcaaatatccaagtttgtttttattatggctcttatatttaaaaaaaaaaagataattttttggtcaaatgttaagacatgccaactctcggttttaaatattttaaggtcttcaaaaaatgaatgtttacagttttgttgccagaacctctctggctctttaaaataaaaatatttcagctgtaaattggaagataagtcctctgtccaagcagtttttcaaacctgttccagtcagctccagtaaagtgtggtacaatggactgaacccaaaatgaaaaagactggagtccattctcaaccagacacagtcttagccaatctgcctttgggttttcacgtctgtaaaatgattatattaataccaaactcatggagttacactgaggaatgaattagatcacaggcatgaaaaagcgcggtaaggtgaataactcagtaaatgtgaattattattgttattactgttgaccaagttcaaatactagaaccagaaaaggacttgaattacaatgaaaattagccagaaacacagaagactttgacttacacatttctgatcactccaaccctaggagtccattcgtaggcaagacttaagtcacactgaagtataaatgactgataacaggctactaatctgttactctatcaaatgcctttgcatttaactgactgagagccttgactacaggattgaaattctgcaagataaattttaaatatcaaccagtgaatgatgatagtgctgaccagaactaccagtgtttcttacggctatttcaaattaagactttaaatatagggaaaatttggttgttttaaatctacatttacacttacaggcattcttttcaacatgcattatctgtggtaactgcaaataaagcattccccaattcgtaaataaaaattggacttagaaacacctaaccattaaactacagctctgaacaactcttaaatttcctttgtattacccaaaccagaaagcccaaccttggattgagagagccttaatatacacctttgaaaatatagaatttctgtatcttataatagatatgcacatttaatgtgatagcatttctcctcccatacacccccacagcctcaaaaatctattattaaacactgctacatcaagaatagagaaaaagcagcattttgtagaattaaacatcatattgcttccaaaaaagaaaagagcagttgtagacatttccttagttaattgcataaatctttaaaaacatcattttatataaggaacaaattaacaaattactgagctctttgaagataaactttgtgagaattataagctactttgtgcatttaatcattttatatactgaggagctgtatttgataagtaatatggaaaggaaattctgaatagtatacaactgaactgccaagctactggatctctgtttaatcctcttttgaggaaaacttaggagatgctattgccaaaaggggaggggtcacactgtattttaaaatcaaatttgtttaaataaacaaaataggtgttataattagcaatatataacaggaaacatgttcaagaatattcatagtggcactgtttataacaagaaactggaaacaacccaaatggccactaacaagacaatggatacataatatgtggaatatccacacaataaaatattcatcagtgaaaaggttggccaggcgcagtggctcatgcctgtaatcctagcagtttgggaagtcgacatgggcggatcacttgaggccaggagttcaagaccagcctggccaacacggtaaaaccctgtctctactaaaaatacaaaaattagctgggcgtagtggcaggtgcatgtaatcccagctgcttgggaggctgaggcaggagaatcacttgatccagggaggcggagcttgcagtgagccaagatggcaccattgcactccagcctgggtgacagagctagactccgtctcaaaagaaaaaaagaaaaagaaaaagaatgaattacagccacatgcaatgacatggatggatctcagtatcataatgttgaatgaagaactcaagtgttaaaagattacatataatcctcttttgtttgtaaggttcaaaaaacaagcataactaagtactatattgtttaagcatgcatgtatttgtgataaaaatttttgaaaggagacagaatgatagtcgtaacattcaggatagtaggagagaaggcaagggtggaagagagatggggtatggaagagatcatagtaaaatattggttattgatcctgtcttattaaggagatgggaggggctcatgggtgttccttttatgattaaacaaaaaaataagaaaatgaaaaagggccatgtaagagtcaatgatgactgtgtgtcattaaccagatctattcacctgtggtccacattaaaaagaaaattcgttttctagtttagaaacatgtatctttcttcgtgctgtgttgtcttttaaaggaaaaatgtacatagatgctactgaaagggctatgtgagcataatgcatgataaagagaatcataaatcttaagaattttgagatttgtatttattatgataggtgacaatgcttcaagatttgcagccacaaagtcactgaggttatatccccataagccagactctgactacgcaaaagacatggtagaatatcaaccaacatttgtaaaagtaactaactctgtcattctgtaaatttcacatcgcattctggcagttgttcttttgttaattagactaattccagaggtgggtcattcccattactttttcgttctgtatatattccaggtttaatttgttgaccacctcacattcaacagaagtgagtgtgaaacaaggctgctccctagaaccaggccacctgcttttagagcccagctcccctcttccaagaggcagtgcctctgtgtgcgtcagcttgttcctttctcaaatgggcatgataatggtacttacctcagagttgctgtgagggttaaacaagttaatatatttaatacataaaagactaggctcaaagtttcaacatcataaatactctatattagctaatcggaagaaaaaaattattaaatcagacttttatattgtgcctgcaaagccaagaaactctactaatctcaccgtgatggcatcactacacttaactgtggtgagacttcttttaatgaatacatcctcactccagcactgaccaaacatagaaaatagaaataaaatgtgagccaccaatgcaatccacctatgtaattttgcattttctagcagccacatttttaaaaagtaaaaagaaatcagcaaagcttaataatatattttaacgctatacaaatatccaaaaatattatttcagcatgtagtgtttagaaatttccaatttctatgctctttttttcattaaaaatgtcttcaaaatctagtgtgtatttggcatgtctggcacatctcagtttgagcaagccgcatttcaagctcagtggccacctgctgttagtggctactgcagagaatatggagaaaggaaataatgacttcttccttcccagcatcagtgttagtggggaggaaaggcacaggccaggtgagaagctccatctgtgcatgttcattgtcctgtgaggcaggagggtagccagctactccaggccccctggtacctgctctcagggtgagtgtccctcatgtccacgtggcccagcaagcccatgcagggcagagagtagcgttgcctgagtaccggacactgcctggtgcttagcagctatgcttcctcatggtggggaccagcgtacttgtctttggtctcccagtgctgacaagagcctgttgctcttctggagacttcactgcattgtgtttctgtcttcaggtcagcaggcgaggtgtccgccctaatgggccttacccctaatctgactgcttctaagtctcccttgtcatccaccatggcctcagcatggggaatgaaaccaaccacgtggccacaggtgttgcggcagccaactgtgttctctgtgtgtgcaggagatggaatggtgaggccttaccttgccacaccttcatgatgacacccctgcacttaccaaagctgccacaagcctaatgctgtgcttttgaagcctattcttgatgcctttgcccaaaaagagccacatgattatgtattgcttgagcagaagcagattgtataattttgttcttttcattttattttctgcatgaaatttttagggcatttagtaattcactgaaaacatacaaattagcattttatttctaagtcaagaagttggctgtggtctgtgtgtgtttaaaaggaatgtattatgaatctgagtaaaagaaatggagaaagattttttcggcctcagtggaattgaaaaaaaccaaaagccagtacctggtctctgagcgtggaagaaactgactgtgcgtgctctgttggattatgagaaagctgcatgagcctggctgtccgtatgtatgggagtcagaaaagtgggaggaaatatatgattcatggtgtacaaagaattgagtttagaaaaggggaataaacaagaggaattactcagtcactactatttaaaactgagaatcagaagacaattagcacaatgttgttggaagaaagtttcagatagtgtaacatttttagtttctgcaaagtctggaattgctgtgattcatactttttcccagtcccacgctcagttttcgtcccctctcagccattggaaatgtgcacctgtctttcccctacctcaatccagtcaagtcttttagatggttttatataagatttcatcccagtggaatttggaaattagtctagaaagctgaaaatgagagggtacctgaaagttgggataaagatgaggtcattgctcctggattctgcactctttcccatgatatcatcctttagggaatccctggaaatgtggaatgggtgtccacaaggcagatggaagtatgggatgctccgtggtaagcctgtatgcctccaagcccccaataagtagaacaatgggaaatgcaaattgcagaaatctggaacaaggagaagaaaggaggacactggatgatgctgggatttaccaatgctggggttccaggaagacagcttctctggcccccgcccaggcctggaggctgcaggcccctgcctccttagaaccatggtccctggacagcactccatccagcctttcagagttttgttttcttctctttagcttacaattaattatcttagggaaaagaaatcagtgccagtgaattgccttgctttttttttcaatgagtcttttctaaattgggttcaggccggtgtatgagagaccagaaggaacccttctgcccagagacccagtctgacgccccctctcctgcgaacgtcagcgatggcctcggccatgaatgggttaagcagcagctcctctgctcagccccgtgttgagctgttattgaaggtctttaaaggcttccgcccaccttcctcccactcccctggcaagtgaaagacatttgaattcctcttgcaaggcagaaaattattaaagtgaaagaaaatgactgttccctgttctaaaaaggagagaaaagaaaagtggggctgcccctccttcattatttcttacctgagaaggagattatcagaaacagggtgaagcattctgactcccagaaatcaggagaaggggaagtttatcctgtcggccttttgtgtgcttatttcagcttataattcagtgccctggaattccgtgcacattagaatatggaggacctgctaaccctggaggagataaccatgattaatagggttatatcctcacagggcagtattactcaaagaccccaagtaactaaattatagagaagaatatgaaagaggagtagaaacccggtttatttttcctgtgcctttgagcactacaacttccactgaaaatcaattcattttagagggtcagatctgaatgagagattttagtaatggttcttttacacgtggctgaagaagcgtggtgggatagatcttcaaacggtttcctttttttttttttttttttttttttttttgagatggagtcttgctctgtcgcccaggctggagtgcagtggcgctgtctcagctcactgcaagctctgcctcctgggtttatgccattctcctgccacagcctcccaagtagctgggactgcaggcacccaccaccacacctggctaatttttttttttttttttagtggagacgggctttcaccacgttagccaggatggtctccatctcctgacctcgtgatctgcccacctcggcctcccaaagtgctgggattacagacgtgagccaccgtgcccggcgatcttcacacattttcatttgaatctttttatattttataaacatcacttcataatttctctgttaatccagctcacctttatacttcccaatctaatcaaactactgattcaaactatgtctgctttaccccagccctgtccagagcatgggtctggccctgggaggtggagggtgagtgagctaagagggctattggaaaggtttttaaaataatctctggctgggcctgtaatcccagcagtttgggagactgaggtaggaggatcgcttgaggccaggagtttgagaccagcctgggcaacaacacagcgagacctcatttctacaataataataataatctctgttctagggcttatggtttaattaggaggattagaccaacagtcatgaaaagctaaagtcaagagatcatagaatttaattaaatctcagttttaaaatgtctctacttccccagacaaatataaagaaaaggaaaaggaaagcaagaacctggcaatggcagaagtctgttctgtatccacttcaagacaatgcattttacatctccttaggatgtataaatattagaactaaagtctctgccaatacatcacttttttggcaacagctatggtgctggaagtgacaatatgatcaccagtgaggtgggccgaaacagttctcagcatttacagtactatcataatttggtcataatgacatgttgcggaactcatataagatacagatacagaacatttcaagtgttgtttggcagccatcatgtaataaaagttaaactgatagcatgattacctgagagctattttcatgtgtatttaggaaatatttggccgggcgcggtggcccacgcctgtgtaatcctagcactttgggaggccgaggtgggcggatcacgaggtcaggagatcgagaccatcctggctaacacagtgaaaccccatctctactaaaaatacaaaaaattagccaggcatggtggcgggtgcctgtagtcccagctactcaggaggctgaggcaggataatggcatgaacccgagaggtggagcttgcagtgagccaagattgcaccactgcactccagcctgggagacagagccagactccatctcaaaaaaaaaaaaaaggaaatatctgcttaataggatcatgggcagccggcactggtttggccaatcccagagaaaaggaaaaaagtgtgtcttagcacccagtttcattgacattgccaacttcccatttccttctgcaaacttcccttttttatttcctgctgtccccagtaaatttatccttgaccatacctggagccattaaccgtaatcgggccttagatatcttacacacccctgagaatttctcctcagctgtggaataaacgtgttattcccaagttgtgctgtgcttcagaaccacctggggagctttcaaacaagatccctaagcctgtcctcagagattttgattcaggaattcttgggtgaagccttgaggaatctattttaatagctccccaaaggcttctaaggcaccaggaggtgtggcagtcacaacgcaacacctagtgtggctctcaaggcataaccagagttaagaggtggtcagaaactgacagcgaacttgcagcaatgcccttgttctgtgaggagtggttccccatgcagatggcctcatttataagtgtgcccccaccccattttctctgtacttacactccacaatcatgccaagaatcgtactgtcctatagtcctttttatgtttacaattcagaacaaatcttgattcattaaaacttattaacagttattaaaaatattgacagtgttggccgggcatggtggctcatgcctgtaataccagcactttggaagacggaggcaggcggatcacctgaggtcaggagttcgagaccagcctggtggtcaggctggtcagaagttcaagaccaacatggtgaaaccccgtctctactaaaaatactaaattagctgggtgtggtggcacacgcctgtaatgccagctactagggaggctgaggcaggagaatcgcttgaatctgggaggcagaggttgcagtgagcagagatcacaccactgcactccagcctaggagacagagcaagactccgtctcgaaaaaaaaaaaaaaaaaatatatatatatatatatatatacacatatatatcaaaagtgttttttcttaaaaatagaatgtgtaagataagttaaatgtagagtattagttataaagaggacttgataccacaagttccatctctaggcctatctcagtttcagcacctgctcccacctctaactagtctttctcgatgccacacaacctgttttcttgggcctccttcatttcaggtcacacctctgccaaccctgccacaacacagaggagcagttgaggccctcaatcactgtcctaagtaacagggcattgctcttacttgccaagaccttagctagcctcaggcaaaattgtggagtctgttgaaaacatccctttcctatcacatgttgctgccagatactcaggtatttaaatctgggtaagcaataagtgatacaagaagtgtaaagtggttttgaaaattctagccccagcaactgtcctctaacattacggactgtgatgatggattcccacgtagttggcattgattgaggatgatttgcaaacctactttaattaagcattttctcacaacttcttagctcatttgggtaactccatgtgcatataacttaaggttatggcaccatatggtggggaagactatatatagataggcagattccccacggatccaacaatccagttatcattgtatagattataagcataaacaaaatgtactttaagtggattgttctaataaagtaccatgtcttctttttcctccttatattttatcatcacctctgtcttagcatttgctaccagaatctggagatgctcttaggtggacacagagtcttacatgccattgatacatatactgctcatgtggcttgcagaggaaggacgtgaaaagcttagacccagaagctgggaaagggccttgttgttagtgtcagtgtaataagatgcagcttctagctcattgatgctgctgtgttgcagaggaaaagcctcagataaaaggattttgtttgaagtaaaacatcacaaaccggattccttgtaaacacaggaatagttgaagaaggtcagactcagatcactgatgatgcaaatgagaagaaagttccaggaagtaaaggcttaagctttctagaacgctccagtggcccaggaagggtgctgttgttcttagaacaatgagatgtcaaatgtattcaaagtaaaaattaaagtgggagaatggttttaataatttgaagtttacctcctcaagccagtcgttggatgaggggttgagagctatcttttgtgcaagtgggcagggggtgttcagagccctgcccctggggtctctgcacaccattgttgggacaaaagaaattctccagggcgtctgtcagctcctcatgattcccccagcttccgacactctgaggaagaaattctccagggcgtttgtcagctcctcacgattcccccagcttccaacactctgacatcaatgtgtccttggggatgtgttgtttacaataatgtaacattcacactaagatggacttcatttttaatacagactcataaagcatttttaaccacttattttaattcagcaattcttaactgcaaaggaggtcagtgccaaggtggaaatcagtgttaacatgtttgatttttgcctctgaggcccctttgacacttatgtaaaattctctggcttccagcctggctgatggtttttcttttcttttcttttcttttttttttttttttttttttttgagacagtcttgctctgttgcccaggctggagtgcagtggcacgatctcgtctcactgcaagctctgcctcccgggttcacaccattctcctgcctcagcctcctgagtagctggaactacaggtgcccgccaccacgcccagctaatttttttgtatatttagtagagacggagtttcaccgtgttagccaggatggtcttgatctcctgacctcgtaatccgcctgcctcagcttccctaagttctgggattacaggcgtgagccaccgcgtccagccagctgatggtttttcaatcaaaactattgattgaaattaatacttaatttaagaaaaaccagaaactactatttaggatttacagagcaagatatccagatttcaggaatgagaggtgactaattcccagagttgttttcaaattaaactgtcactttaaagctgtgaagggaaggccaaacaatttggttaagcatgtcctttcggcatggtggtggccatggctaaatggtttgtgtgggttcttaagccatggctaggatcctaatgaaggtttccatgaaagtaatgttgaaactctgaaggaagcaactagccacagttatttttaaatttcctgcctgtttgtttctttgttgccagccacaggaatgggaaccgctaggtgtttttccatagccatagcagaacaggctcccctgttgagcagtgaagacgcctgggttagggggtgaaaccagagaagccataagggatgctttttgccttctaaacagaaggttgattatcaagagatcatgcttgtttgtttgaaataaatgaactgatttctcccctgggtgtttctcttggtaaaacattttaaaagcttttaaagtgggggaggaactacaaccaactccacactatcttaataagatactaagctcagatagtaaacacacacaaaaaattaagctactgcatgtgatctatttaggaaagactttatattagagaataacagagttagcttataggtgcaatcatctagactggttagctgctgtagacagatatctatgaagttttctgcttcattgggtttcattgcaaggactcgaagtaggacacaaaggacttcggactcaagtagcttcccatgtctacctctgcagtgatccaggtgtgccgagaactcccgagggtctgcaccacatccatagtgcagcactgtcagcctcacctctcacaggtgtctcccctggtacaggtgtctcctgcacagttaagccagtctgttaaagactgttaatcattttgattatgactattgtcatttccgattttaatttcctgctaattttttgagttcagacccacctcttttggagacctttccaacctgtcctgaaactgagcaacctctccctttttggccacttcctgtggctttcctaattggcaccatagctttggtcacgaaattatatccagtacttactgccttgtattgtttccttcctccctccctccttccttccctcccttccttccttccgtcttaccctgtttcccaggctggagtgcagtggcgtgcaatctcagcttactgcaacttctacctcccgagttcaagcaattctcatgcctcagcctcccgagtagctgggactacaggcgcacaccaccgcacctggctaatttttgcatttttagtagagatggggtttcaccatgttggccaggctggtcccaaactcctgacctcaggtgatctgcccgccttggcctcccaaagtgctaggattacaggcataagccactgcacccagcttgtcttgtattgttttctaattacttggtatgtcttagccatagtctccctactgaagtgttgacttcttgagaacaggagtattggccatctcgccttgtcctagacacataatctgcaaaattacaaactctttgaggacaagggcacctctttctcattcattgcagtatcctagctcctagcatggtgcctagcacagagttagagctcaataaatatttgttgaatgattgatcaattgttggcactgagggaatacttgggcattgattataagatttgaaggagagggtaattcttgtcttaaagtgtctttggcaaactaccaacctggtgacatggtgatgcaacttccatatgacagaggacactaccaaatcccttagtaactttaggtatgtttatatagttggacttgttatattattgaatagtgtcattttccaataaaaagttgtggaaatttgagaaataatctagattgaactaattctaagagacatatataactttactccatatgcaaaaattaaatcaaagtagatcaatcacctaaatataggagctaagactatatgtaggggtaaatcttcatgatcttggatttggcagtgatttcttggatatgacatcaaaagcttgagcaacaaaggaaaaaaataggtaaattggacttcatcaaaattttaaaatttgtgcatcaaaggacataagaaagcaaaaagacaatccacagaatgagataaatatttgtaaactgtgtatctgataagggtctagtaaccagaatatataaagaatttttgcttgggtgcagtggctcatgcctttaatctcagcattttgggaggctgaggtgggaggatctcttgagcccaggagtttgagaccagccttgacaacaattgagactcccatctcttacaagacaatttattttttaattatccaggcctggtggcatgcacctgtagttccagctacttggggggctgaggcaggaggatcacttgagtccacaaattcaaggctgcagtgagctatgattgtgccaccacattgcagcctgaacaatagagcaagatcctgtctctaaaaaaataaaaatctacaactcaacgacaaaaagacaaataatttaaaaatggacaaaggggccaggcgcagtggctcacgcctgtaatcccaacactttgggaggctgagtcaggcagatcacaaggtcaggagatcgagaccatcctggccaacatggcgaaactgtgcctctactaaaaataaaaaattagctgggcgtggtggcacgtgcctgtgatcccagctacttgggaggctgaggctggagcgggagtcagaggttgcagtgagccgagattgcacgccactgcactccagcctggcgacagtgagactccatctcgggaaaaaaaaaaaaaaaaaaggacaaaggacttgcttagcatttatccagagaatatatgcaaatggccaataagcacatgaaaagatgttcaacatctgttgtcattagggcaacacaaatcaaaaccacaatggggtgccacttcacacccactagaattctataattaacacacacacagaaaataacaagtgttggaaaggatgccaagaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcattatattcatattcttgggttagtgttacattctccaagacataactgtgaaacctttgtagttaatggcagtatgtcaccagagtgcctcttttcctatcgaacaaactagacagaagttcaattctgcagtgacaagacacagagtagcatagagttcacctgaacctgaccttcaccccacccagctcattctctgaattctttgtgccttcacagtaatcagtatttaactgttctccagtcttctcttacctttatttaaaaaaagcaaatgctgagccagttcctcaaatatgtatgaattatgtttatatttgcaacataaatgtagtggcttgctgacatttgtcatgttcaaaattatatactttgaatataattttgaaagatgttaaatgccttcatggatttaaggatattttctcttgttcagcaatatttatattataaagtaggatgtttacaataaaatatgggtgctcaatcacaagctaaaagcagttaagtagtttaacatacgttaaatggggctgggcacggtgggtggctcatgcctgtaatccaagcactttgggaggccgaggcaggcagatcaggaatttgagaccagcctggccaacatagtgaaaccccatctctactaaaaatatgaaaaattagctgtgcacggtgacgcacgcctgtaatcccagcaacttgggaagctgaggcaggagaattgcttgaacctgggaggcggaggttgcaatgagtcgagatcaagccactgcactccagcctgggcaacagagcgagagtctgtctcaaaaaaaaaaaaaaagttaaatgaacacaccttttaacatctttggaaattaagcctcaaactaatgaaccccaggatcccaagcccatatccccatgtgtccccagccacagggacagtctgtccctctgaggctgcttttgaaagaaagtatcatgtctccagcccagaagcactgtgagtacttcaccactctgttgtcttagggaaagtgtaaagccatttttgaacgccttccatgatatctgttcattgctctgtcttaaacataaatgttctcttatttctacaatgagaaattattcaaatattttactagctttctacaatagcacaggggtataatagggtcactgtccagccctcagcaagttctagccttcagtttgctatcagctgacacacccatagttattacagcttgaccatgtgtaatccagaaatccaacattcaaaaggctccaaaatcctaaatgttctgagcgcttacatgacactcaaaggaaatactcactggagtatttcaaatttcagatttctggattagggatgctcaacctacgtataaaaaaaatccaatatatgaaatacttttggccccagccatttcagataagggatattcagcctgtactacttttgcatatagtttttttttaagtggtgcttttaaattttcagcagtggactgacaatggcacagtttacaaaatgccccacttttccttgtcctcaggcaagtgtgcacctgtctgtctggtgctccctgaggccttctctctccctctctctcgcccctcactcttcactgtctttccctccccctgtacgtgtccctttttccctctccattccttttccctattttttgtcatatatctctaccctttactggccatgaaactaaaatgtcactgtcattattattatttgctttatttattaaattgaatcctatggcacgtgctgttttttcccattaggtcaacaaccttcaacaatgaacaatgatgtatattcatgtcttcatacatttctttcacacatagtatacgtgatagatagatgataggcagtcagattggtggatgggtgagtggatggatggataatacaagtgatgatagatggaacatagatagatagatagataggattgattaaataagataagatgacgagcagcaggtgtccaatccacccctgcagtgagggcagatatttaagggtcttgtgggggtaacattgcaaactgcgaattgggagaattgctgaacatgtacattgcttattatcctctcactggtcataattaagaattctacaggcatgaaaggatgggctcgtgatggatactctggggtggcctgtaagtgccaagaagcagtttattgttgtgtgggagcagcatttgctgggaaaaggaggtatatgtcctgccagaagcccacggaatgaaagaggccactgcctttggtaggatgtccctgaggccatggcccaggttgaatttgttctttgccaatttatatggtggtgggttatactcaggtacagcagaaatcaggaaggggccaggcggcctctgggagactcgtggggctgtcatgtggaaggtgctttctcttccgcaggcttctctgtcataggaaggaaagccacttaacatttcctagtccattcattatcaattacatgaattatgtatgactttctgaggataattgtgttcttggatgccagaaaagttgctttctaaattacttatgaagtagaaccaggacaaacatggtctaaacaccaaaatacaactcccacttgcagacacaaacccaattcccatcacctcaaagttgctaacaaataattgatatgaattttcaacctaattcacataggcttttggcatggaggtgaaactgtacaacaaagtaggtagaagacagagtgagagaagacacttcctggaaaagtttattcatccactgctcatgaaacaaatatttactgaactcttagcatgtgtcaagggcaatgctaagtgcttgatatacatcaggaacaaaacaaaaagatatctgccctgggggagcttatagtatagggggtgatacagagaatgaatgaaacataataaatcaataaaccacagtgtgggctgggcgcagtggctcacgcctgaaataacagcactttgggaggccaaggcaggtggatcacctgaggtcaggagttaaagaccagcctcgccagcatggtgaaaccccatgtttctactaaaaatataaaaattaatcaggcgtggtggtgcacatctgcagtcctagcaactagggaggctgagacaggagaatcgcttgaacccgggaggcggaccttacaggtcattgtaggaactcttagtgaataaggtcccgttggaggattttgagtggaggaggggccctagctgacctacactgtgaaaacatcaccctggccactgtttcagaagatgccatagagaggcaaggagaccaggctgctgctataatctgggtgagaggtgcggatggttggaatcatggaagtagtgagattcaatttggatccagtttgaaagtagagccttgctgatgtgatggatgtggctcgtgatagcaagagaagcatcagggatgatgtcatggtttattctgagccattgggaagacaaacctgccttcccctgtggtctgaaggctgcaggtggagcaggtcccgggggtcaggagttcgagcctggccatgctgagtttaagatgtgcattagacacctgagtagggacctccttcaccatctgtaaggaactggtaatagcaataatcagtataataatcaagcataatcatggcaaaaatcactgcaatacatagctgtcatatttacagttttaactttttcaaatataaacttggttacctgtttccctgaaagtttagggacattttttttctggtaggaagactacttgccaagaaaatttcattttctttatatttagagtcaagttagcaaaaagcgataaaataaagagtatgctccttacgaacttcgcccgaaaatccttttgctggccacttattttgttgtttggccctaaaagactgatgacagggtaagaactgaaaccattctgtttacggagttcctcaagtcatggacagtcctgggaaatgtcaagtccttactggattacctgaactggttggaagggagctgtccaccagtgcttgctcctcatggtttcttgcttttgccttggtgatgtggttgaattccccactgccaccctacacccaggcgtacttcttgatttcgaaacacactcatcaccatactcttgagaccagtcttgttgcaggcagtggctcaccctctagtccacatccctgacctctgcactcatggtcctgaagcagagctctgggattctcttcatccaaacccccagtgacttcccatccatccacagattccaaaactggtcactgcatatttctatatcaggcgtaattctagctactatgaattaaaagcttcttatgaagctgagtctctgttaggagaaacaaaccaataagaaaatcagcacacagtgtgttgatggctgatgcgtgggtgggaaagaagaataaagcggggtagggactgccgggtggcagggagttgccattttctccggggctgcggaggatgtggcatctgagcagaagctggtagaagggaagggcacggcagtggcccaaggaggcaggctctcgagttcgagaggtacccgggctgtgtgtctggagaagagtgagccaggctgggtggggaggggaatcagggagccagggaatggggaggtcagatgacgagaggctttaggtttcacttggagatggaaagtactggattgtttttgttttgttttcataatatattcttttattgtgataaaatacatataacataaattttaccatcttagtcattattcagtgcaccttctgtggcatagaacattcacactgttgtgcaaccatcaccaagatccatctccagaactttctcatcttcccaaaatgaaactttgtgctcatgagacaactcccaactccttcctccccacagcccctggcaacgatgcttctactttctgtctctatgattttgacttatgtaagtggaatcatccagtattcgtccttctgtgacaggctcatgtcacttagcacaaagtcctcaagctttatcaatgttgtagcatgtgtcagaactgccttcctttgtaaggatgaatgatactccattgtgtgtctagactgcatttccattatccattcttctgcccatggacacttggattgtagcattgggttgcttggggttttttgttaccagtttttatatattatctttattattatttgtgtatatttaaagaggacaagtgcaatttgaatggaacatggagatattgtgtagtggtgaagtgcaggtgcagtttggatggaacacggagatactgtgtagcggtgaagtacaggtgcagtttggatggaacacggagatattgtgtagcggtgaaatacaggtgcagtttggatggaacacggagatactgtgtagtggtgaagtacaggtgcagtttggatggaacacggagatactgtgtagtggtgaagtacaggtgcagtttggatggaacacggagatactgtgtagtggtgaagtacaggtgcagtttgagtggaacatggagattctgtgtagtggtgaagtacaggtgcagtttggatggaacacggagatactatgtagtggtgaagtacaggtgcggtttggatggaacacggagatactgtgtagtggtgaagtacaggagcggtttgagtgggacacggagatactgtgtagtggtgaagtacaggtgcagtttgagtggaacacggagatactgtgtagtggtgaagtacaggtgcagtttgagtggaacacggagatactgtgtagtggtgaagtacaggtgcagtttgggtggaacacggagatactgtgtagtggtgcagtacaggtgcagtttgggtggaacacggagatactgtgtagtggtgaagtacaggtgcagtttgggtggaacacggagatactgtgtagtggtgaagtacagatgcagtttgaatggaacatggagatactgtgtagtggtgaagtacaggtgcaatttgagtggaacatggagatactgtgtagtgaagtacaggtgcaatttgagtggaacatggagatactgtgtagtgaagtacaggtgcaatttgagtggaacacggagatactgtgtagtggtgaagtacaggtgcactttgagtggaacatggagatactgtgtagtggtgaagtacaggtgcagtttgagtggaacatggagatattgtgtagtggtgaagtacaggtgcaatttgaatggaacatggagatactgtgtagtggtgaggtacacgtgcaatttggatggaacatggaggtattctgtactggtaaagtacaggtgcagcttgggtggaacatggagatattgtgtagtggtgaagtctgagtttttagtatatccatcacccaaataatgtacgttgtacccattaagtaatttttcatcatctaccccccaccaaccccctcacccttttgagtctcctgtgtccatcattctacagtctatgtcctgtatactgattatttagctcccacttgtaagtgagaacatgtggtgtttgtttttctgtttctgaattgttttccttaagatagtgacctccagttccctccatgtatctgcaaaagacatgatttcacttttttatggccaaaaagtattctattgcgtgtatatataccacatccagtcatccatgggtgagcactttggttgattccatatctttgcaattgtgaatatcactgtgatacacatatgagtgtaggtatctttttgacataatgatttcttttcctttggatatatacctagtagtgagattgcaggatagaatggtagttctatttttgattatttgaggaatctccatactgttttccatagaagttgtgctaatttacattcttaagaacaatgtataagtgtcccttttctctccatcctccccagcatgttatttttttgtctttttagtaatagccattctgactgctataagatgatatctcactgtggttttaatttgcatttatctgatgattagttatgttgagcattttttcatatgcttgttggccatttgtatgtcttctttttaaaagtgtctattcatgtcatttgcccactttttaatgggattatttgggggtttttgtagagttgagatttttataaattctggacatagtcccctgtcagatgcagagtttgcagatattttcactcattctgcaggttgtctgttcactctgctgattatttcttttgctgtgcagcagctttttagtttaattaagtcccatttgtctatttgtgttttcgttgcatttgctgttgaggtcttagtcatgaattctttgcctagaccaatgtccagaagagttttccctaggtttccttttagtatttttatagtttcaagtcttacaattaagcctgtaatccatcttcagtcgatttttgtatatagtgagagataggttacccctctcaggaacagtgagtattagaggaaaaagaattcgaaggaagaaagaaactgtgtgcccagcattgcggcccattaactgtccttccactttgatattcacatagacgtcctcctgttgagggaggctggtgaaagggaagcagggctgaagaataccaagggccttctcaatattgtgaagtactcttttttttttttttttaacttttatcttaagttcagggataatttgttacacagaaatgatttgttctcatcatttagctcacacttataggtgagaacatgtgttatttggtattctgttcttgtgttagtttgctaaaaataacctgcagctcgagctcctgacctcaagtgatccgcccgcctcggcctcccacagtgctggtattacaggcgtgagtcatcacaactggcctggccaacatggtgaaaccccgtctctactaaaaatacaaaaattagccgggcatggtggcgcacgcctgtagttccagctactggggaggctgaggcaggagaattgcttaaacctgggaggcagaggttgcagtgagtggagattgtgccaatacactccagcctgggtgatagagcgagactctgtctcaaaaaaaaaaaagaaagaaagaaaagaacaacctccagctctacatcctcgcaaaggacatggtctcattctttttacagctgcatagtaatcattggattgttttgagcccacctgtaatgcgatttgacttatggtttcaacgattcactggctgctgagtggaatggactgtggtgagaagggtgggaacagaccagataggaggctgtggccataactgcgtggactagatgatgatggcttcagtcaggaatttagcagtgcgagaatcagaatctggatagattctcaaggtacagccaagagtatttccttaaagatcacagggatgtctccaaggagtttggcctaagccgggccgtggggggaaaccgcaggtggagcaggtttggggaggaagattaagagttctgtttggcacttgctgagttgtagttgcctgttgaattcaagcagtgatgtcaggcaggcaattggatgtgcaagtccagaattcagaggagaggcctaagctggagatgtccatttggagtcactagtatattcatggtgtgcatgccacaaagtggagatcgccaaggcagtgagcttacatagagaggggggcccagcaccaaccctggatccctctaggattaggaggctgtgggaagagagggagccagcagtgaaccctgagcaaaagtggccatgatgtcttgaaggccaagacagtgtttcacggggagggtgtagtcagccctgtcaggtgctaatgatgagccaggtcagatgaggaccaaggtcccctgaaagcagcctgaatgtcattggtgaccctcatcacacaggagaaaccacacttccttgtccagcccagccttcttttttttttttttttaaagactttgtttgtccctactctaccctcacaggtcttcttacccattccaggaccatgataaatatttgctgagtgaatcggtgaatgacaggccttactttggttgagtcactctgcagggagtggaaggaatcgccactctccccagactctactctcctccaatcactcaccctgcactccaagctccaaagcaaaagagcgcctctgcccgttttactgctgtccctcttccctcacagtgtggcccaggaagctcagaaagtggctgtggctggagcagaaggccaggaagaggtactaagccaggctttggggctttcttatttgattgtttggaattgtcaggaattccaagaatgttgggactatctctgtgcgaatttaaatctgaaacgcattagaaagttagataagtgttaccctcatgtaacatctgccatgctacccacctggataggataaatagtagagtttttaatgaagttattaaatgttcagagaggaattaatcatgttgagtgactaattccaactagaaactcttgtaatatatatagatccagatgtttctcttgggaaagaaaggagtcccattcccaggcatgtatccaaacggaatgaaaacatacatcaagactaaaacttgcacacgaatgtttatagcagcattactcaataatagccaaaaagtagaaacagcctaaatgttcatcaaatgacagatggatcaacaaatgtgtccgatccatgtaatggaatgccgttcggcaataacaaggactgaagtgctgacacatgccatatcagagatgacccttagaaacatcatgctaagtcagagaagccagtcacaaaaggccacatattgtgtgactccatttataggaaacgtccagcataggcaaatttgtagagacagaaaggagggaccaggcatggtggctcgtgcctataaatcccagcactttgggaggccaaggcgggcagatcacctgaggtcaggggttcaagaccagcctggccaacatggcaaaaccctgtctctacctaaaaaacaaaaattagctaggtgttgtggcatgcacctgcaattccagctgctaaggagtctgaggcaggagaatcacttaaacctgggaagcggaagttgcagtgagctgagatcgtgccactgccctccagcctgggcgacagagcgagactctatctcaaaaaaaaaaaggaagaaagcaggaggctgggggaggagaaatgaggagtgtctgctaatgggtcatgcagaattgcttttcttggtgataaaaatgttccaaaattgatggtggtgatgaaggcacaactctacaaatattctagagagaccattgaattctacacttaagattgttgaattgtatggtatataaattatatctcaataaagctgtgacatgaaaaaatagaaagaggctgaggtgggtggatcacttgaggccaggagttggataccagcctggccaacatggcaaaaccccgtctctactaaaactacaaaaattagcaaggcatggtggcatacatctgtaatcccagctacttgagaggctgagacatgaaactcactgggccccacaaggcaaaggttgcagtgaaccaagatcaagccactgcactccagtctgggcaacagagtaagattctgtctcaaaaaagacaaacagacaaaaaatagaaagagggaaaatgtaaaacttgaaatatttgagtccaagaactggaagaagtatttaagattatctagtgcaaaccacaagtatagaattacaaggtgtttgaatttctttggacaatattctttcccttttatgtcagttatttgttgacagacttacagctactgcagaattacagaggggctcagtggctgcctttgaaatctttccttttgtatgtatgtggaaattgtaatcccctcatacctttaagctagtgcaggtgttgagcttcctgtagccactgaggttccccagagctaggggctgcaccttctcagaacaaaagctcaatagaacaaaaacccttggctgggcagggcggctcacgcctataatgtcagcactttgggaggccgagacagatgcattgcttgagctcaggagttgtcagaaccaggctggacaacatagcgagaacctgtctctactaaaaatacaaaaaaatagccaggcgtggtggtgtgcgcctgtggtcccagctactcaggaggctgaggtgggaggatctcttgagcccaaaggggcggaggttgcagtaagccgagatcgcatcactgcgctccagcctgagtgacagagtgagatcctgtctcaaaaaaacccttgttggttcccaattaggacactatcagctaattttatggtgttgggtgcaagtacatctgcccattgataacacagagatcacaggcctgcacattgcctggcaggtgtgagctgttggtcccagtggggctgaatatggctggaccagtcccagctcgtcacctggaaaactcagcccggagcctgcagggaggggctgtccagtggtgggtcactagcatccccttaccccacagaggattgaggcttggtttacagcatgcagcccctcaggtacatttcagagctgcatctcacgttgtttatggcagtattctgctaccccttttcttccctgtggcatatttttcctagtcatctgttgcccttctgttccatccacgctggctataagtgcattggcctggacaagtcacattttcttgggccgttcctgaagggtctgaaggctgagagcaaatccaggaatctgtgggtgtggttgaagctcagttctgaatgcagtgcccttgggccgccccccacaccccgccgtgcttatgatctgagcacagcccctcctgcagctcagaacctgtgcccccttctctcttctgcaccaggacttaatgtggtgctctccacatgcaggtgttctgtagatgtttctagaatttcctttacttaccatgtgttgctcccctgccccaccattgaaatccgggccttgccacatttcccaaaagccacaacgccacattcctgggtgccttccttgcacccaaagccgccaaaggagcctcctggaccgtcccacggccccagcgcagccctccccacggctgatcgccacactcttgactgccccacggctgtgcttgtcctccctgacaccacatccccgcacccccactcgcttctcctttgtctttccagcctctttcaccatgtcctcctgccccttgcccctcacagactctcctcctttctgccccacccaccttcccctgtgagctgtgaactggtcagtcctggccttagcaccagcctctgcccaggaatactggattatcccttggaccaggcgaggaaactgttaaaactgttaactgtcagcagtcggagctaagaacccacccaccccagccgggattcgaaccccagcactcagataccaaaatctatgctcaaattgccataaacattatttcatgctttctcattagaaacggtgtgttttacactaaaatttgccaacagaaaaatatatttaattctatagtcactgtcagcaagaatatagcaagcccacctttacagatatttgctttaaatttaaccttgttcccccaaaaaagggatctcctttctccattttgcttctcaacaggtaaaacagaaaggatacggagtgactaaaaagaccaagaataagagtaataccctaaaatgttacataattcaagcttgatgttccaaggagaatttttgtcagataacttagaggcttgtctggaagcaaagactaaagtcgtgattctttgaatcttttttccctgatgaaaatacctaattattttatttctgttcccacacaaataagtttctcttgtgagtctctttggcatgctgcaagtgcacagctttcttagagaattaggattttacagagagaatcttaggtctatgagtgggagtattgtgaaaagtcaaaagctaaaaaattaattttgtgggaaaaaaaatacttgaggaaaattctatgttccatcactggagactcgatttatttaattctgtactgtgggaactgattagtaaaagtttatactttccacagtttttttgtgagattataatttggaaataaaagatagcatccctagacaaatcttcaagtatctttgaaaaaatgagtaaaagcagtagaaatcctgcaactggccctggggggctatgaaggtcccttggcttcatcttcctgtacttgggaacctgcagggaattccgtttctgccccaggcctcaaggatcttgagagaattaatatgtgaaattagcaagcttgcaggacacaggaacaaatacagagatcaattgtatttctgggcactagaaatgaaaaaaatctgaaaaatgaaatttataaaacatgaacattaaaaatgacattcaggctgggcacggtggctcacgcctgtaatcccagcactttgggaggccaaggtgggtggatcacctgaggtcaggagttcaagaccagcccagccaacatggtgaaaccctgtctctactaaaaatacaaaaattagctgggtgtggtggcgcatgcctgtaatcccagctactcgggaggctgaggcaagagaatcacttgaacctgggaggcggaggtgtagtgagccgagctcgcaccactgcactccagcctgggtgacagagtgagactccgtctcaaaaaaaaaaattaagaaataaataacatccaaaaaagtttacttggaaaaaaatttaacagcagatgtaaaaaatctatatgctgaaaactacaaaacattattgagataatttaaataagatgtaagtaggccaggtgtggtggctcatacctgtaatcccagcactttgggaggccaaggcaggcagatcacgaggtcaggagttcgagaccagcctggccaacatgctgaaaccccatctctattaacgatacaacaaattagtcgagcatggtggcacacacctgtaatcccagctactcaggaggctgaggcaggagaattggtggaacccgggaggtggaggttgcagtgagccgagatcgctctattgcactccagctctggcgacagggtgagactccatcttaaaaaaaagaaaaaaagacataagtagagaaataacatgttcaattatgttcatggattacacaaccattaactgccattaaggtggcagttcttctcaagtgacccatagattcaatgtaatcccaatcaaaataccaacaggcttttttataaaaattgacaagctaatgctaaaatttatgcaaaaattcaaaagacttagaggcttgtctggaagcaaagactaaagtcgtgattcttcgaatcttttttccctgataaaaatacctaattattttattagaatagccgaaacaatgttagaaaaggagaacaaagttggagaagttagaactgcctaatttgaagacttactagaaagccacaataatcaagacagtatagtgctagcatgaggagagagctagagatcagtggaacagaattgagaattcagaaatagatccaccttcatatggtccattttaagagagatgtcaagcgcagtggcatgtgcctgtggtcccagctactcaggaggctgacatgggagggtggcttgagcccaggaggtcgaggctgcagtgagctgtgattgcaccactgcactccagcctggggaacagagcaagaccctgtgtctaaaacaaatttaaaaattaaaaaaaaattttaacagagagccagaggtactaaggattcaaggagaaaggatagtcttttctctaaatgttcaggagaagctggatatccctatggaaaaaaagtgaatattgaccctttccttacaccatacccaaaaactaatttgcatggatcataggcctaaatgtaagagctgaaaactataaactttaagaaaaaaaatggaagaaatattttttactaagtggtaggcaaatatttctttgatagaacacaaaaaaaggataaactctaaaagaaaaaaatggattaattggacatcagaatttaaaactttgttcatcaggcacagaaaaacactgggccgggcacggtggctcatgcctggaatcccaacactttgggaggctgaggtgggtggatcatctgagaacaggagttcgagaccagtctgaccaacgtggtgaaaccccgtctctatcaaaaatacaaaaaatattagccaggcattgtggcaggtgcctgtaatcccagctacttgggaggctgaggcaggggaattgcttgaacctgggagacagatgttgcagtgaccagagatcattccattgcactccagcctgggcgacagagcaagactctgtctcagaaaagaaaagaaaaagaaaaaaaatgaaaaacaaaacaccatatggtctcatcatatatggagtcttaaaaagttgctcttggccaggtgccactagtggctcacacctgtaatcccagcactttggaaggccaaagcaggtggatcacttgaggtcaggagttggggaccagcctgaccaacatggcgaaacgctgtctatactaaaaatacaaaattaactgggcatggggtggcacatgcctgtaataccagctacttgggaggctaaggcaggagaatcacttgaattcgggaaacagaggtttcagtgaaccgagatcacgccactgcactccatcctgggcaataagagtgaaactccatctcaaaaaaaaaaaaaaaaagttgatttcatagaagtagagagtagaagtggttaccagaggttggagaggggaaagtagaggagagggaattggaagaagctgatcaatgggtacagagttacagttagacatgaagaataagtttgggcattctgttacacagtagagtgactatagcaaataataatgtagtgtatatttcaagttagccagaagagcagacttggaatattatcgccccagagaaatgataaatatttaaagtgatagatatagtagttacccagatttgatcattatactatgtatatactcattgaagcaccacattataccccataaatatgaagttattatgtgtcaattatgtattagtccattctctatatatttctttatagtcactgctataaagaaatagctgagactgtgtaatttatgaagaaaagaggtttaattgactcagttctgcaggctgtacaggaagcaaagcggcttctgcttctggggaggcctcgggaaacttagaatcatggcagaaggcaaaggagaagcagacatgtcttacctggccacagcaggagaaagagagaagcggggagatgctacacacttttaaacaagcagctctcacgagcactaagtcaccgagggggaagtctgcctccatgatccagtcacctcccaccaggccccacctccaacattggggattacaattcaacatgagatttaggctaagatacagttccaaaccatagcagattatatatttttaaatgttttaaataaaaaaataaactttgctcatcaaaaaatacttaagaaaaataaaatgcgaatttgggagaaaatatttgcaaaacctatagctgataaaggattttaatccagattatttgttgtaatctcttacttttatttttaaaaaactcaataataagaaaacaattgttgagccaacagtttcataaaagatagccaacgtaattcatcattagggaaatgcaaattaaaaccacaacgagataccactacatgcccactagaataattaaaattaagaaaatgaagccaagcactggtgaggatgtgcaatactagaacccctaaacattgcccttgacaatgcaaaatggtgcaaccaccatggaaaacaatttgacaatttttaaaacttaaacgttcacttaccataaaaccctgcaattcccatcctgcccaaaagaaataaaaataaatgtccatactaagacttttacacaaatagtcctagtagcactattcacaatagtcaaaaactggaaataacccaagtgcccaccagctggtgaatggataaataaaacatgatatatccataaaatggaatagaactcagcaatttttttattttttatttatttaatttttttgagaccgagtcttgctctgtcacccaggctggagtgcagtagcacaatctcagctcactgcagcctctgcctcccgggttcaagcgattctcctgcctcagcctcctaagtagctgggactacaggcgcccgccaccacacccagctaatttttttgtatttttattagagacggggtttcaccattttagtcaggatggtctcgatctcctttcatgatccacctgcctcgggctcccaaagtgctgggattataggcatgagccaccgtacccggccactctaattttttttaaaaaggccagcctggccaacacggtgaaaccctgtctctactaaaaatacaaaaattagctggatctgatggtgggcacctgtaatcccagctactggggaggctgaggcaggagaatctcttgaacctgggaggcggaggttgcagtgagccaagatcgtgccactgcactccaacctgggcgacagagtgagacgctgtctcgaaagaaaaaaaaaaaaaggaacaaactgttaatgtacgtaacaaaatggatgaatttcaaaaatgtgctaagtgaaagaagccagtcagaaaagactatggttttatttacatgaagtttctagaaaaggcaaaactatagagacagaaggaactgagtggtggttggggcctggggtggtggcacggcttggctccaaaggaggatgaggcacctttcgtgtgatagaggaattctaaaacctgggtgttggtggttgcatgactttataaatggatgaatttatggcatatatagtatactcaaaaagttgtttaaacatgacactaataataattgaagtaggctaagtcctaagggaaaaatagatgtgtggggtatattgcaaatttgtacttgtcctcactggtctcttatacccaaggaactgctattgagcagagaacagggaagctagccagcctcagagcatgcttttgaatccaggtttgaccacttcctagttaagtgaacttaagcagttttatgaagtattctcgatggttctcatgttgtcattgaattacctgcacagcaggattgtttgagacagatagaccttatacctaggctctcagaacattgcctgggcactcggtaaatgctaaggtaaacgttaacctcatgcagttgcttagttgttgaacttgttgcctgtggcgatcacgcttctcgctaggaaagatgctttcccctcaggaactgcaaaggcttttaattggcttgttttcatgtagttttctttttgtttggttgtgttttttgagacagatttcttgctctgtcgcccaggctggagttctctgctcactgcaacctccacctcccaggttccagtgatctcctgtctcagcctcttgagtagctgggattgcaggtgcgtgccacaacaccgggctaatttttgtatttttagtagagacgggcttccaccatgttggccaggctggtctcgaactcctgggctctggtgatccgcccgcctcagcctcccaaagtgtcggtattacaggcgtgagccaccgcgcacaacccatttgtgaagttttttttaacgtggtttctgaaaactgttcctcaatagaattttagatatactggccaggcactatgcctcatgcctgtaatcccagcactttgggaggctgagacgggcggatcacttgaggccagcctggccaatgtggcaaaaccccatctgtactaaaaattaaaaaaaaaaaaaaaaattagccgggtgtggtggctcctgcctgtagtctcagctagtcaggaggctgaggcacgagaatggcttgaacccaggaggcagaggagaattttagataaactgtgtaacattaaatttcaggatggacagaaattatacataacaaaatcatagtgttataacactgtaaaataacaaaataacagatccagacttttaacttgatattcaccagatacctgaaaacagaaacaacggatacctactagctcattctgttatccaagggataaaattgagtaggtgtattttaaatgtatcagacctaaactcgagttttaaaaaattcaatttaagtggttactgtcctgaaactgcctgtttctaaggctcatgtgattacagtggtggacattattcactaggttcccgtaaaaggttacattaaacaacttaaacgactgtgtgtgcttccacttggtccagaaaggatttagtgctgctcacaaagttacaatacaagttaataaagcaactgaaaatgtgggaggatgaaggcaggaacggggagagtgagttttgtggaaccgcagtgaagttactgctcagtgtgtctgaccgaggctttcacacgtgccgggacgcaccctgaaacttggtttctaagctttcacacagtgaactcagtgacgtaaatgaaagcagtaggaaagtcacaggatccacagattaaaaatgaataataaaatgtaaaaagcagttgcttgagaaatgcaagagtattcccgacactaaaattagaagtatttttcataagtcaccctagaaagaatattgtgcgaatgttgggaacattttcacactcaacccagggatgtggtccaccagcccacagggcagggctcagtgtggaccaccggccacccccagcatggcgagtgggagcagggcggcctgaccccacagccgccagacagacggcaccacactcacgtcaagtgatgggaaatagctctttgatttttatttcaaaatgaaaaatgtatcccaaatgtcagtgtaaccaaaaagtcatttgactgtgttatattagcacagaaattatgcaagaaatgttattcttacacttcttattgtcatctgtttgtttgcattttaaagtaattaagaagaatttaaaagcaaaaaactttcttttactcatctgagaatttcatgttatctttgagtatactttcaatataaaggtagtcgtagatagcagtatcagaaggaaaatgttgtcaatatgaaatagagtcattacatactttaattttttaaactttagtttaaatgttgatttaaaaatcaaaattgtacttcaaaattttaaagccttgcttttaaaaaataggtttaaacttggtatcattatttttattttatataactgaaatccctttgaatataaataacaaatattcacatatatcagttgctgaacataatgaagatcacatggcaattctcatattcagtaatacagaaaaaattaagaaatttaacttagtaattttctttttatgctttcagtttttatataccctcagatgtcaaaaacaggttacattttactgtgaattactcttttcagacacatacacacaaaaaaaaccctgaaattatttttatttagtattatttatcttagttgctaatgtagacatactaaaattattcttcatattaatttctccgttgttttttaaaatgtatgagatctatagggaaggaaaaaaactagagcctgtgaattaaaatgacaacagacaagagaaaagacatacaaattttattaatgtttttaattttatatgcacaggggcgtcacagaaaagaagtggaacttataaaaaaaaaagttagagttgggagcttatataccattttaacaaagggtgagaaattgtggaagaagtgactacaaatgaaaggggatttgggctcctagggttgatataattgtgagaaagggctattttagtaaggtttgcttatgcagactcatcttggtgacagctctctgtctctgcgataaaggtcactcttatcctagtacagggtgggggatatttatgctcttttttaggcagaaagggggagagcagacagctcttcttatatctgttgtttctcagttgccttcagctcaaaataatcaatatgccagtgtcacataattgggggtggcgtattttgatccctatcagaatcctagcctagctctgaacaaatgtttaattataccttaagaagcttcactggctggctaaatatttaatgacttcgcagaatccttttctatgtgtttatgtattttttagttgagataatggtattacggctattttttaaaagtctttatgttttagaaataatgttgaaataacatgatatgctgccttataaataaaatatttgtttcaaaataataaaagcagtgtaaaagtggatgagatatggatgaaaagaaattggccatgtgttgataaatgtggaacctgagtaatgggtacctggagattcattctctctatttttataagtttgaaacttttccatgtaaaacattgaagtaacaatcacaacagcagccctggaattcaccatgaagtttttagaaccctttaaaaagtaaatatgtggaatcatggggacttagctgtatgctagtccaacatgtttacccatgaggaagttgaagtgaagagagattgttgtcgcttttgtgtttcttcagtgttatctaaatcacctacttaaaaatcacagtgcctacaatccctgttttactcttgctatcaacacatgctccagaaattctgtatcttcattcttggttcaagcacttctctgtaattctctcaggcttcagctcaaacctagagtttggtctcctataaagcagttccagtcctcaccagtgaatcttacccaacaacaggacattaagccttatcccatgaactgaatttacacttggcatctttgcaatgtatttgtgaatcgtggaaggaccacagaagttactgagctttacagacctgtgggaatcctcatgagtgtcttgtgttgctttaacaaggtacccttgtatgagatcccctgtactttatccagcgaagagtggtttttctaaaatagtggttttaaagaaacccagtagaaaactaaagaatagaagatgatttaatatatacataataaaaggtggtagtatgcatagtggttaaaaacacaggcagtggaataagatattctgctattacctgctgtgtgcccttgggtggattacttaactgatctgagcacaatgacaacagcgacctcttccagttttgtgagagttaaatgcgatcatgtgttaaagtactgtgcacagtaccctcgacaaaataagaactacgtaagaactattttaaatagggattatcatgtgagtaaggcccttactgtgacatgcaggaaattaacgcaaaatgagaaagggtattgcgaaggaagtgagaaaacagcagaagccgaagcctgaaggaatgagctgaggcctgggggcgctgaggatcccagccccgctgggcagggcctccaagctggggagctgcgggggtgcactgtttgcagaggcaggtggggcggtgatactgatatttctgcaggagggagccgggaggtccttgagcaggggccccagtaaatgcttcagagctagaatgtcctccctttccagctcaccaagggctgaagcacaagggcctcccgcctccctgcagcgcacatccgccctctggcgaggccaggccggcatccagtgtggcccggtggccagaacgcgcccaggccatggccgccgctccgtaggcctccgtttcacgggtgctaagtaagtcgaaaagcaagggcatctgataggagcctcagtttctcctccgcctgccaggaggtcttgtgcgtgcagagcggcggatgcgtgtggcaccgcaggcgcggggcgagggcggctccggagaggcccaggggcttagcgcgcctggctttccacagcccggcttcgggcctactcaagatggggtttctcgggcggggcgtggtgggcgcgcctgtggaatcacttgagcctggagttcgagaccagcctgggcaacattatgagacctcccttcccatcccccccaccgccaaatctcaaaacaaacaaacgaacaaacaaattagctggatattgtggtacacacctgtcgtccccgctgctcgggagcctgagggcagaggatcgcttgagcctaagagttggagaccagcttgggcaacatggtaaaaccccgtctctaggaaaatacaaaaattagccaggcgtggtggcacgcggctgtagtcccagctacttgggaggctgaggcaggaggattgcttgagctcgggaggtcaaggctgcagtgaacccagattgcaccactgcactccagcctgtgagaaggggcagagtgagaccacgtctcaaaaaattaaagttaaaaattaaaaagatcaatttctcaaccctctcactgacctctagccacatgcctgttagctctggggtcagcaccgtgtgggctcacttccatggctggttgggtagtagggtgaccacacgaccgtaccccacacggtttggagccctttctgccctgcagggcctggagcaatattgtttttcttttttttttctttttcttttttttttgaccaaatttagattaattactccagtcttggtcgtttttaattccatttggaaacctattatagtgaataactcttatgtgaacttttataaaatctggtgtctgtggttcctgtgtttggataaatccagttaaatttgtttcaatgtagcatgagtctatagtttttatatatcatacgtctgtcgtgtccagagaaatcaggtgcccagagctggcaactggaagacccatcaccatgaggcagcgatgtcactctcttcatggccatcttgataacggcataatgcaggattgatctttacacgtgtgtgtgtgtgacgtgtgcgtgtgtatggacttggatggctcttcgaaggaaatctttttaaggaaacctacaaactcctttactgggttaatgggagcatcagaggaagattccagaaggaaacataaacctagggagacaagatgaaaactgagagctttagccacccccttcagggggagaatgtctctttttttgtcaactgggaaccatttgggtttgctgataatggtgacagacagatacagatatagactatgccataacttacaagattgtctctgatactgtgaaatcagaattggattttctaaacgctaataaagcctacactctgggtacctcacttctactccccttccaaggatttatacctaattttgtattcatcatttagcctctgttttttcaaagagagccttccaaattgtgagcattaaacccctcacagtgcttggatccacctttgtatggaattgtgagtccttaagaaaaagtgccagtccttctttttttctccaaagaatctgtgttgattcctagaaatgtggcagctgataagcatgaaggaggagtcgctgggacaggccatggagcctgagaaccctgaagatcaaaggcaggcaaataactgctgtgggaagggcgtgaatatccccacaaagtgttttgtgaacatttacgtaacttcttttgtgttttgctactaatgtagtcatttgcttccatagcccttttgggtaatattaccaatatgaactcataagccgttcatttacttttgagatgaaaaatgttcttctttcagagcatcttgcttgccataataataggtgaagttgagcacagtgacctcatggctctggaatgaacgaaaaatcacaattcacacttaactcctagttttttttaaacgaaaaaataaataaattatcatcctcaaagtgtaatttttaaagttccttttttatgtacctaatatgtctgggccaaatttaatccatctactcaaccatgtccattcctaatcatatctcacatagaaaacgtaaaagacagaagctaagacaaaacttgtccttataatatgcatgtttttttcatggctgagatgggggttcaatgagttaagttactgaattctaaatactttagaattatgctgttaattgtatttatagctaacatatggtattaactttgacgtaatttgcattttgggggactttccagaatgataaaacgattttgggccaggcacggtggctcacgcttgtaatccaaacactttgggaggccgaggtgggaggatcacttgaggtcaggagttcgagaccagcctggtcaacatggtgaaaccccatctctactaaagatacaaaaattagccaggcacagtggcatgtgcctgtaatcccagcttctcgggaggctgaggcaggagaatcgcttgaacctgggaggcggaggttgcagtgaaccaagatggcaccactgcactccagcctgggtgacagagcgagactgtgtctcaaaaaaaaataaataaataaacttttgcaatttgacttgagtaatgataacatgcatgcatacattttttatcacactaaacatagagtgggtgcattttactatgcagacttccacaaagaaaatctgaatgctacttgcaaaaagcagtttttgcagtttctttttccttttaactttttaaaaggttattacacatttttgtttttaatttgtaactctttcaaactttaggaattctttgaccatgtgaaaaaactttgggacgatgaaggcgtgaaggcatgctttgagagatccaacgaataccagctgattgactgtgcacaatagtaagttgtgtcctgtacaagttacagggccctttgaagaatatgattgcatgcatgattatgctgccttctcagtactgaagtttcttgagtgcaaggaatgaataattaaccttttatgacagaaatcaacttttaaaatgagacatgtttagtagatggaaaattgaaaatccagtaagaatcaatgtttctgacaaccagaaagttttgttcattttgtcctgattgttttcagttctcttcattttttgacttttacatagagctatatgcatattggtaagttaaagtgaacttccgtggttattgttatgttttgattttggagcaggggcctcaaattatattttaaaataatacgaaccttgtgatcaaggccaggctcttaaagtaatgtgatcattctgtacacattagaagtataccagaaggctgggcccaatggctcacacctgtaattccagcactttgggaggccaaggcaggcggatcacctgaggtcaggagttcgaaaccagcctggccaacatggtgaaaccccgtctctactaaaaatacaaaaattagctaggcgtggtggtgggtgcctgtaatcccagctactcgggaggctgaggcaggagaatcacttgaacctgggaggcggaggttgcagtgagctgagattgcgcccttgcactctggcctgggcgacagatgagactctgtctcaaaaaaaaaaaaaaaaaaaaaaaaaaggaaaaggacactagtgccagggctggctcattgtttttccctgaaacacttacttttccattttgttttgctatgttagatatattctattgctattagaaaataatggtccttagaacaatgttaaattattaagaagttctagatatgtttgctgttttgataattaaaaattgtagttgactagttgttttatgtaaagctgtggatagcaagaaatgaaaaattttacattttaaatctctaaactctaaaaattcatatacatagaagagattccatagcataaaatctgggaattcatagtatttggaaccaatcagtggagctgcattgtgaatgttgatttccaggagggagtggttgtgttggcccaagctcctgcttactaggttctacttccactcaccatcccccatgggatgggcctgaagcacccagcgaagcccagagagccaggctccaaggggcccatggcaagggccagaggaggaggaggagcggggagggggaaggaagaggaggaggaggaggaggagacactaagcatggctggggaaagaaagagtgctcataaagaagtgagggaggtcagtggggccagacacccccagggctgaagaccacagcaaggaacttgggttttctttcagctacagcaaccagccatcccagccataggctccaagcatgtggttgtcagggaaagtagattgcagaaggcagagaccctgtggggtgccttgggttgggctggggtagccatgcaggtgagtgctggaaactgaagggcagaactagctggtggacttaatgaggaaagggatccaggagggtacagggtgaaccacggtgccatttactgcaaaggggacatctaggagacttagggaagagatccagctctgatttggagaagttgagtttgagatgccaaatggagagccatgtggaggcatcgagcagtcagtctgttgtcagagcctggagctcggaagagaggcagatggccccagtgtaccggtcatcagctactgatggtatgcagagcctgggaatccagagcacacgaggagtgcccgcagagaggcaagggctctgggcctgagaaagttcagcttcagacaaggaagagcctcacagcacatctgggagagagggagtgcccagcagagggcacaggtcgtccgggccagatgctggagagacccggaaggaggagggctgatggtcctagtaagattgtacttaacctccttcttaccttgtccaaggacaggatgtcccatgctcagtccgcaggcatgtggtgagcgcgcttggcaaggcaaagtatagtaaagcatcgagaatggagcgcacacctgctgcaaacaccctcagaggaccgtagaaagggttagccacctccattatacactaaagaaagtatttactcatgaaaatttttaattaatgaaaaaagtatttaaaatgtcctggccgggcatgatggctcatgcctgtaatcccagcactttggtaggccgaggagggtggatcacctgaggtcaggagttcaagaccagcctggccaacatggtgaaaacctcatctctactaaaaatacaaaaattagccaggcatggtgctggacacctgtaatcccagctactcggaggttgaggcaggagaatcgctcgaacttgggaggcggaggtggcagtgagccgagattgtacacctgcactccagcctgagtgacagagcaaggctcgtctcaaaaaaatgaaaattaaaaaattaaaaatgtcctgtttcctgccatgcacgacaagtccttcaagattttctttaaatagctgggtgtggtggctcacacctgtaatcccagcactttgggaggccgagatgggcagatcacgaggtcaggagatcgagaccatcctggctaacacagtgaaaccccgtctctactaaaaatacaaaaaattagccgggcgtggtggccggcacctgtagtcccagctactctggaggctgaggcaggggaatggcgtgaacccgggaggcggagcttgcagtgagccgagatcgcgccactgcactccagcctgggcgacagagcgagactccgtctcaaggaaaaaaaaaaaaaaaaaagattttccttaaataatgtttgtaaattggccctgcccttgagtttacatttgtgaatacagttctgtggttgctctcatgttatttggttgctttcggtttggatgtgggagtttggaaaggctctcaggggaactccaatgcagtctgagcagccttgggaggcttgcaggtgctgaaaaggccttttatcttttcctcttactctcactcactctttctgcaatacttcaatcattaagcagtcatttaaggcacaatagaagctgggcatggtggcacatgcctgtggtcccagctactcaggaggctgaggtgggaggatcccttgagcccaggagttggaggctgccgtgagctatcattgtgccacacactccagcctgggcgacagagtgagaccctgtctcaaaaataaaaagacacaatagaattatgttaaactcacgtgctttagaggtgggaagaatataccaggaaaatgctagcaactggaatttctaaagcagttcttaataatattaaaattcatacacctctgcatttgaagctgttgtggaatatgcgttctatcatcctttttcagtatttcagtatttattggacaaagactggccttggagaacaccacagttctgctcaatgccacattagaaatttttctgttgtaaaaaaaaaaaatggacaagttattcctgcatcaccgtagtgatagaattaataatttgatttaaaatagaatatgtgaaaataaatcatggaaaaagaaatggtgtgagcttggcaataggcagatcggaattcagattctggccccacccccgaccactgtgtgagactttgggcaaattacttttatgggaaaattaacaggatctattctcatatggttgtgggattaaataagtagatatccaaagtcctcaaaatagtgcctggcacttagtaagcactaggtaagtgttatctcttgctagaatgtgactgatacagaaactgacacctagagaggtgcctacgatcacagttacccaggaacagatgagaccacagccaaaatctgctatttcttttagatttattccttcaaattacagaaagccacagataaaaactgccttgtgagcgaggccccagggcctcaggccaagactcccttctaggcttgtcaggaataaaacacctttagccaaagcctctgtttcagctttctgaaccctgggcctgacagaattacagaaactggttcccccttgaggcctcactatcctaggctaattgtaacttctcccgtttagctcgtttcacccattttaatacatacaggaatcatgtggagcaataacctttgcatcctaataactatcttgtttttcctatagggtcagattctggaattgagggatgagggatttcaaaaacaactaacatttcaataaatctgttagaccaacatagagctgccaaattcttttactttgccaaataagatgttagaaaaaataaaagctgctcccatctcccaccaccgtcacttcataaaagaaaggacatttcaaaatcaggccagtaacaggacatgtctcagaccacagtctgagtgcagtcctcagaccacgagactcgtgtgtcttgttcagcctactaggttttgaattccccagggaatgtgtctcattcatatttaaatgcccagctcctaggtgggtgttcttgtataaagtcagcgctcagtcaacgggcgcagtagctcacgcctgtaatcccagcactttgggaggccgaggcgggtagatcacttgaggtcaggagttcgagaccaacctgacaaacatggtgaaaccccgtctctactaaaaatacaaaaatttgctgggcatggtggcacacacctgtaattccagctactcaggaagctgaggcaggagaattgcttgaacctgggaggcagaggtttcagtgagctgaaatccgtgtactccagcctgggcaagagagcaagactccatctcaaaaaataaataagtaaataaagtcagtgctcagtcggtgctatctgaaatatgtgaactgaccaaaaaagagccagtatttgatgtggtattaacggaaacagccaaccctcatctccttgacgggtccgtactcactcgcctttccccatgctgattcccactattcctgcgtgttttccattttctttacatctaaattgctcttggaaaagctctgacttaaatcttggtgtgacagtaagtcactgtgtcaccttgctcaacagaattgcatctttttttttttttttttttttgaggcggagtttcgctcttgttgcccaggctggagtgcaatggcacgatcttggctcaccacaacctccacctcccgggttcaagcgattctcctgcctcagcctcagaattgcatcttgaaccctagtgcttatgaagaaggtaataattctaagacctcttaaagtcatttattccatggcaggagtcatgggagtcttttgggcttctcagtgatgctgaaattgttagggcctcaggaggccaggctgccaattaagagaatccagtagttcctcaaaaggttcaacatcgaattacccagcaattccactcctaggtgtaaacccaagagaattaaaaacatacctccatacaaaaactggtagatggatgttcatagcaatatttgtcatcataactaaaaggtgaaaacaaccgaaatgttcatcaaatgaagaatgtatagacaaaacgtgatacatccacacaatggaatattactcggcaatgaaaaggaataaagtgctgacacatactacaacatggatgaaccttgaaaacatcacactaagtgaaagaaataagacacaaaaaagacacatattatatgattacatgtatatgaaatgaccagaataggtaaatctacagagacagaagtcaagtagtggtttctagggaatggggagagggggaacttaagagtgactgctaatggatgatggagggtttctctttgggataatgagcaagttctggaattggatagtggtgatagttgcacaattttgtgaatatactgaaaccatggaattgcatacatcaaaatggtgagttttgtcttatttgaaattataagttatgtaaattatatcttgatttaaaaaaaaaatgacaggagagggaagaatccagggcaggaaaggcaatgggagctctgtggtcaggcctggccatgggcacggtctaggggaggactcatgtgaagacagagatgctgccttgtccttcaggcctccttggtgagtcagcggtcctcttctgaagtacaggttaaggtcagaatatgtgtttataaggcctgcttcttcatacttgacccaccgaaagtacatgcccccacacactctctccaagcctgcaaatatgtgtgcggatagggacctccaaaactgtaaagcacccatgaaaaaagtctaaggctgtgaagatctgtgttgtgctgcttggcatgcaaggaatggaaacttaccaagtgacttcaagaaaaggggggttttctcctgaggatctggaagctggtattgagccaaaggccctatggggaaaagtattctgttcttgccttcaggcgtttcaactttgccatccctgtttactccactcgtaccttgtccactccgtaatctgcagcccaattccagagggagcaggggagatgggctttgctaaggccaggccaattcttacctagctttgtcccgtcaaacaggcccactggccagttgctggggctcacttgacccagtcggtggccatttgtgtgtccctgagcaggtgctgtggtgaggcagggccagccaggtggcactgagcagctgcaggactgatgtgattgcaggactgtgagaataattattatcactgagccttaaatactgtgttttctgtaaaagtgagtgtccttgaagcattgagcaagctgtgcaaattaccagagattatattttatattgaatttcccagttcctactgtgaaaatttaaaaacaacctctactgaattatcccccaaaatgcatttcctctaagtcctaatactaagtgattatgtaaccatggaaacggttattttgggagaaagaaaatcagagagaattggatctttagcatagctttataaaatcggactttgcttaatggaactttaaactccacagctcacagagtgtaggttcttatgctcagtacgacacatgataagctcctttagggtacatccatttcaataattggtttttgaattctctaaggagagacactatcccagaaaaaaagaaaagagcagcgaaaaaagtcaagtgatttttctgctgcagtcccagatctgttttctgtcatctttcaggagttttcttgaccccattggccctctttggcactgatttgatcctatggctgtcaagtcctggaatactcagctttcaggacaatctggaaattattagcacaaatgaaatttcaacttcaaagttaattttttgaaggtcattttaaaatgaaaggaattgacctggcgcggtggctcacacccgtaatcccagcactttgggaggccgaggtgggctaatcacctgaggtcaggagtttgagaccagcctggccaacgtggtgaaaccccatctctactaaaattgcagaaattagccgggcatggtggtgcacgcgcctttaatcccagctactcgggaggctgaggcaggagaattgcttgaacccgggaggcagaggtttcagtgagccgagaccacgccattgcactccagtctgggtgacaagagtgaaactccatctcaaaataaataaataaattaataaaaattttaaaaaatgagatgaaaggaactataattttaaattatgcatattactgtatatactgttgaacttattaaatatatagcagccacctagatgcatgtacatattcttcttacctctcattttgatctctatctctagccaaatttattttcagattttttttttttcgagtcattctgtcacccaggctggagtgcagtggcgcgatctccactcactgcaacctcagcctcccaggttcaagagattctcccacctcagcctccctagtagctggaattacaggggcccgccaccactcctggctaatttttgtatttttagtagagatgaggtttcacaatattggccaggctggtctcgaactcctgacccaagtgttctccccaccttggctcccaaagtgctgggattacaggcatgaaccactgtgccccgcctctcagatttgttttctagagctgcaaaattggaaatgttcctgtttatgagcactacaataacatttactttagctatgaaaaataaatgtagcagcagggactaggtaggtagaccagatgtctctgtgtgtggccatcagcccctgttacatgtttcttttattctcctctagaaacccttgccctgagacatccagaagaaaatttttagtgggattaccacaaatgtttttgtgtgtaaaacctgtttttaaaatatctcagaaaatctacttacttgggtggagaactgcagtggcttcccattccttatctaacgtaaccctcagacttcctatacagaaaggatgcctggaacaggatggccttcagggcctggcctctctgcccagcacatacatcacaggaatctccaatcatggcgtgaaaatcaggaccttcaaactataaaacaaaaatcacatttttgatgccttagagctggatttttcagtatttcttagaaatggaacgcttcgtcacacggaactgtatggaatgccactagcaaagagggagaagacaagtcccctggtgaggagccggagcccttgtattcgcttctgcctgctgctgtgtggcccctctgttgcctccaaatgtgaggctccccggggtgcggtttaaaaactagtgcccgttttcaaaattcataccagcagaaccaaatgcaatttatagccaatgccaaagcaaagtggtattttattaaaataaatatatgaaaccaaagtgaaaatttaataaagtaaaatttagtttacatattcacatttgtaacatttacttattataaacaaacctaaagatctctatggctatattgataagaacaaaattggaattcagtggtcttagatgacggttgagtttttcgctggactcaacatccagcttattcctgctagggaggggcgtgtgggaacatcctgacatatgcagatgagttgttgcaaatggtagcaaaaatggggtcttttgttaaggttgccttgtaattacaagaaacattttaagttaaatgatgtagaaatgtgaaaaggagaatcataagaaattttcttctggctgggcacagtggctcacgcctgtaattccagcactttgggaggccaaggtgggaggattgcttgagcccaggagttcaagaccagcctgggtctctagtgtctacaaaaaaaaaaatacccccaaaaattagctaagtggggtggtgtgtacctgtagtcccagctacttgggtggctgagacaggaggattgctggagccttggagtttgaggctacagtgagccaagactgtgccactgcattccagccaggacaacagagtgagactctgtctcaaaaaacaaagaaagaaattttgttccaagttgaattcttaacagtctctaacagctcttcacattctttaacacaaatgtgacatctgataaacgttatatttatagcgttgggttatgggttacgttgtcccctgtgagaacatggcagttgctctgtgaggagagcttgggccctgcaggtgagccccagctcaagtggccttgggcaaagcagggtgtgcatcctctgtgcctcttagggactcgcttctaccgtaagactattcaacaggtgctgcattgtctacaaaaatgaccagaacctccttccaaacaacacatttgaaagaagttgaaaatatgtgcataatatttttatgggaatttgagctacacagatagatgcatttttcaaaactcagcagatatacacttaagatttctgtttcattggacatgcattttacattgaaagaaaaagccatgaagaaatattgattcttagataacattctgtgagctgcagtatttcagagggagtgtactgctgtcttccctttttttgaaatacatcaaaaataagatgggttgaggaatggatacatggatagatctgtgattttttttttaagtacaataaaatgaagctgggcacagtggtgtttgcctgtaatttcagctactcaggagactgaggcaggaggttcactcgagcctaggagttcaaggccagcctaggcaatgtagcaagaacctgtctctaaaaagaaaaaaaaaagcctaaaagtacagtaaaacgaaaatgtcagaatctaaatagtaggtattcaagtgttcactacaaaattatttctaatttattttatgtttgaaatttttataataaaatgtagggggaataaagaaaaatatgtatatgtaaagctgtgatcagaagcttacagaaaaataaattacatagtagcacaggttaataaattgacagtaccctacaaattacagtgtgaaatgtaagacgtgtgtgtcaggttttatcacaatacttttgtttgctgaattctttgaaacacttccaaggaatccagggaactcagggaaaacaactaagtactgtactactattaataaaggtacagtttcagaattatttaagacgtgcgtcccaccaggcgaggtggctcacatctgtaatcccagcactttgggaggccaaggcaggagtactgcttgagcccaaaagtttgagaccagcctgggtaacatgttgagacctcgtctctacaaataatttttaaaaattagctgggcatagtgccacacacctgtagtcccagctactccagaggctgagttgggaggattactttagcccaggagtcaaggctgcagtgagcaatgatcatgccactgcactccagcttaagtgacagggtgaggccctgtcgcaaaaaataatactaataggccggctgtagtggcttatgcctgtaaaatcccagcactttgggaggccgaggtgggcggatcccctgaggttgggaggtcgcgaccagcctgaccaacatagagaaaccctgtctctattaaaaatacaaaattagctgggcatggtggcgcatgtctgtaatcccagctactcaggaggctgagacaggagaatcacttggacctgggaggcggaggttgtggtgagccgagatcacaccattgcactccagcctgggcaacaagagcaaaactcttatctcaaaaaataataataataaataataataataaagaggtgtgtgctctgtattgcttagtacccaagtgtagctgtaagatagctcatatttattgaaacttgccctgtggaggcacattttatgcacattagatgaactaacatagtaatcctcacactaacccaatgagttcattatctttattttgcagatgaggatataaaggcacataagattacataagactacacaataccaactattacttgattgatccaggatttcaaattttaaacctaaagattatgagagactacttagattaaaagttcaccaagcattctgtgagcatcagatgcatgctagacactgccagccactgaatgacaaagatgaatgaggcatggacctatgcatttgaaggagattgcctcagggacatcctttttctcagattctgaaggaactgtcatcaacttcacatctccatccacttcatatcttgaacctagttttccaatgaaagccaggatagctttttcttgagatggagtctcgctctgtcacccaggctggagtgcagtggcacagttttggctcactgaaacctccacctcctgggttcaagctattctcctgcctcagcctgctgagtaactgggattacaggcacatgccaccacgcccagttaatttttgtatttttagacatgccaccacgcccagttaatttttgtatttttagtagtgctggcgtttcaccatgttgggcaggctggtctcgaactcctggcccacctcggcctcccaaagtgctgggattacaggcgtgaaccaccacactcagcccaggatagcttttgatgtacatatagaggtccttatgattcaagaaagtgaaaaaacaagctcatagaagggggaaaatgtttataaatcatgcatctgataaaggacttgtatctagaatcataaagaactcttacaaatcaataataacataagtaaaccgatttttaaatcagcaaaggatctaaatagacatctcccaagtaagatagatgaatggctaatcagccacgaaaagatgctaaacatctttagctgttaggaaaatgcaaagcaaaactacagtgacattccacttcataaccctagggtggctgtgcctaaaaagtcagataaaacaagtgttgctgaggatgtgaagaaattgggatcctcatatactgctggtgggaatgtaaaatagtccagccactttggaaaacaaactggtagttctaaaaaacgttaaacacagttgccatatggcccaccaattccactcccaagtgtatgtccaagagaattgaaaatatacatccatgcaaaaacttctaggcaaatactcatagcagcattattcataataatcaaaatgtgtaaacaggctgggcatggtggctcacacctgtaatcccagcactttggaggccaaggtgagtggatcacttgagctcaggagtttgagaccagccttggcaacatggtgaaatcccttcttacgaaaaattatccaggcatggtgatgcgcactggtagtcccagctacttggggggctgaggcgggaggattgcttgagcccaggaggtcgaggcttcagtgagccaagattgcatcactgcactccagcctaggtgacaaaatgagacccagtctcaaaaaaaagcgttaacgacccaaatgcccatcagccgatgagtggataaacaaaatgtgacgcatccacacgatagaatgttattcagttacaaaaagaaatgaagtcctgatgcatgctacaacatggatgatccttgaaaacattatgctaagtcaaagccaccagacacaaaagaccacatatggtatcatttcatttatatgaaatgtccagaataggtgtatctacagagacagagtagacgaatgttgcatggagccaggtggacttgggggatgaggaatcgctttaatgtgtacagagtttcctcttggagtgatgaaaatgttctaaaagtgattgatggttgcacaactttgaatatacaacaaaaaagtcattgaattgtgcatcttaatcaagactccctgttgcaactggcttgtgagagctttacttggacacttcagtaaaattaatttggagactcctgatcattcgagtctgcctaatttcagggccttctgatttaataccaagtgggtaagatgcattatgtttcatccatgtgccacgcatggtgacagtgtggggatgcttctgagaggatgcggtatgagatccatagcatttcagattgttcatgtacttactttgtctttttaaaaatcagtttaagagagaaaggcggaagaaatgaaatagaaaagcaaaaaatactgattcaaaatacagtacccatactgaaaatatgtcttaaaaatctcttctaaaagactatctttgtggaaattggcaggtaatttctaagttgtttccataggatttggagttgttcttctccatgcagtgcgtgacacagtaacatataaatatgagatgttatagcatatatcactacttcattcctttcaatagttgaaccacatgaatgaacaactaaatctaaccaaattttgtaaactgttcattatgatgggctaactgacatgaaattattgtgtaccactgtgcctagaacaatgcctggcatataataggtgtttaataaacttgttacatgaatagatttttgtgttatcactgttctttttctgctctctctaccattcatagcccagtattcctatgtatacaaaattaatttttggctgggtacagtggctcacgcctgtaatctcaacactttgggaggccaaggcaggaggatcacttgagcctaggagtttgagagcagcctgggcatcttggcgagacctcatctctactaaaagtaaaaaaaaaaaaaaattagctgggccatggtggtgtgcacctgtggtcccagctccttgatatggtgaaagcgggaggattgcttgagtctagagtttgaggctgcagtaagccatgatcaagtcactgcactccagcctgggtggcagagcaagaccttgcctcaaaaaaaaaaaaaaaaaaaattttttttctttaaagctcagatagacgtaagcataatatctcttcatagcagcattattcacaattgggcaaaaagtggaaacaacccaagtgtcatcagctgacaaatggataaacaaaatgtggtgtatccctacaatggaatatgattccaccgcaaaaaggaatgaggagctgaactgtgctacagcacagcctcctttagagcacaagcgttctagctcagagaaaagcgaaagctgtaatcgtgcattgtgtgagcacttccttcgtcccagtgaacaataataatgtgttcacaatatcaaggaatgtaatgaaagcttttcaaatagaacttaaggtataaggaagctgctctttgataatttcatatcaaagaaagcattcaaaaaaggaagaaagtaaaacctttcttagggtagtgcatgcattagcggttagaattaaatatctttatttcaccaaactcccttgatcacataataactaggatccatgatatcaacaaaagctacctttgaactatggcattattctattaactgacttaaggaactctccacacaaatagaatttccatttacttacaattttattcatgtgacaacaattaagtgcatgggatgctcgtatttctcattctattcgatatttgtgaaaatgcagtgctctgcattatttctgtgaagaaagaatgaaagattccttatccagctactgaggcaggtagtcattgctaagaaagaaactgctttgccatgactttctgccaggatacatgcagtgactaaatatatcttctaagatagacaagacttaacagatcgttttgccaaaaaaggaaattttttattaacctcaattgaacatgtttaatgacatcccagatctcttttaaaataggagactcagcagaggtgaacactgatgcaaaggtcagtttctcattccagctcttcctttgaaacatagtgtgacctgagcaaatctgtgtgtttggtatctggggcaccccctctgagaaagctctttatctaggagtcctcagacttccctttgttaccctttgttgaccacgtgcttctcatagttagcgttcttccctggaatgatctacaggagacctggtggacgtattcgggaatgctgtgacagattcagtcaatgtacacagtcatagctgcagagaagaggaagcacccggaggcctccagtgagcaagagccatgttgaatgcactttgtccttctttctttgatttagttcacgtaaatgacattgaggaatttgctttttcttttctttttttttttttttttgagacacagtctcactctgtcgcccagactggagtcagtgctacgatcacagctcactgcggcctggacctcccaggctcaagtgacctcccacctcagccacctgaatagccaagatcacagatgtgcaccacgatgcccagctaattttttgtatttttagtagagacgaggtttcgccgtgttgcccaggctggtcttgaactcctgggctcaagcaacctgcccacctcggcctcccaaagtgttaggattacaggcatgaaccaccgcacccagccttcatcagctttcaattctcttttaacccctaaactaatcttaaaatacactgtctcctacaaatatgttaagatttactatgaagtattgtttttcagatggcagtcacagctacaatttattatatttagggcaaggttaatcatgattatttgaagacagctttgtggttcccggaaaagatatacctgctagggccgggcacggtggcctataatcccagcactttcggaggccaagttgggcagatcacctggggtcaggagttcaagaccagcctggccaaaatggtgaaaccctgcctttactaaaaatacaaaaattagtcgggcatggtgacgcatgctgtaatcccagctactctggaggctaaggcaggagaatcgcttgaacctgggaggcagaggttgcagtgagcagagattgtgccaatgcactctgcactccagcctgggcgacagggcgagactctgcctcaacaactaaaataaaatgcagtcaatccctctttttcctcgcaggtccctgcacctcagtccctgctgtgtcctgcccctgcggatgctgagactggacgttcctgttttggcccagttctgctggcctctcctgagtggccctgacacactggtccgcgatcgtgctagtctcttctgtccagggggcccctgggcttgccacactccctggggcgccgcagccgtaggtccggggaggctgcgcaccgctgggcctggacattctctcttcggctgccgcgccactcccccgatgcaggtgtcctgaggaaggaaaccaggagcttgcctgtacccaagacccgcaggaatgcggcccgggccctaaacgtttccaggaaaagtcaccttctggcacaaccctcaccctcacctttgnnnnnnnnnnnnnnnnnnnnatcaggtttgcatagggaaattacttacctatcccccatactgttcattctctagcctgaaactcagtaaatgtttgtggaatatacgtatgaactggaagattgtagcccaactccatcaaataacgaaagaaaacatatgttatattttagttcagattttttttttttttgagacggagtttcgctgttgttgcccaggctgaagtgcaatggtgcaatctcgactcacctcaaccttcgcctcccgggttcaagcaattctcctgcctcagcctcccgagtagctgggattacaggcatgtgctatcatgcccagttaattttgtatatgttttttttttagtagagacagggtttctccatgttggtcaggctggtcttgaattcccgacctcaggtgatacacctgccttggcctcccaaattgctgggattacaggcatgagccaccgcgctcggcctagttcagatatcttatatctaatgacttggtgtagcggcccccagcctttttggcaccagggactggtttcgtggaaaactatttttccatggaccgtggtggggtggatggtttcaagatgaatccagtgcattacgtttactgtgctcttctattacgattacgttgtaatatataatgaaataattatataactcaccataatgtagaatcagtgggacccctgagcttgttttcctgcaactagatggtcccatctgggggtgatgggagacagtgacagatcatcaggcattcgattctcataaggagcatgcagcctagatccctcacatgcaaagtttacaatagggttcgtgctcctatgagaatctaatgccatcgctgatatgacaggaggtggagctcaagtggtaatgcgattgatggggaacagctgtaaatacagatgacgttttgcttgctggctggcactcacctcctgctgtgtggcctggttcacacagcatgagaatgtggcctagggtttggagacccctgacttagttcatactcattgtaaagttagcacttcttttaaaaacattcatctttggccttctttcaactgttgactatttgattgttgactgtttcactgttgagtgactttagggtgttgactgtttcagaagaaactgaatgctattatggtacattataaaggtacaaaagtgataagtattctgctttgttagaggatttttcacattctaaagagatgttaaggccaggcacagtggctcatgcctgtaatctcaacatgttgggaggccaaggtgaaaagatcccttgagcccaggagtttgaggctacattggactatgattgtgccactgtactgcagctgaacaacaaagcaagaccctgtcgctaaaaaaaaaaagaaaaaaggggctgggtgtggtggctcacgcctgtaatcctagcactttgggaggccaaggtgggtagatcacctgaggtcaggaattcaagaccagcctgaccaatatggtttcacctactaaaaatagaaaatatgtaaaattttttactactaaaaatacaaaaattagcggagagtggtggtgcacacctgtaatcccagctactcaggaggctgaggcaggataatcacttgaagcagggaggtggaggttgcagtgagctgagatcgcaccactgcactccagcctgggcgacagagcaagactctgtctcaaaaataaataaatagataagaagaaaagaaaaaaaggaaagaaataaagagatgttaaaaataaattatttctagtaggactcaccaagttaagttatatttgatttctaataccattttgcttcctaacgaaagacagtagcttaaactaacaaaatcgttatgtcaccaggcacagtggctcacacctgtaatcccagcactttgggaggccgaggtgggcagatcacctgaggtcgggagtttgagaccagcctgactaacatggataaaccccatctctactaaaaatacaaaattagcagggcatggtggtgcatgcctgtaatcccagctacttgggaggctgaggcaggagaatcgcttgaacctgggaggcagaggtttcagtgagccgagattgtgccattgcactccagcctgggcaacgggagtgaaactccatctcaaaaaaaaacaaaaaactttatgttttggccgaaaagtttaattacagttattccttgacgaaaagaaatggccaagattagccttccatggacactaatggctaatgactccttactttacatgaagtgtgtgggttagactagaattgaagggattttaaattgaaaggttctcagggccgggcacagtggctcacgcctgtaatcccagcactttgagaggccgaggcaggcagatcacctgaggtcaggagtttgaggccagcctggccaacacagtgaaaccctgtctctactaaaaatgcaaaaattagctgggcgtggtggcgggcgcctgtagtcccagctactcaggaggctgaggcaggagaatcgcttgaacccgggaagcagaggttgcagtgagccgagatcacaccactgcactccaacctgggtgacaagagcgaaactctatctcaaaataaataaataaataggttctcaggatacatggttcctggaaccagtgctctccattctgtggccatggccgttttaaatcacttgtgccttaaacttaatctaattgagacatgatgctaagtaaaagctgggtctaaggcagatcaatcacagcatcaattaagggtacgagtgagtcagctgcacacacatgtccccgggaacagcagtgaagaagaaaaatgctttttccctccaccaccatctaccaatactcaatgcagactagccctgggaagagctcctgacttctcacaatctgttcccatcatgaacagaaggtgctccccgaggaggacgagagaagattttaatgtgcaacaaaattaactggccaatttgtacattcgccatttttattttttatttatttattttttgatttattttattttattttatttgagatggagtttcactcttgttgcccaggctggagtgcaatgatgtgatcttggctcactgcaacctccgcctcctgggttcaagcggttctcctgcctcagcctcccaagtagctgggactacaggcatgtgccaccacacccggctgatttttgtatttttagtaaagacagggtttcaccatgttagccaggctggtctcaatctcctgaccttgtgatccgcccacctcagcctcccaaagtgctgggattacagatgtgagccaccacgcccagcctcgctatttttaacttatagattgtaagcttaatgttcaggttaaacataaaaattacgtaagaacaactggcttccatattccttcagaggtgggatttgtaccgtattacgccagacgcaatcctgtccttctatcttcaggtttgtaatagtaaaatcattttccatccagaagcatgttttcagaataaactatgtttcccagtagtcaaccagacagctgtgagatatggcaaaatgctgtgtgcaggagagtgcacttttcttgaaaataaaaaaaaaaagtagcataataaagactgctaacaaataataagaacacagattggaaagaggaatatatcgtgtgtttcatagacctaacaatatttcacgtgtttggttccctgccatattgcttgagtttgtacgttagtttgtaggaacctgaccaaaggagtagattttcctcctacaaaatgctctccaactagaggagtcagagagaaatgggcccagttgaggcagaggtagcttgcgccactccgggtaacagagtgacaccctgaaggaaagaaataaaggaaggaagggagggagggagagagggaaggaaggaagagaaaagagagagagagagagagaaagagagagggagggagagggggagagagacagagagagaaggggcccagtcagccttctcagttttgctgtgtcagctctatatggtcttcacaatatttgcaaatatccaatacaaactgccaggaaaacgccacttaaataatacatttttttctcttagtaagtcttgtttcagggattttttaagttaagcggttttgagtggccctctctggtgatctgacctgatgagggattattacccactgttagatcataggccttattttttccagctttataaatgaggaaattgagaccagaaaagagaggcatcccgtaccagccttagagggacaggtgtgttgagatttcattttcagcttctcaaagtggtaagttgttcagtgtaaagaaggaggaggagaatcactgtgttgctaaatgagtgaatgccaacttcgactaacatggaagttaggtttctcataacagtattaactcaccacatcaccaagaggaataataaaccgtgcatttaaactgcagatggaggaatgcagaattctgtttacatgctgctgttctatttctttctctttcttatttttatttttaaatcgacatcatttttttatatataaatatataaatacatatataaatatataaatataaatatatatataaatatatacacacacacacacacacacacacacacacacacagactcactctgtcagccaggctggaatacagtggcatgattatagctcattgtagtctcgaactcctggacacagagatcctcccacctcagcatcccaagtagctgggactacaggcacatgctaccatgcccagctaatttttattttttattttttgtagagaccgggtcttgccatcttgtccaggctgttgttaacatattttgagggacagtgactttggttttgttttgttgttgttgtttttgagacaggatcttgttctgtcaccccgaatggagtgcagtggggccatcatagcccactgcaacctcaaactcctgggccgcctcatcctcccaaagtgttgtgattacaggcatcggccatcacacccagccctggacagtgactttgaaatttcccaaggcttgaggagtctcagcgtttttaattctagctgtgttcccaaataaaaaggtgatgcagaggaaaatatatatatacatacatttaatacatgtgtaataaattaatattatatatgtatgtaatgtataatatatatatacatatatgtaatgtattcctcaaaatggtcaccaagtgaatatgtatccaatgccatttcctttggctacattcatatattcctacattcaacagaaatttattgggtatctgttttccagaggttgaatagtaccaggtataggtagtcaaccagaggtcaccatgccacacctaataggaaagcctgctgctcagcaaacacaaatatatgcaaaaaatgcaaactgtgataagtaggaggagcccttagtttgagatataacatttcaaaatcaccagaaacatactgatgagaatccagaaatagtttaactcacaagagaaagttatttttcacatcttttattttcttttttttttttttgagtgacttcagacttagcaaatgattcttttccagtgaagtaaaactgaatgtcctgcttaaatattttcattttaaccacttgtattatttcaaagtaaggaaagaaatcagccagatgtgccaaatgatagcatatttttcttccccatttcatgataaaaataattaactggtttgacccgcagctttctagaaatgtctgcactttaatcaaaaatttctttttttttcactaagaaaatttggctatgggacttgcaaggtttcaatgttaacgtggtagttgctaaacaattccagtcattataaactgtatgttctgttttcacatctgtattgggtccaaaacattttcacgtacaattagcatggttgtaggaccaaaacctcctttaataataatcccaaaataatcttccttttgctagatacacaaaaagagaaagcataccaagctgaaacagaccctgaaggttgtcaacctcaatggaatataaagaatggaaaaaacttagagccagggtagatgcagattcagataccacggtggtcagagataattcttccaaatccaactcgaatgacaaggtagatggaggtgccagtagtaaatgggaatgagcagatttgggggaaaggactgagttcagtcactttgaggagttgccaatcagtcttgggccacagagcgcccagcaccaaggagacagctgggcatatgggtttggagctcagaagcaaatctctccgtggaaatgtgaacatgagagcagttagctatggatcctattgaacaccgtggaaatggctggggtgttgataagagaaagaagagggcagggctggggaactgtcagggagaggaggagaacagccttctcttcagaattctagtcagccctggtctctctgggaagatggcttctggaactccacctataccttctctccagcacagaaagtagaggtgtcatcatccaaggaatgtagcttcaggtgatggcaacttcttttagcaaccatactttttctttttttttcttttctttttttttttttgagaaggagtctctctctgtcacccaggctgtagtgcactggcgtgatctcagctcactgcaacctccacctttccagttcaagcgattctcctgtctcagccttccaagtggctgggattacaggcatgcaccaccacacccagctaatttttgtatttttagtagagacgggctttccccatgttggccaggctggtcttgaacccctggcctcaagcgatccacccacctcagccccccaaagtgctaggattacattcctgagccaccatgcccagtcaacaaccacactttataaagttcatattaactttgcagtcaatgcaactctgtcttctcaaaaaaacagctggaaagtcaacttctttctttaggctacatgatgatcattattttattcttattaattcatgttcattggattccccattgccttattactggtcccaatacatccatggaatccggtttctaacacttacctaatgtgtgggttcaggcaagtttcttagctctctgtgcttccttttcattacctgtgaactggagacatttatagtatctacttcatagggtttgcgaagctgaaatgagttaatttatgtaaagtgcccagaacaatgtctggtgcataagtactttattaatgttagttgtcattatcatcatcatctatcggagtctctcatgattatattccaaaccatctcacctagtcagaatttgtcattaagaaaactatgggctgggcacggtggcccacgcctataatcccagcactttggaatgccaaggtgggcagatcaactgaggtcaggagttcgaggccagcctgaccaacatggcgaaaccccagctgtactgaaaatacaaaaattagccggtagtgctggcgtgtgcctgtaatctcagctactcgggagactgaggcaggagaatcgcgtgaacccagaagggggaggctgcagtgagccaagatcacactactgcactccagcctgagtgacaaagcaagatttcatctcaaaaaaaaaaaagaaagaaaagaaaaaagaaaactatggagcatgacatggaagctggataagaaacttgtttgcaaactccaagaaaaaccaggacctaaaagaagggaagagtggaatggagggtgagcagagtagggggcctaagctctctatatccactttgaacagatttcttccccttttttttggttgtttatattccatttctagaaaagtttcatttggaaaaagggttctactgctttgcggggcaaaaaggaaccatagctaagctgctaactagggtaacatcctatcccctctgaaatacaattaaattcagcaacgccatctggattcagtggctgctgtgtgcagagcgcctgctgggctccatggagaggggaaggaatcagtgtctgcatccaagtagttcacactgtaacaggtgacctatacacacagaccccttgccaggcaatgtgccctgtagtatggccacacagaggaggagtcctggggaggctccatggtgaaggtggcttttgaaggactggcagggtgtcaataggcagagatgcatggacactaaaatccaggcaacaggaacagcatagccacaggaccgggcgtcagtcacattctccccgctggccgaatgacgcaaataatgctcaaattccatgctgcggtttgctttgactggcggaggtggaggggcgcgaaagacgagccagcatgctgcacagcaggtttagcctccatgcccggggtttggagcaagagagtgaaaacatcagagctatgtcttcagaaggtcttgtgttgtgaaactgactggcaagctatcacaggaagctaagcgaggtggcaggctgctagattaaaatgatctctaaacagaattcgctctcagagttcattttcagcctacctcattagggcagatttggtcttctcacattgttattgctgtatcggaggaatctttctaaagagaaaagtgacagcacacattgctgccatttgaaagccagcatttttaaagggcgtaatacatagtgacagttttgatgtatgcccgtgggtgtgggtcctgatatctcaacatactctgcctgcataatttaaaatgacagtttagcctgtcaaacttaaatgtgagtgaagtttcttggatatttataaaacatcaaaaagatagaatggtgtcagcaaaagatgggtctttttattactaaaccacgggacgatttttggataattgctggcaactcacctagaagctgaacttccagacaaagtataaatttggtggtgccacagttttgaagattattttcactcaatgcaataaaaggatattacagaactctagcacaaattgtagtcaaagatggagacgcgtcaatgacccgtttgtttttaatgtgttttaatgtttttgtttttaatgtatccatggtttccagttcccctgagaaagtggaaattacccatgctaataaagcaagcgttagtgcgaagacctagctgatgtttggctggtttttagcccgctagccagtcaccctttataaagcctgccaagtttggagcgtgggtaattttacacgcgggtctccacagatcctgtctacttcggtagatttattactaggaaagtgcgtgggggcactaatttttgtgaattgactaatgcgttagaattttaaaaaccgggtagaacgcagcgcaggaagcgagcgttccccgccgcagcgccggagcgtccagccagaatccccctgcatgcgcagcccctggcgtcttacgtcccacaggccccaccccggcgccttccgtcccgcaggctccgcctttggcgctgggctctgacgtcaccacctgcgccgctcacagtagaaacaggaagtgggaccaaaacaaaggagcggcggccgggagcggacttaccttaccttctctgccttcggcgcgcttctcagccgggccgccgacccaaaggagccgtccgactatgtctaacatggagaaacacctgttcaacctgaagttcgcggccaaagaactgagtaggagtgccaaaaaatgcgataaggaggaaaaggccgaaaaggccaaaattaaaaaggccattcagaagggcaacatggaagttgcgaggatacacgccgaaaatgccatccgccagaagaaccaggcggtgaatttcttgagaatgagtgcgcgagtcgatgcagtggctgccagggtccagacggcggtgacgatgggcaaggtgaccaagtcgatggctggtgtggttaagtcgatggatgcgacattgaagaccatgaatctggagaagatttctgctttgatggacaaattcgagcaccagtttgagactctggacgtccagacgcagcaaatggaagacacgatgagcagcacgacgacgctcaccactccccagaaccaagtggatatgctgctccaggaaatggcagatgaggcgggcctcgacctcaacatggagctgccgcagggccagaccggctccgtgggcacgagcgtggcttcggcggagcaggatgaactgtctcagagactggcccgccttcgggatcaagtgtgacggcagaacccgctctgaggtttcctggccatagccaccctttgaaatgctctctgtgtgttagagagatattataccctagaaactctgaacacgccagaatgctgaaatgcccttctacctttgggtttacagccccctccacataaattaagaaattcagtatttctgcactcttagctggattctaaagttctgtatagctcgtaatgatggtatttttatagcagccttttaacagaactagttaatttcgtgtatatgaatctttctcgaagatctggtcaaaactgtattcagtttcctgcccagaatgatcagattgaaggtggttggtttttattattatttagtgtgattgatagtatctagaatggcaggtggtgcataaaagttaaagagaggggaaagattacttagtttggttatacagttataaacaccatgcagtgtattcggtggactgtgctatttctgtttatcctttgggttttggtttttgttttttttttttgccttcacagtgagactgcaaatgattgttctcataacgtatattattaataaatgtggtcctataatttatactgaaattaccttaggatatttttgcataatactctcttactgcttacattctataaatttttcacgtgataattgtctttgcgtaactgggaaaaatgccgaataacttcctttattatctggaaaaattaaatttgttcatttatattttctacttactaaattgagtttttaaaaagacttagtgtgacatttgacagtgtctttcaaacgaacttctctaacaagtttatagttattttcctgtttcaacactattagaagtcttataaattatgctaattagcatggcagtcatgttacacactcttaacattgccaaagaactgttgatttcgtttgagaaaaccctgggactgtgtgtgtgtaggttttgttttgattttaacaaccaaaaatagaaataaaattagaactgcgttttaagttctaatttgcatttattaatttgtccaaaagcaagaactcttggaaatccttgaaaatataagctggaatgttttacttagccatgcaagtcatttatgtatacatccagccagctggaaatctgagaagtaaagaggtaggactggaaggaaggagaaagcttgagtctttaaggctagagcccagctgtgctgcctgccatcttctcaggaatggcagtgcgtattttctggctgaaaagtaaagcatgtatccaccgctttctcatagcctcgaaacatggagaaaagcaacttgcttttgccttggcaagcatgctaacctaagttaattcaagttttttttaacttaccctttccttcactggaagatttttccataagagaattccattgtttcagaaaataattataggggcccttccaagttctttgaaagattcataaccaactattcactattataacatgtttcccagtgtaaatgagtaaggaaaaaaaaagtgtaacaggtgcgtgcagatgaggagtgaccctcatatttaagttattttatatttgactggacattgttcagaagtgtgctttaagggacacttgttggttgtctgcccagcatctctcaagaatatccctcctgtcctccacatggttgtgcagggccatgtgtgaagacagcatgagtcttaacccctcttttattttatttttgagacagagtctcgctctgttgcccaggctggagtgctgtggcgcgatctctgctcactgcaacctccacctcccgggttcaagtgattctcctgcctcagcctgccgagtagctggaattacaggtgtgcaccaccatgcccagctagtttttttgtatttttagtagagacagggtttcactatgttggccaggctggtcttgaactcctgacctcaggtgatccgcccacctcagcctcccaaagtgctgggattacaggcatgagccactgcacctggccttaacccctctttagattggaaaaaataattacaactttaaaaatagcttagtgttgaaccctttggtaaactaaagacccttttataatgcacatattcccaacaaaattaatatattttgtgagattaaacaatgcttgtatatgcttgaactttcttaaaatatgtccatgtcatactattatgaatgtacatttttatgagtcataaatattattttcaaaagcactacaggcccatgaattacttcctcacttttgcagttgattactgaaatgtaaatcacaagaatttgtcaattaaatcattttaaactgcatgttattggatgtgagtgtgcatcctgttttaaaaaacacttaagaaaaaagaattgcggggcacagtggctcacgcctgtaatcccagcactttgggaggctgaggtgggcagatcacctgaggtcaggagtttgagactagcctgaccaacatggagaaaccccgcctctactaaaaatatgaaattagctgggcgtggtgctgcacacctgtaatctcagctactcaggaggctgaggcaggagaattgcttgaacctgggaggcggaggttgaggtgagccaagattgcgccattgcactctagcctgcgcaacaaggatgaaactcagtctcaaaaaaaggaaaaaaaaaaattctgaggtagatttgggtcagaaagcatgatatttttccaaattcaccctcagtcttagcacttaaatttttgtttggttagtatggctttttcttgcatatttctaggatccctggcttatttttgttgttgctgttttgagacggagtctcactgtcgcccaggctgaagtgccaccacgatctcggctcactgctgcctccacctcccaggttctagcgatcctcctgcctcagccccctgagtagctgggactacagatgcgcaccaacacacctggctaatttttgtttttgttgttgttgttgttgttttagtagagtcggggtttcaccatgttggccaggcttgtctcggactcctgaccctcaagtgatccgcctgcctcggcctcccaaagtgctgggattacaggcgtgagccaccttgcctggccaaaaagtagctaatttcattagggcaatcacagtagtgtgtgattgtgagtgtgcgtttgcgtatgtgcgcttttccctcacaactgatgtcactgaattctttccctacttccccttttgtttattattcttctttctttgtttggctctttccattctccctactcttcttctcctctttccccctccttcttcttctcctcttcctttcccttttcttttttttttcttttttttcttttttttttagggatgggaatgtgctctgttgcccaggcttgagtgtagtggctagtcacaggtgcaatcatagctcactgcagccttgaactcctggcctccaatgatcctcctacttcagcctcctgagcagctgggactacagacatctgccactgagcctgactttctctgttttctaattatcaaaaaacatctactgggaatcttgtctccaggttacannnnnnnnnnnnnnnnnnnngacaactctggccagaaacattccaaccacaagataaacacctccccgaccagagacatgccatccccgagataacctccccacaggccagagagatgtcagcctcaagataacctcccgtccaactagagacgttccaaccccaaaataaacttctccctcatgcagaaacattctgagcctgtgataagctccctcaccctaaaaccaataaatactcttagtctataagagaaagcgctcctgaccaaaaatggccagaagcccctctcaagtttattttccaaaataaacctgtctttgactgttgagctgcttttcatgtatctttcctctttaattcttacagatggagtctcgctctgttgcccagcctggagtgctgtggcgcgatctctgctcactgcaacctccacctcccgggttcaagtgattctcctgcctcagcctgccgagtagctggaattacaggtgtgcaccaccatgcccagctagtttttttgtatttttagtagagacagggtttcactatgttggccaggctggtcttgaactcctgacctcaggtgatccgcctgcctcggcctcccaaagtgctgggattacaggcgtgagccaccgcgcccggtcccctggcttcttcactgtaattgtttcttcataactacaagattttttttcacattgaaacttccctacaccaaagatggatataatttacaaaagtatccaactgaaacacatcagggaactagttaactagttaatcttccatttaactactagttatatttcttcctttcatttttccgccttcaagtgcacaatttctaacatggatttaggattgaaagaaaaaaggtagactggattaattcacaaaatactttcctctacttttagtttatttcagttcaggaacccagatgatactgtgtgtgctgctggggaattttcttactaaagctgtttcttgctgaaggaatgccaatgtatctagatgccttttaaatacaggcagaccatgaggtttggacactgtgtgcccgccctgctgtctttgatttggaaaagactgctgggccaggtgcagtggctcacgcctgtaatcccaacactttgggaggccgaggcaggcagatcatctgaggttggaagttcgagaccagcctgaccaacatgaagaaaccctgtctctactaaaaatacaaaattagccgggcatggtggcacatgcctgtaatcccagctacttgggaggctgaggcaggagaattgcttaaacccgggaggtggaggttgcggtgagccgagatcgcgccattgcactccagcctgggcaacaagagcgaaactccatctcaaaaaaaaaaaagtgctgaaaataagcaccagtctgataagagaaccttattaactgagcatagtatcagcatcagctggccaagcacactataaagcagaagggagggacttcctctgcaaaaacacaacatcctcttggcaattctgtagccaaagtccaaagctcaagatctttatagcaaaaagctgcaagccagtggacactaaggaaactgatgagcagacccctgtttttgtttttgtgttgaatcaactgactggaattagcaaaatgctgtctggtttacctaggtttgtttttctacattagattgcaaattccatagggagcccgggccaggcaatgtctgtcatagtgtcagtctctgggcctggtgtggtgcctcccacagtgggctccttgcactgcatagcaaacgtgtgcctggcctgggtggtcactcctgatagtgcctcgagctttctgatgacagcagacaggcaggtaaagcaggcaccctaagcgcacagagtcccaagtatggacactcaagagctgtgtcctcttccttcacagcatttgtccacaatgaaatgtttgcctctgttcttcagggtttgtacatcctctccctgctgagaaatgccaggacaaacaattcagcagtgtttactcaaaatgacaatacaggtggggcgtggtggctcacacctgtaatcccagcactttgggaggccgaggtgggcagatcacctgaggtcaggagttcgagaccagcctggccaacagggtgaaaccccgtctctactaaaaatgcaaaaaaataattagccaggcatgatggtgcacacctgtaatcccagctacttcgggaggctgagacaggagactcccttgaacccaggagggggaagttgctgtgagccatgattgtgccactgcactccagcctgggtgacagagtgagactgtctcaaaaaaataaaaataaatagttttttaaatttaaaaacgttttaaatgacaatccagggaaagatttagtccaaaacatgcatgccatgtggggcttctttctagagatgagaacatgcttctgcccttaaatgatattcagtacagataggtagataaaacatacaaagaaaaagaaaaatggacaaggcgtacccagatgttaaaaaaaaaaatcaagaacacttaagatcaggactgtttacacagtttatgttattttatacctcaacctttaaaaaggattaaatcacagtataaggcagcatgccatgctcaccaaattgtgaaacagtaagtgccggaggaaagggatattgtgctgtgtcatggcagttagaagtggcttcccagagccagcagggtttaatctcaggtttcaaagggggaaaaaaagcaggaatgacacaggatctgagaggccaaaaactacagggagttttgactggagtggagggttcacgtgatgttaaaagagactgaaggggagactggacagactgcaaagggctggaggccacattaaaagtgtggactttaccccatgggaaggaggaagcgcaggagtcatgagaaatgatggttcaggcagagattagagcataaagcagggaggtggggaaagccaagaggaacacgctcttggatgacgagtcaccatgaatcactgatcacctgggacatggttcagctgcacatgctgacgcagtgggtctgccagtgacgccgatatgctgcgagtctgggaaccccttttaaggagcagggaatcttaactctggctgtgcattacaactgcctggtactttgtcaccacgtgagtaatgtttttctccaccagtacgaactcctgggctccagtgatcctgctgcctcagcctcctgagtatctgggatccatctatatttttatgtcttgtagataaatatcatgagtcaaatttcattaacattgggaaaagttttttacttgccttgacagatttccaattgctatatgttttcacacacaaaaaattttaaatacatggaaattcagttggtactttttttctcagatccagtagtttgattacaaaggcatttaacagaatagttttcatcttttcatgactctccttgttcctcttcatgatcaattccatggccataagaattctttgacgccaacaacagatgggatataaacagtgcattgttacttttgctaatatcaaacagaagggggatctaaatgaaaatgaaaacatttctgcaaacatgagtgtcctcagctgtcacaggaaataatgaaaaaaaaatcagagtaaatttctttttaactacttccttatagtgtctacaatgcaagtgattttttacaatgctaatttggtatagttttgcacctctgcatctaatagttggagtgaatagtctgcgagggatttttagatctgcttaattcttctggtcagcatgcagtggcatatttaaggaggcaatgttataaccctttaaaatgtaatcatatgcaaaattctatgtatgatttgggagacccctttaaaattctctctatgtatgtaatcacagaagccccaatttgaaaaagtactcctgcaacatgcttggaaatatgccagttgaaacaaggatcaaggcagaaggctggcagaaatctaccactctattatttattccttagaaagtctttcaaagaattgggggcatattcacattttggggtgaatattcacattttattttcattgcacaaacttgaaatgcatgaactcggtaccattcagcatcagcaacaaatcagaagcagctcttggaaatgttcaatgagacctcccacgtctcacttagatctctgagaatcagagctggaaggactctgaatatccattttggaggttggcgacaggagaagacccaccagcctcatcactgtcagcatctcaaagtcactggtctttcatagtgcacaggaagatgcactcacacgtcctctcatcacatctctctagcactccagaggcattttttggttaaccatacttcattctttctacttagactagttattatcatctgaatacattcaccacctacctccaacctatgtgcatcccattttaaataggttacttcctaaactctaactatagccacaggcttcatatttaattttcagttccttccagctcttttcatcagagcgaattcatttctgtatcctttgctctggaccctgtcaaaagttgcgaccatttctgattacaactgttgtagcctgtgagggaagcagccttctcacccagaaacccatctgactgtccagccccagttcagagctcccgtcccaccccggcagaaacttctcctaccttctcatggattccaaggtctttttgctcctttgttgctggatggtcaggaactcagtgtgtccttccaccacgctcttcaccccaccacattccaggccagcaaccaccatgccaaaactgcattgtactttccaaaccaggcctcaggcaatggcagggaattcctgcctccaggctcccaagtctctccagctcccagagggtcccttccctttgttccttcccctctggagccagctccacacccttggccaactcaccaaccttctggtgcgcagtagcacctcccagagcttgcagcacctattccaaagacaccactggctgatcagggtccctttggcctctcaatagccctgtcacctgggccatacctctgcagagccaggagcagttgacattcttttttttttttttgagacggagtctcactctatcgcccaggctggagtgcagtggtgtgatctcggctcactacaacctctgcctcccgggttcaagcgattctcctgcctcagcctcccaagtagctgggattacaggcatgcgtgccaccacacctggctaatttttgtagttttcgtagagacagggtttcacaatgttggctaggttggtctcaaactcctgacctcaggcgatccacccacctccacctcccaaagtgctgggattaaaggcgtgcaccactgcacctggctaacattctttaatgactgcacaccagacaatgcagtcacagacaccactcccatagcctgtttcccttggcttccagggaaatgactcattcatgacagttgaggtcacagttgcccccactgtttcctatcgctatgaaaggccatcccaaacaccagcagatccactcctgcccctttgtgtattctgcttctgggttacttgccctgggggtgccaaacccaagttcatgggtgaaggctgccaaaatgtcatcccatggccatgcctcagttttggccactagggactgtctctagctttccaaaaggaaggagttaagatgtccaaggaaattatgtagtcttactgtctttggccaagtggttcctaaaatggaccccttttggcctctgtagggaaggaaaaagaacttccctctttcccattaggttctgtagctgagtgaactaacaaagacggattaacaggaggaaagcatacacattttatttaatatttttacatgcacacgggaactttcataagaaaaatgaagacccaaagaagctgttaggaccgagagctaatatacccttttaacaaaagatgataaatttatggagaagtgacacaggagaaaggttcaagtttctaggggcagtcattgtggggcagtgactaatgaaagacaagggttattttggtgggtttgtacagatcagtttcagggtggactccgaacccctggtgataagaacattctcctcttcctggtacagggcaggcacgtttcttagggaagatttcatgacctgctttttgggacagagcgggaggtcagccagccagccagccttgcagctgaggcttctcaagtgccttcagctacaattagtcaacatgctgaagggctcattgtggggtggcgttttgtgttctgaaccgtttcgtctccctcttgcccacactgaggttcacaggcgcctgcagaggagctggtgtgggacgatggggagattgggaggcaacatcgcctcctctgcatgaaatgctcatgggcacatgtctgctgcctctacctaccaaaggacagaaccagccaactggcatggcaggcagggagccagcgcagcctccaggccgtccatcctctctcctcagtaccagggcctcccgtcaacgccagcgccaacagagagcctgggcccccccgacccctccctcctgctggctctccttcttccttctagggcccctgctgcccctctgtctccagaattgtcccctgcttgccatttaacccattcccagtgcttgttggtccccgagggacccagcctctcagccctcaatggtcacctgtcccagccgcggaaggagaaggggacagaggacactggttcattccaccatatttactggggccaggcctgcactaggtgctggggactcccaggtggacaagacagagacctgccctgagggcctaacatgttagtggagaagataaataacaacagatcaaccaagagtcagtgggaaacgtgcagcctggatagatgccttggtaaagccaggctggcacagagagggcggtggaggcctgtgcaggggccgtggtcactcaggagagggagctcggcggcctcccagctccctctcggaagggtcatcacccaagagcggcgcacagccttccttggctcccatcctgccttgtgtgggacacagtgggcgccaggcagatctgacaccaacaggcgtcgccaggtttgccagcacacacactcaaatatgcacactcacgttctcgctctcgcacactttccgcacatactctcacactcacccttacacttttacacatttactcttgcacaccacatactcgctctccacactcagtcgctcttacacatattcacgcagtcatacacacacacacacacacacacacacacacacaacatctggatttgattaggaaactaaagggacatctgtcaccttccatgttttgtttacattgcaacacattcttgtactcgcttagccttggacgggaggctccatgctctctcccagtttctgagtagctcccacccccagcgctgtggcagtggagaagagaggggagagaaggcaacattaaaaaaaagaaaaaaaaagaatgcagttctccctccctgggtcaagaatgttgcattatctagacagatacaaattcaggaaacaaagtaagaactcacttcagcttcttggcctgcccccatccttgctgtacttgggtgatgtcccattaatttctccccaaccccaggggaaagtgggcagagaacaggcctcaacccttgctggctttctttgcagcttcctggaaagaatcgacagcgtcagcttggttgactacacacccacagaccaggtatgtggaattagggtcccccaccacacaccagaaactttgagattcatttccaatatgatttaatgattatttcagaatgaattaaggaaaaatccttaagatacctactttttgcaaattgtttgtactgccctgtgtgtgtgcgtggattggtcatcaaaccttgtgccttgctcccctgactctagcacttagtgattatcaaaattgccagcatgcaaatgagtttatctgcagataaggaacatgccgttccttttcctcctggagctgtcctcaggaaagcgaagtctttacttcctggcttcataaactatgcccattctgtttgtggccctgggcctggggggtcccatatcacagtgaactttccaggtgtgacccagagcatcccctttgggttgagtcaaaaaaaaagcactccaccatttttttttttttttgaaatggagtcttgctctgtcgcccagactggagtgctatgttgcaatctctgctcactgcaacctctgcctcccaagttcaagcgattctcctgcctcagccttccaagtagctgggattacaggtgcttgccacctcgcccagctaatttttgtatttttagtggagacagggttttgccatgttggccagactggtctcaaactcctgacctcaagtgatacacctgccttggcctcccaaaatgctgggattacaggcgtgagccaccgtgcccagcccactccaccaattcttaaatagcagagagggaatctttgtgccccttcgaccctcgggcagctgcagagacttggagagcccccggattgctcaattcaggagacttcaggtgcttctagagccagtgaaccccaaggaagttagagggatgtctctgttcaaaccacactctccaaacttcccccagagtctgtattccctgcaaggccttggccctgggcccccaaggtgggaggtctgaggcctgagcttctctctctcccatgaagtttatcctctctaaggctgatcctgagagtttgaaattatctgacaaagcaatggaggcttcctcgtcttgagtcagtccctcaactaacttacctgtcctaaacagttctcgttatactaaaatgggaggaccacctcccatgttccagaattattacagaatggctgcttccttaaaatcacatggatttgggggtcaggaaaaaaaaaaactctgacatctgccaaatgtaccagggatgccagctttgtgaggctgcgtggctttctcgtcccctcggggtaccacatcttttatcttggaggaaacagaaatgtgcagggaagagagaataaatgaaatcaactagcatccagttcataaggctgaagacttgtgagtgcagagttacacttcctttggtttctcacccaagccatcgtgagtttcacccaagccaacagagcaccagcagggatgtccctctggaatgctgatgccctgactgtggttgtcaggtatatgttagtaagattcttgcagacatgattttaagtcttaaaacaaaagcacagttatcaggtctcttggggccaaaccaacacattaactgtggctttctctggaggataaaacagagaacattcgtctgagttctttttttttttttttttttgagacggagtctcactcgtcacccaggctggaatgcaatggcgcgatctcagctccctgcaacttctgcctcttgggttcaagcgattctcctgcctcagcttcccaagtagctgggattacagctgcctgtgaccacacctggctaatttggtttttttgtatttttagtagagatagggtttcaccgtgttggccaggctggtctcaactcctgacctcaggtgatctgcccacctcagcctcccaaagtgctgggattacaggcgtgagtcaccatgctcggccaatgttggttcttaattgttgtttcctttacagtggaacaaattatttgaaaaatattgatgaggtatagttatacccgggctttaccttgaagaagaacagtaatgtaactcagcttgtttccctcttcttgttcccaggacctcctcagatgcagagttctgacatctgggatttttgagacacgattccaagtggacaaagtaaacttccagtgagtatgttgttaagagctgcatggcccagggccacatgatgtcccagagccgaagggctgtgaggtttaagggggcttcattcctgaatgtgcatggcggccctttcaggtaagagcagctggggtgaaatttgaactctagcaagagttgaagtgttgattttactgcctactttaaagtagaaatgaggacacctgaaaggaaggcagtgtttgcatctgagttgttgatttgattggcccttttttttagatcaggagactcatgaaattttgatctttcagatgcacagtcacaggttgagaactgaaatgagcagtttatgtgtgtctccagcccatctcttgggttgcccaactgcaaactcggccaaatgagcttactttcttcatttttctccctcatgataagacattaattctccctccacaaagctcttttccatcctcatagctatcaccctagtcctgctccatcacttcccccgcccctagactctctcggcacagccctggcttgtctcctgtcccctggcttacccatttcagtcgcccttctcagtgccacgaaatgaatcttcctacggcacggcctggatcgtgctgttcctctgctgaagaaggttcgggctcactactgcttgtgcaccgtatgacccaagccctctgcctatgaccagccccgtccccaggactgctttgtcccctgccacctgcctcaccaggctgggctgttgtcaggacccttccagttctcccagcttttcctgccgtagcgcttctgttcatcttgtcctctgagcctcagatgccacctgtgctaagcaaaccccacaaatctatcaaagcttccttcaggccaggcatagtgattcacgcctgtaatctcagcactttgggaggcaaaggcagtaggattgcttgagaccgggtgttcaagaccagcctgggcaacatagcaagaccctgtctctaccaaaaaaaaaaaaaaaaattagccaagcttgatggcatacacctgtggtcctagctactcaggaggctgaggtgggaggatctcttaagcccaggaattcaaggctgcagtgggccatgattaggccatttcactccagcctgggtgacagagtaagaccctgtctctaaaaaaaaaaaaaaaaaaaaagcatccaagcatccctcaaatctcagcccatggtgaccccttagaattcccattgcatatctactatgcagccattgatggtatactgccctttaccttgcctagtcaccctcagcatgtctgactcgactctaagggacctcaagggtgaggtcccttaaagcaagagtttcatgatctccagtgtgttctgagactcctgcagtgcccagcgccctcctcagtgcacaggtgacagacccctacttccagatttcccaagaacccttcacatggccactgtcaggctggataaaagccagctacatctctctgctgggaggcgcacagtgcagtatggagttggcgtgacttgtggttttgcccacatcataaccaagtccctggcatagtggaattactaacaatgaagctgtatctcacatttgtgattttgtttgaaaggattctgctcatcagctcatccattttcatcaagtatctcagcgtgccccacgtgtgctaatgtaaagcgtacggattaaattctaataggatcagcaacatacccgcccaggacaaaaaaatctagcccgtgtggtcctaaggcacatgcattatgtttagggaggggagaaatctcagaggcagggaagcctgcgaaggttggaaacatccagcagaatctgggtaggtagaaactctcccagggagaaacgccttatgcgctgagcaggggctgtgagaagaggggcctgggccggcctgatgaagtgcagggtgcagctgagaaactctgagagaactggctgaggtcgccttggctgagcgagaccgggaagcagctcgggctgggcagagcagcctgcactgaatccaggcgtgatcaagacccagtgcaggtcaccaggcagaggtggctagagataagatgcatgtagtgtagacagatcagcaaggagcctttctcaattctccatgggagggaagacacagtgtcctgagagctggaacaaatcacaggaaggatctgccctgggcagtgacttagcctgtactcagagaggcctgagtgtctgagcaggtaacctctagcattactgagctagtaaccactggatttattaaggacctactgtgggacctcagacactgccggctgctgtctgcttgatctgtcacccctgtagccccactgtggggtgactgaggagggactgcggctgagagaggtggagccacttgcagtccaggatcacacagggagtgatggtgcaggccagtgacccgagcttgactcaagacccatgtgtgaacgctggaacctgctgatagcaaaagaggaaagcaagcacgtttgccattgtcccctgcttcccccaaataattgtgttcctcttgctcttccacagcatgtttgatgttggtggccagagggatgagaggagaaaatggatccagtgctttaacggtgatttttttatgctctctcaagaaaataggagtgaattctaacactcagcactgctgtgcttaactattcttgaattagataatctctaactaatatgtaaagtatagcatttatagattatgatgctccttccttagatactaatctcattaaaaaaagcatttaagggcctgacacggtggctcacgcccgtaatcccagcaccttgggaggccaaggagggcggataacctgaagtcaggagttcgagaccagcctggccaacatgtcgaaactggggctctgttaaaaatacaaaaattaggccgggcgtggtggctcatacctgtaatcccagcactttgggaggccgaggcgggcagatcacgaggtcaggagatcgagaccatcctggctaacgaggtgaaaccccgtctgtactaaaaatacaaaaaattagccgggtgcggtggtgggtgcctgtagtcccagctactcaggaggctgaggcaggagaatggcgtgaacctgggaggcagagcttgcagtgagctgagatcgcaccactgcagcagtccggcctgggcaaaagagcgagactctgtcaaaaaaaaataataataataaaaaaattagccgggtgtggtggctcatgcctgtaatcccagcactttgggaggctggggtgggtggatcacctgaggtcaggagttcaagatcagcctgaccaacatagtgaaaccccgtctctactaaaaatgcaaaaattagccgggtgttatggcgcacacctttaatcccagctactcgggaggctgaggcaggagaatcacctgaacccgggaggcagaggttgcagtgagccaagattgcgccattgcactccagcctgggcaacaagagtgaaactctgtctcggaagaaaatacaaaaatacaaaaattagccaggtgtggtgacacatgcctataatcctagctactagggaggctgaggcaggagaatcacttgaacctgggaggcggaagttgcagtgagccaagatcatgccattgcactccagcctgggagacaagagtgaaactccatctcaaaaaaaaaaaagcacttaagcatcccaaatttacatgtgtcttttggggtgggctcttcatcaagtgcgttactgaagcaaccagtggtgcgcggcgcacctgcaggctgttctgtgactgaatagtcctatcactgaatgaatgtttttgtggaactgagtagctgctgggtgtgtactttcttgtaactccacagtgaggatgtctaactgaggtgctttcctttttctccccaccaagatgtcacagctatcatttacgtcgcagcctgcagtagctacaacatggtgattcgagaagataacaacaccaacaggctgagagagtccctggatctttttgaaagcatctggaacaacaggtgacaaaaatagcaaattcagtcttaccattggattgcaaattttcttttgttaaaaatacgctcaggccaggcgttgtggctcacacctgtaatctcaacactgggaggccgaggcaggtgtgtcacttgagctcagcagttggagactagcctgggcaacatggagaaaccctgtctctacaaaaaatacaaaaattagccaggtgtggtggtgcacacctgcccagtgactcaggagcttgaggtagggggatcacttgagcccaggaggtaagggttgcaatgagctgagatcacactactgcactcctgcctgggcaacagagcaagatcttgtctcaaaacacacacacatacctacacccacacccagaaccacacataaagtaccagtttaggacatccactaataactagatgatctctaagatcccttacagctcacaatcaccacataatcatgtttgaaactactagcannnnnnnnnnnnnnnnnnnnttggattgcaaattttcttttgttaaaaatacgctcaggccaggcgttgtggctcacacctgtaatctcaacactgggaggccgaggcaggtgtgtcacttgagctcagcagttggagactagcctgggcaacatggagaaaccctgtctctacaaaaaatacaaaaattagccaggtgtggtggtgcacacctgcccagtgactcaggagcttgaggtagggggatcacttgagcccaggaggtaagggttgcaatgagctgagatcacactactgcactcctgcctgggcaacagagcaagaccttgtctcaaaacacacacacatacctacacccacacccacacacccacacactctctttactgataaatccagaaccgtacgaagtatctcttttagttcatctattgtatagatatacttaaaatgtggaatatttttttttattattttttttttattttgagatagagtctcgctgtgtcacccaggctggagtgcagtggcgccatctcggcccactgcaagctccacctcccgggttcatgccattctccttcctcagcctcctgagtagctgggactacaggcgccctccaccacacccagctaatattttgtatttttagtagagaccgggtttcaccatgttagccaggatggtcttgatctcctgacctcgtgatccacccacctcggcctcccaaagtgctgggattacaggcgtgagccaccgcacccggccaatgtggagtattctttgatgaagttctgatagttctttgtcaagaaaatttaagtctctgttttgaaaggctaagattatattcggccttccatatcttcaggttccacatctgcggattcaaccaaccacagattgaaaatattcaaaaataaatttaagatagcagtacaacaacaaaaaataatacaagattacagtggcatacgcctataatcccagcactttgggaggctgagacgggggaattgcttgagctcaggaattggagaccagtctgggcaacatgttgaaaccctgtctctacaaaaaatacaaaaattaggcatggtggggcgcgcttgtagtcccagctacttgggaagctgaggcaggaggatcacttgagcccaggaggcggaggttacagtaagctgcgattgcatcactgcacgtcagtctgggcgacagagggagactgtgtctcaaaaaacgtaattaattaaaataaaaaattgagcaaataaaaaaattgactaaaaataatacaaataaacaatacagtataacaactacttacctagcttttacatcgtgttaggtattttaggtaattggagatgatttaagcatacgggaggatgtgcatggtttatatgcaaatactacaccatttcatataagggagcctcctcaaattttggttttcacagggagtcctagaccaatcccccacgggtatcaagggatgactctatatctagggttcaaaataggttttgtttggtttttaaattttaggaagtaccagtttaggggccgggaacagtggctcatgcctgtaatcccagcactttgggaggccaaggcaggaagatcacctgagatcaggagttcgagaccaacctggccaatatggcgaaaccccgtctctactaaaactacaaaaattagccaggagtggtggtgggcgcctgtaatcccagctactcgggaggctgaggcaggagaatcgcttgaacccgggaggtggaggttgcagcgagctgagatcgcaccactgaactccagcctgggcaacagagtgagactctgtctcaaaaagtaaaaaaaaaaatttttttaattttgaaaataaataaagtaccagtttaggacatccactaataactagatgatctctaagatcccttacagctcacaatcaccacataatcatgtttgaaactactagcattgcagattggcagaagtgattatttcagaaaggaatatttagcgcgcacacacacaatacatacatatatagttagaaatcaaagtttcttctgaaatattttggaagaaatattaccaaggaggagaggaaacataagtttaccttataaaagttttggattatcagaaaagtgtttttgtatgaaatgttcaacaaccatcctcaaatttgtggtaataagactgttaataggaaagaaacagggtcaggaaataccaggtatacagaaggatactatagagttattatgaatttatttataaacactatatgtgtaagtgggaaaatgaccacaatcttcttataggaaaaagctgattttaaaacactatgatctcgtttttaagtatgtgtgaggacagaaaaaaacttgggcatgaaaacataaaatttctgtagtaattgtttctgggtataattacatttgatttttttctgtatgtttttctataagatttgtttttacaaaggttatatattttattactagaagaagcaggtaagctatttccatttgacgggaaagtggattgtgtgtgtgggtttttctttctttttttttttttttgagacagagtctcgctctgtcccccaggctggagtgcagtggtgcaatctcagctcaccacaacctccacctccccagttcaagcgattctcctgcctcagcctcccgagtagctgggactgcaggcacgtgccaccacgcccagctactttttgtatttttagtagagacagggtttcacagtgttggtcaggctggtctcgaactcctgacctcgtgatctgcccacctctgccccacaaagtgctgggattacaggcgtgagccaccacacgtggccaaattgtgttattaattgatagtaagattcctgtagactaatcagttagcttgattcctttgaagtgatggaggcggaagaagaaccaagccagctgcatgttaagctctgtgttattagctaatgagtcatatattactttgttgttgttaacactttcacttctaatgtgagttttccgaccttttattggtaaattacaccacagaaattcaagtgaactcattacataagtaaatcttagctttggttccaataaatctatatcccccatgggactgaattagaaagtgcttaactacagattgagtatcccttatccgaaatgcttgggaccaaaagtgtttaagatttcttgttgttgttgttttttggaatagttgcattatacttactagtccagcatccctaatatgaaaatgcaaagtgtcaaatgctccgacaagcatttccttcgagcatcatgtcagtgctgaaaaagttttggattttgaagcattttggattttgtgtttttggattagggatgctcaacctgtacctatatttgtttatcattctttacagatggaatgaggatactggtgtactgaactttcttgaatcctatacatttttaggaagacgatggtattcttttaatttagcaacttctatgttagaggcactttcatgtactagtgtatgtgaaatttgtatgtttatttttccttttttaggtggttacggaccatttctatcatcttgttcttgaacaaacaagatatgctggcagaaaaagtcttggcagggaaatcaaaaattgaagactatttcccagaatatgcaaattatactgttcctgaagacggtaagatttcaaaacacattcttatgattgaggaatagaattgttttattaatagtcctgtaactctaattcacatacctctgatgaatcaaagaaattcactttatttaaatcaattttctttctactgcccatatcctaaagtattagagtgttacaaggtcctatttgtaatcggatcccatttgtaaatgtttccgagtttgactttccattgaaaccgtgcagcagaagaaagagccattttgggatgtgactgtgtcatgctggtatgagctctccctctagtgcctttggctgggtgtgacatgacaggtgccttgttagtccttgatacagaccttctcacttcaccctcagatgaccctgcatggtagtttctattattttttcccgtggaaagagagtctgagagaggagagatagcgtgttcaaagccacacgggtagagtcatgcaggcaaggcagtccttgcaccctttgtccccaagcccatgctggcagcagccgcgcttatctgctcctgtctctagccttgctgtggctgcagccttggggatttccagcagggccagcagccatcccaggccacctgagactgaggggtttccggggcacgggaccgtcagtgctaaagctgggaaggtagaccaggaagagttggtcactccgtttccagtcgcttacacttcagtttccagtgaacaccaggtctaccagaggctcataggagtgatttaaggtgaaataacaccgcttcttacatcttgaattccaaactagaaaacgcagaataaaagacactttcctggaaaatatagttaagatttggaaaatttattttttatcctcaatgaagagggaaaagaaaacttgcatttgtcattaaacttttttgctccttatgttcaatgttcttttctccctcatgggagaggcattatataagtatattcatagtaaaatcctgacccttgtggggccttccaacaaaatcctactgctatcacctgtgtcataaagacccgaaaaaaattcctactgctacatatttccttataggaataaataatagacattggaaatgggcctgagcaccagctctgcctgtggtctcaccagacccagctgctttcatgagccaccagcagtctccgcacccgccagagggtcactcagcgtgaggtcaaggtccaggctcttcctgagaccaaatcaagtggaaatctcattgcagttcatcactgccttgctctacccgcagcctgatgatgtgctttccaggactgaggccgggtgccgcttgcccatggcacatcatcagagcatggcttctgctgcgctttctgtggctggcattgccagtttcccagcaagctgggtctttaattctcccgctaaccgcctcttgccacctcctgtcactcagctcaggcagtggctcggcggccggggggtccttccaacagggtctgcctccccaggcccttccctctttccctcctcatggctgtggtccaggccctcactcctctcgtctcagcagctgccacagcttcctgcctgacctcctgtagctggtcactcacctttccagaacattctgtgaactaccaaagtcacccttctgagacacaaccttacctgcttaggagcaccaaggagaagcaccaccactggctgacagccaaggccacctgcccagccgcgggtgctgaagggcttccgtccaggggctgaggggaccctggcttgctgcctcggtgccaggcccagtgactgctcttcacccagcagcatgcgtcatctccatctgtgccctgcctctcccaagagactcacccatccctgagcatctgcagcacctgctggaagcctgggaccaccatcaactccaacgtcaactctcacttagcaattaaaaggaactaacagttggtccatgtgacggcatgggttaaactcacagtaattgtgctgacagaaagaatcaaagcaaaaactacacaccatgtgaatgcatttgtgtaaatgtctaaaaagtaaattagctgggcgtggtggtgtgcgcctgtagtcccagctactcgggaggctgaggcaggagaatcacttgaacccaggaggcggaggttgcagtgagccaagatcgtgccactgcactccagcctggtgacagagcgagactccatctcaaaaaaaaaaaaaaaaagtgcagacttatgcatggtgacaggaagcacatcggtggttgcctcgggaaggagggctgcagagggaatgcaggcgctgtgggagggtccggctgtgctcattgtttccatgtagtgatgctggcatgacaacacacacgccagaactcctcagacgggccaggcgtggtggctcacacctataatcccaacactttgggagtctgaggcgtgcagatcacctgaggtcaggagttcaagaccagcgtggccaacacggtgaaaccccatctctactaaaaacacaaaaattagccaggcatggtggccagcacctataatcccagctactcgggaggctgaggcaggagaatcgcttgaacccgggaggcagaagttgcagtgagccgagattgcaccattgcactccagcctgggcgacagaacaaggctccgtctcaaaaaaacaaaaaaaaagcactccagcctgggtgacggagtgagacttagtctcaagaaaaaaaaaaagaactcctcagatggtacacggacactctgggcattccagagtatgtcagtgacccccacccccgccaagataaatgacatgggcgctccccagccactccagaacacagcccaggcagagacccacagcggttgctgcacccttccctccctcactggatgctgcacccacccaccccccacagcaggtgctgcgccctcccctgcccatcactgggtgctgcaccctcccttctatgaatctgtgagtaagtgtcctcacagcctcacacaccctgcaacagagaaggcagagagtggtaagaacactcagctgtgtcgcctagatctcagatttcgtggggttacagaaaataatgataggaccacatgaatgtggactcttccgggggagaatgcctcagaaaggcctagagctagagggtcggccatagtgatctgggtgctccgcatgcctgagtggggagcaggaacagggaaggggagtctcagaagaggaggctgatggaagctgagaggcagtccatggaggccctgccagtgctgcccccagggaggccagggcccagctcctgtgcctggaggctccgagctttcctctcccaacagctctgcagggagggcagctctggggctcaggcaggtcagtaggatttctcccccaccccagcctgtcttgcttgcgctgctgtaacaaaataccttaggctggtgataggatttagatctgtgtccctaaccaaatcttttgtggaattgtaatccccagtgtttgaggtggggcctggtgggaggtgactggatcttggggatggatcatttttgaatggtttagcaccatcctcttgacactgttttcaagatagtgaatgggttctgcaacagcaggtcatttaacagggtgtagcacctcccccatctctctctcgctcctgccctggccacgtgagatgtctcactccctgtgcatcttctgccatgattggaagcttcctgaggcctccccagaagcctagcagataccagcatcgtgcttcccgtacagcctgcagaaccatgagccaattaaacctctgttctttataaattacccagtctcaggtatgtctttatagcaatgcaagaatggactaacacagctggataatttatgaacaacagaaatgtattagtcacagtactggaggctgaaatgtcaaagattaagacaccggccgattcagtgtctggtaagggtttctctgcttcatagatggcactgtctcatttcctcctcacatggtggagagggtgaggggtctctctcaggcctcttacaaggatataatcccatccatgaaggcggagccctcgtgacctcatcacctctcaaaggctgcccctcttgatattgttgcattggagattagcagtcaacatatgaatttggaggagacaaaaacattgagaccatagcacccccagagaaaagttttatcagagcaataactattaaaatgatgtaggagaagagggcaatgaaaattacatgtttggctgggcgcagtgactcacgcttgtaatcccagcactttgggaggccaaggtggccctgaagtcaggagtctgagaccagactggccaacatggtgaaaccctgtctctacaaaaattagccagttgtgatggcgggtgcccgtaattccagctagtagggaggctgaggtgggagaatcacttgaaccggggaggtggaggttgcagtgagccgagatcatgccactgcactccagcctgggcaagagagtgagactccgtctcttaaaaaaaaaagtacatgtttgtttttgccttgctgtacatgtattttaatgctgggaatatacagcagtctaacgttgaaattccttctgtgttttcgtagagttgtatctttgtttcatgttgcttaaataaagttccatttgtcatttctacagcaacaccagatgcaggagaagatcccaaagttacaagagccaagttctttatccgggacctgtttttggtaagcaattttgttaacctttgtttttctacctcccttcttaatcttttgtttcttacaatatgcaaattactccttgatgatctcatttaatcttccttaacattacgagcgatgacaaagggtatgttactttaatttcacagctgagcacaccgaggttcagagaggttagatttctcacccaaggtcacacagcttccaaccagcagagcctgggtgagaacacagcgttccagggaatggcacttggatgggctagacttcattcacttgttgtattttccaaaaaggacagcgtccttcagcagagtctaagcacccatactcttcctccatccaaaagcactaacaggctgatggtttatgtaaaaatggatgtgctcaaattcagatatttacttttttttcttcagctttttgagattatttcaaacttacatatgaggcagaagatttgtacaaataactcccatatactcaggccgggtgcggtggctcatgcctgtcatcccagcactttgggaggctgaggcagatggatcacctgaggtcaggagttcgagactagcctggccaacatggtgaaaccccatctctactaaaaatacaaaaaattagctgggtgtggtggcatgcgcctgtaatcccagctactctggaggctgaggcagaagaattgctgaaacccaggaggcggaggttgcggtgagccgagaccacaccactgcactccagcctggccgacagagcgagactctgtctcaaacaaaacaaacaaaactcccatatagtctttacccaaattgaccaattggcaaaaatttgccacatatgctttatctgtctatattattttctttgaaataacctacagcgtgtagctagctgtgagtttttactcgcttcaaactattacatgccaaggcattcccaagggcgtgttcccggtagtactccaagtgcacttaacacgtgtggacaagatcttagtccaggtagcagtagggctgatcctcggctgtggggcctttccacggggaccggcactccagcctggcctttcaccacccttttcccggcacacccctgtgggatgactcttgaatcctacagtgagttagaaagtaacaatgaggagaaatcaaggccccagggtgagttcagaggacaagggttcccccagaagtgcatggccgtaagtgcatggcaatacccagagagcttctgcgctgaataaatctgggacatgctatgttaaatacagcaagagagcctttacttaagccaattaatgtgcattgcaaatctcttcaataagggaatttagtttgtaatagctcaagggatcccttttttaaggagcattttgtaagaccatagcacataaagacacaagaaaatgctgttctaatgagaactaaatgttaattaagcatgcatatgttgggcatttaaatgaagattagaaacatccaggccggatgcagttgctcatgcatgtaatcccaacactttgggaggccaaggcaggtggatcacctgaggccagaagttcgagatcagctagacaacatatcgagacctcatctctacaaaaaattttaaaacgtacctgggtatggtggcacaggcgtgtagtcccagctactcaggaggctgaggtgggaggatcccttgagcctaggaatttgaggtggcagtgagctatgattgtgccactgcaccccaacctgggtgacagagcaacactccatctcaaaataaaaacaaaaacaaaactatttgaagcaacgacctttgtaatgactccattcccttaattttaaagctctagacagggacaaatagtcacactattacagaagaaagccttttttagtttgtttatttgggacattgcttcacactgtcacccaggctgcctggagtgcagtggcaagatcgtagctcactgcagcctccaactcctgggctcaagcaaccctcctgcctcagcctcctgagtagctgggactacaggcacacaccaccgcacccggctaatttttaaattttatagagatacagccttgctatgttggccaggctggtctcaaactcctcgcctcaagtgatcctcctgcctccacctcccaaagtgctgggattacaggtgtgagccactgcacccagccaaaagcctatttttcatccattcactacacacttactgtgtatgtgccaaatacctcacctggtgctttgggattaaaaagatatataactggttgggggaggggggagggatagcattaggagatacacctaatgtaaatgacgagttaatgggtgcagcacaccaacatggcacatgtatacatatgtaacaaacctgcacgttgtgcacatgtatcctagaacttacagtataatatatatatattaaaaatatatatatataacctactcattttagtgtccataagttttttttttaatgctcaagagaagcctgactattgctaaaataggtctatccccgtgaggagtttcatacctcatgacatctttaggataccctttctgtggtccaagcagctctctaaaggctgtttcccaggatcgaaaaaggagtggaggggatgaggaggaggcccagggattcccgtggcaccaaggaagaaggtgagcttccacaggacctctgtctaagtctgcccaggctgccataacaaagtgccgcagaggctgagtgtcttaaacagcagaaatgtatttctcacagctctggaggctggaagtctgaaatcaaggtgcggggtcttccctcgcacatggctgcatcctcctggtttcctcttctctctaggacaccagtcatattgcattagggcccaccctaatgacctcattttaccgtaattgcctctgtaaaggccttatctccaaatatagtcacatctgaggtgccagtcgtcagggattccacacaacttcagggaacacaatttggccctaacagcctgtccccacacccactgcacttagcttcatagtgcacattagcacatcactgaggtggtccccacaaaccatgattcgtaatgtctaaccctgtttctcaggtacttgataacagatcacttttctcccagaaggcagcaaacgttcccccgataaccaggggacaccctgcttagcagatgctaaactgcccctgtgtggaggccgccaccgggccgctgcaccgtccagtacagaaccactgggcacatatggacatttaattaaaactagctggccgggcgcggtggctcacgcctgtaatcccagcactttgggaggccgaggcaggcggatcatgaggtcaggagttcaagaccagcctgaccaacatggtgaaaccccgtctctactaaaaatacaaaaagtagccaggcgtggtggcgcacgcctgtaatcccagctactcaggaggctgaggcaggagaattgcttgaacccgggaggcagaggttgcagtgagccgagatggcaccactgcactccagcctgggggacacagcgagactccatctcaaacaaacaaaaaaacaaacaagctaattaggtggggcacagtggctcatgcctataatcccagcactttgggaggccgaggtgggcggatcacttgaggtcaggagtttgagaccagcctggccaacatggtgacaccccgtctctactaaaaatacaaaaattagccaggcgtgggcacggtgatggacgcctgtaatctcagccacttgagaggctgaggcaggagaatcccttgaacctgggaggtggaggttgcagtgagccaagactgcaccactgcactccagcctgggcaacagagctagactcagtctcaaaaatatataaataaacaaacaaaataaaattagctaattagaaatcagccccttggtggtatcagctagatagcgactatcatattggcagggcagatagtggacattcccattgtcacagaaaactctgttcagaccttcctttttggaagctcctcccttgacttgcctgccggggctttctctgacctatccgtgctgcttcagcctcctgggggcaatgataagggtgaggttatctgggtcctcggccgatgcttgcattgagaccattcctgcctctaagtgctcccatgcaaaacaagcaggccactgtcaccaaagcctccagcacctgctcagcgtggcctagtccttccccagagtacatgctggggccgcgcagggctagtgcacacgctctctcttgcagaggatcagcacggccaccggtgacggcaaacattactgctacccgcacttcacctgcgccgtggacacagagaacatccgcagggtgttcaacgactgccgcgacatcatccagcggatgcacctcaagcagtatgagctcttgtgaggatgctgccgccaccctgcgacggagcggcgccccggactgcctgactgccagccccatgccatggtaggaggcagagtctctagttccatctcgctgccgtctgtcccgttctgtgtcgaccaccaagcctctggctacctctgtcccctcaggtttggttgtgtagcttctgttgtcattgaatacggcctcccgcagcatcccacccccaaaccaccgactctcattgccgacactgcagcagaatctctccgggtgggagccccattattcattctccctttattgattcatcgaggagaacttggtagatggggagaaaacacagttggtttttttttccacgttatcaaccgtgactgcaagagcgttcgtgcatgccctgagccacggccgtctctgattctccctttatgaagctgcaggctgacgagagatggtcccttcccattggccttagcccaagacttggagtcgaccccaagcgacagagtgaccagaaacccttttacagtcacattcagagtcgctgctggcctcaggcatttgaattagagctactttgagcctcttaggcagaaaacctaccacattcactactgcaaaatgtgtcctgtctaaaaatgattctctaaactttccctatacttaggcatagtcttctttcttagattctctttgttgttgtccctattgctggtttattacactgtacagaccacaaaatgtaatattcttttgtataactactaaagaaaaatccttgtagatctttgtgccttcaccatggctatctatacctgtacatgaaatgtgtttgtattgtgctgaagagcttaatgtcaacattacctgctgcttactctgaaaaaaggaatgaatggtagctgtagaatttaggatattttatcaggttggcactttataaaatactccctgatttaaaaaattgtaagttatacacgttaatcatccacattctatcgacaatgtaccaacatcacaagctgttgcaaccacctgctgttacttctctgagctgtaaaaacctgaactcaattcaggggtacaaattgcaatctaatcttttcagggaaccagggatttttttctctctctctagacaatatgtttcctcattagtctgctaatgaaacacttcttcaagttccccaagtgggaacaggtccatcattcccttagtcaaaactttggacacaggctacgtcatacaagtaagcaaacagtaagagaaaaacaaaatgtggccaggcgcggtggctcacgcctgtaatcccagcactttgggaggccgaggcaggcggatcacgaggccaggagatcaagaccatcctggctaacatggcgaaaccctgtctctaccaaaaatacaaaaattagccaggcgtggtggcgggcacctgtaatctcagctactcgagaggctgaggcaggagaatctcttgaacctgggaggtggagattgcagtgagccgaggtcgtgccattgcactccagcctggacatcaaagtgagactcaggccaaaaaaaaaaaaaaaaaaaaccttgacgtgtcaatgtttgtgtctggcctaggagaatgaggatgacagcttcacttgccttttgaagaagaaacattacaaaaccttaacctgaagtataaagtcaaaagatacggctctttctcacacttgcaagacttacaaatacagcctcaaacattatgacacaccaacaatatctagaaagtaagaactggtgtagcaatgatgcttcatattctagctgtagccacagagttgagggtagtttttgtaggtctaaaataataatctataaagatgtccaaagttaaattttcaacaatacaaatctagagaagtgacagcctacattacttcattattactcttcttttagtctttagtctttaatattttaaagtttactctataaatcagcattttgtaatcctttataaactcatccagatttaaatgctactttttcatgaagaaaggataactttatagacagtcagtgcaacacacacattttatctcatcaccgtcttactgcctccccatccactgtctcataaagccctcagctgaactaagataaataatacaatggaaattattttcagttccccttgcactgtcaaagtaaaacaagaaaactgaaaagctgcacccccagcaagaaagggaagtatgctgttgtatgcatcattactcaacaattaccctctaactaaacatcctgtttaagagtttaattcaaacaacagccagactgttaagaaaaaaaacaaaaagaataacttttatctggcttacaattattaaagcatttattttcaggtaccaaaagccatatcccattccactttttaagtttcttttgatcactgacaggcattaacagatgtagcaacgtggtctcctatagagaaaattacacttatctaaaaatctgattccattaattgatcaagtataaaaatctacgaaaacaatatgttctgcacatcacatctgtacttttttttttttaaatatattttttgagacggagtctcactctgttgcccaggctggagtgcagtggcatgatcttggctcactgcaacctccgcctcccgggctcaagggattctcctgcctcagcctcagctggta

SEQ ID NO: 14897 - DNA, 10288 bp, Human
agttcactgagaaggctatcttatttcagattccaggtaagcagaatcacttaaatttaaaagagcacgctctgtgttgatatgcaaaactttgttaaagtatacgttttgatctttaattcatttattagttacaaatgttatttactatttagtaagcacacgcaaatgtggtaatcactgcatttattaggaatacactgtaaggttacaggcagtgtgggtgtggattttgactgtatttgaagttttcttaccttgaaacttacttagcacttgtaaacctataccatagagtttagcctttatttcctcttaagagacttgaaaatcctacaccatctagtgtagtgctaatcctaaagaaaacaaccaacgattaagtgttaattgttgattggtatcaccctatgatcaattgttttcaccctaaggctcaagtgaaaccaaacggttggtcactttttcgatttagtattttttcaatttcttagatctcaggatatttttagtagattttggatgagacaacaaggatgtctgacgaccatcattctcagaaaatatctggcatcacctcaaatctggatttcgaacattacagagggatgaatgaggagcagtaccactggactgagggcctggcccactttgccatcttggtattcttaatctttgtcctagttcctggcacgataagaattttcaaataaataaataatttttgtattaaaaaagtagtatttagaaccgaatatcttctataatatagaaaattgagtcagctttcccagtaatgattctttaagttggccttctgaaatatgagaaaatgttaccctgatagtctcgatgatattttgcaccatgggtagggttgtattttaaagttaaatgactacatatattgttttttgtttttgtcgagagacctgagatggggctaattgaaaacgtctggagcttaaagacccgtgcagtttacgcagcaaggatattattgctctgaatttcaataaatcaacatttcactatatatcggcaaagtctacagcctttaaaaaatgaccaatatagacggaatcaaaaccgatgtagtcccaaagcggcacagagctgtatctgccaaagcgtccatttaaattcgtgcgttccaaggaaaattactgcttagtttctatccatttgcaaaagtttatgatttttttcaggcattcctcacacctgttaggttaaaatcagtaacactcttaaaaagaaagcgagagaccggaaatgatatgagaatagaattggccactccagagacatctgcaaatgacactccatttttccttctcgcgctgcaaaatgtaccggtaaaccggacttcccgggactcgctgggtggccgacattttccctagcaggaattttacgtttccaagatctgaatggatgttaacggtcgggctaaatgccaggcaggtcttcattgtggaattaaacagcggtgggagcaagcggaataaccgagttcccctcccgcacctgagtgccggcagcgagccgcgagccgggacctgtcacccgcgggaagccccggccgcccgacgaacagcatctccggtttccgcctccggctccggcgcggctcccccggcccgcctctgcgtcagggacgcggaaaccccgtaggagcagggcgggcggggaaagcgaggtttaactaactccgcagctatattcttccgccgcgaggtaaagagtcccaacccaaccccgggccctaggatttccagcgaccctgtaatatcgagaaattaccacatttgggtttttctaccaacttgcttaggattttatccgaggtaacgaccccaggatcacaattttgtagctgaccgaagcacggcgagaaaattcctccgcaagaaacgggttccggccacgagcctataaaaaacgggtggttgggcgccgctgtcttttcagtcgggcgctgagtggtttttcggatcatgtctggtggctccgcggattataacaggtatgcagtctgttggcggtcgcggtctgtagtgaaggtcatagggcgccaggggagatgatagtggatggcaaggaggcaaaaactctaaattaatggacgttttcttagggtacagcactcctgtgcccttccagaagcttccatgatgggtagggcccggattgtggggagataggacggtggtgcgaaagcagtggctaaagggcgtttttcctccctaagacattacgaaacttcggctgctttccttcccagtgtagagcacgggaaacatggagtaaaaagccgtggcgcagtccgagttcggtacactgtaaccaggacccgaagctttattttcggtcatccacacgagttgggggagggtcctaggctttacttggggaagggttggaggcagcggtctccactcggccacggcgcggaggcgacgggacaggaccggtgccggtgaaccgttggcatcgccctcgccaggccgctccgcccgcgtcaatcacccggcttgcgcattgttgggggcggagttcggcgctccgagctctcgcgagacgctccgcagttgaaacgggatcgccatgcgctcgggcctggggggctgcctttccgggcatccgcaggccccaacctttagggaaggcgcacagtgtggatattcgccctgaggctgctgctttagcttgtgcaggggaggctaacgtgctgagacgggttgcaaagggctatgcgcttaaggtgcagttgaggtggcctggaaggggtgtctgactgcagtattcttgtcagcagagaacatggcggcccagagggaatggaccccgatggtgtcatcgaggtaagaaacggttgtggatcttgaagctttggaaaggtgagtgtgttcatctcatttatgcgtgcattattttttctaacttacagagcaactggaatgagattgttgataactttgatgatatgaatttaaaggagtctctccttcgtggcatctatgcttacggttttgagaagccttccgctattcagcagagagctattattccctgtattaaaggtaaaagaaactggcatttttaggaaattgttctacatagacatgaaccataaaagggaaagtaacctctgggggactagcacctgtttgtattccttaaagtgaaatgatggcaatcatctttcgggactgacctgaaatgaagagaatactcattgctgatcacttgattatttgggcataatgttccaaatggaatacatggtgtgaagtagaagtgacaatttgatgtgggatcggtaaatgtgtatcctactttttttagggtatgatgtgattgctcaagctcagtcaggtactggcaagacagccacatttgctatttccatcctgcaacagttggagattgagttcaaggagacccaagcactagtattggcccccaccagagaactggctcaacaggtattgatagtgtagttcaaaaaaactgcttgcgtgttgcataggtttcaggtttcacaactgtgaagaatttaaaacttagtataaattggtcctaccagatccctccttttaattgtccatgcatgcagggagtttttgttgaaagttttaaaagaactgggtatgcaggtatggtttgtagggttgtatactaatagattgagaatccgaagcgctctcttggatgtactagatctgtccccattttttaagtttgaatgcagttgtgcaacatgaaaactgcagtgacatgttaccatttgactgtctccgtagttcgtgatgcatctgttgcatgctatgttttcaaagctcactgctatattggctttgaagtaaaccttcctaataaagctgtaggctttattgaggtcaggattatataaggcacaataccctctgggggaaaaaaatcatttgccctagctgtaattacagaacataaatttcactacgtactccctacctacagtgaagaataatgtaggaaacgttattcttgaattgtctagctgatgcgtggagcagcagcatcccaagtttgacaaggcataagaaagacattaagggaattttaccttgcagcagttaggtcgtctgcattttaagcttggaagtagttttgtgctgtgcatgcataaaagctgttggcagaccagattatatttgcctttatgctttaaaaattagtcattgatcctggagttctgcggaataataattaaggcttgggttttagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacctttgtaagtattgtctttaagagagtattttttttaaaactgttaacatagttgaaaagtcaaattgtatcactgagtagatctagaaatgacagtatgactttgtttctaacagctccaaaatggatcaaaatgtttgttttggatgaagcagatgaaatgttgagccgtggttttaaggatcaaatctatgagattttccaaaaactaaacacaagtattcaggtaagcattacttcacccccctcttaaaggtagagatggggtttatttaatgcaggtactgttacaatacaactgatgtgttttgctgtcgttccccctgcttaaagcacttgatgcataactctgtctaccttcattccgtagtaagacagagacgcttggcttcagacattttcctttgggtattaatgtgtaagttgtgctacaacataattttctctttttaaggttgtgttgctttctgccacaatgccaactgatgtgttggaagtgaccaaaaaattcatgagagatccaattcgaattctggtgaaaaaggaagaattgacccttgaaggaatcaaacagttttatattaatgttgagagagaggtaactgtctgattgttagacattattttaccttcttgtataagcactgtgctaaaattgcagacactaggaccatgtcttggtttttgcaataatgctagcagagtacacacaagaagaaaagtaacagcactagattgtaaagactggggtggacctctttcttaatgtccaatgtcctttgtcttaagatttggtgcaatatctcattagacctaacagaatgaagttaatttttataatttctacgttttgagactgggttatgagactggctaagactggccaattttggtattttgggtagagacagtttcactttcttgaaaccctggtctggttggaactctgggctctaagtgctaggatcccaaagggctgggattacaggcattagcactgtggctggcccagaatgaatttttaactgaagagttggaaaaactaaatgactgttaactttaacttctaaacattacaggaatggaagttggatacactttgtgacttgtacgagacactgaccattacacaggctgttatttttctcaatacgaggcgcaaggtggactggctgactgagaagatgcatgccagagacttcacagtttctgctctggtaagaggtgttctaaaatgtctggatttccactaaagcaggattcagactacaatatagctgctaagtgctgtgttgtcgttccccctgcttaaaataaagttgtttcttaactatacctgtctgctattctcctgtagcagccagggacgcttggtctcatacatgttgattaaaattaaataccgacctgactggtgattcttgaattaaggtttattaatttgcagcatggtgacatggaccagaaggagagagatgttatcatgagggaattccggtcagggtcaagtcgtgttctgatcactactgacttgttggtaagtctcttaatgctttttaaaaatctaccaaaagttagctttttggggggcaggtttttaagtaacctttgccaacttgggctatttggaagagtaaaagaccacactccacagtgggctataccacttagtatagttcgctactattttgtggcctacatgacaggtgtcaagtttttttgaatcaatttttaaaacatgccattgtgtttcaggctcgcgggattgatgtgcaacaagtgtctttggttataaattatgatctacctaccaatcgtgaaaactatattcacaggtgagaagccagcatcttggctgtattgaaaaaaattcatacgtttttctactgtgatttgtatgaaaggtaacatcaaatcaaggaatagattcagtaaagtcagtagtgttcagtaagatgatgtaattaaatttgtactagggaaggttgatgagaacaaagtgggaaaacttgtaaacattgcccagattgtggacatagggtttttttccacaattgttggtcttaccttatgcttgagcttttagtgatgttcttgtgtccatgtgtttttcttggtgattttttctatagttgggattttcttggtgtcgcctggtagcaatttgagtgaaccctggtttagttatagtggctttatccctaaataaattgaattgtactttgttatatgatgtaaaaaaagactttttaaaaaatacaggagtcgatagcagcagttggtgacgagatggcactcagaaacggcgttgacgtaatttaggacgtggaatcataagcgaaacagcacactgtttgaataaagagcgagtcggtatttatatttgtttttcttttgtcatgattatttgatttttaagttgctccagctaaggcatttttttgtattagtatttctattagggaacctttcttattaggtggtttgtattgtctggtttctaacatgcaggtagctgtttggcagttaaacacgtttagagtaatttgagttacaacgtgtgaaactgagcaaaaaagcagtgataagtttgggttaccataccaaatatttgttttcccactggaaaaaagtaagttttagaaaatagttaacctttgcagcatttgtttacagtttacagttccagaagtgcgtcgaaatggattacataactgctcttttattcctggtgttcacatctgtcccaggctgacacctgctcttggctggcccactttggtatgggctttaatttcactaccccaaacacgatactgtcatctgctttataataatgctcaagatgcctgataaaaatctcattttgcagccagacaagccttgaatccttttggcactaactgcaaaggaagatttttttctctagatatgcattagcagctagtgctccagttagaagcacgaactataaccttgataagtaaacagcagctggtggttaacaagtggatcgtcatgttcagtagtttatacattatgtgagaagtaacgttctgattctttttcttacacagaattggcagagggggtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtataaaagatggggtctgtaaaatctttctttcttagaaatttatttcctagttctgtagaaatggttgtattagatgttctctatcatttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattcaataaagtatttaattagtgctaagtgtgaactggaccctgttgctaagccccagcaagcaatcctaggtagggtttaatccccagtaaaattgccatattgcacatgtcttaatgaagtttgaatgttaaataaattgtatattcactttaaaggtgcttttggtcattttatttttattacaacttcattatttacaaaaccccccatccagatatattcacgttaacaattctgagataactgctgcatcacagttgcacaaaggctgatgagttgcaaatgttcatcagcaccatctgctaggcatttgtcaacttcctacgagaaaaatttaagaaattagcatccttcaggtagttaaatgttccattgacatgtgcaaagtacctacttacggcaagtttttctgtgataatagacttctgtttatcagataagttattttctacaaccacatcatggagttgattgacgagctgagttgctgcatgaccctcatctattaaatcctataataaaaaaaacttttggtatgatgacttaatattcctttccccaaagttagtaagctgactttaccttgaccacagcttctagtttgtcaaaagagccactctgacaggcagcaaatactccatcaattttctcagctggtattacctaggtaattgaatgttcggtattaaagatgtttctaggtgagactagacatacactctgccaactggcccccgtgcccccagtcatttctgttccacacctaagttccatacttttctgggaaggctttgggagaacggaaagggccagagtaactccagccaccactaagcaaccaaggtgctaacaactgtgcttttaaagccctttaatggctttgtgaacttccaagtttgggcacacatggattatagcttgttctggtcagtggatgaagattaagttttcccctagcggctataacgattcctcagaacagtggccaagatcaaccaaaaagactgatttctttaaaggggaagtgccctttctctcaatgtctccatgtaaagatgccactaatgagattggtttaaaaagtccacaatatccagaaaattaaagaggattagtggtaccagtcttgtcatatggaaggcctaccgtgaaggtgaaaaacgtcatagaaacaaagaggattagtggtaccagtcttgtcatatggaaggcctaccgtgcaggtgaaaaatgtcacagaaacaaaagttgttaagtagtagtgattctgaagtgagtttttacatgggagtatccaaagacaagtggggtactccattctctttaataaatgattactgtaagttggatatgccttttgtttatatacaactggcaaaatagttttcatgtataagaacatctgctaaaattgatttaactgccaaaggcatctcttataaaatctaaaaactgaaggctgggtgcggtggctcccacctataatcccagcactttggaaggctaagcggggggcggatcacctggggtcaggagttccataccagcctggtcaaccaacatcgtgaaaccccgtctctactaaaaatatacaaattagctgggcatggtggcaggtgcctgtaatcccagctaattgggagggtgaggcgggaggtggaggttgcagtgagtcggtattgcgtcactgcactccagcctgggcgacacagcaagactctgtctcaaaaaaaaaaaaacaaaaaaactaacaactgaaagtgtccttttctttcctgaaatgtctgttacatgcctgacaaactgaaaagtcagtgctatctcctcacctcaaacactctgatactcccaggttattcccttatacttcctagtgcagtacttggcacttgctaaacacccagtatttgttggatgaaaatttcctaaaagccacaaaaaagccaactaaaaagaaattcagaatatccagtactcttaccccagcaatgtctgtaatcactttctctgtgatctcctttccacctgttaatcgagtagcgctttgaagaaatgtaatggcttttcttaagtctccttctgacactttaacaagataagctattccctgaagagaaaagagttgtttttaacctatgatggccaattaaggatt

SEQ ID NO: 14898 - DNA, 10303 bp, Human
caaagaagcatttatagttcactgagaaggctatcttatttcagattccaggtaagcagaatcacttaaatttaaaagagcacgctctgtgttgatatgcaaaactttgttaaagtatacgttttgatctttaattcatttattagttacaaatgttatttactatttagtaagcacacgcaaatgtggtaatcactgcatttattaggaatacactgtaaggttacaggcagtgtgggtgtggattttgactgtatttgaagttttcttaccttgaaacttacttagcacttgtaaacctataccatagagtttagcctttatttcctcttaagagacttgaaaatcctacaccatctagtgtagtgctaatcctaaagaaaacaaccaacgattaagtgttaattgttgattggtatcaccctatgatcaattgttttcaccctaaggctcaagtgaaaccaaacggttggtcactttttcgatttagtattttttcaatttcttagatctcaggatatttttagtagattttggatgagacaacaaggatgtctgacgaccatcattctcagaaaatatctggcatcacctcaaatctggatttcgaacattacagagggatgaatgaggagcagtaccactggactgagggcctggcccactttgccatcttggtattcttaatctttgtcctagttcctggcacgataagaattttcaaataaataaataatttttgtattaaaaaagtagtatttagaaccgaatatcttctataatatagaaaattgagtcagctttcccagtaatgattctttaagttggccttctgaaatatgagaaaatgttaccctgatagtctcgatgatattttgcaccatgggtagggttgtattttaaagttaaatgactacatatattgttttttgtttttgtcgagagacctgagatggggctaattgaaaacgtctggagcttaaagacccgtgcagtttacgcagcaaggatattattgctctgaatttcaataaatcaacatttcactatatatcggcaaagtctacagcctttaaaaaatgaccaatatagacggaatcaaaaccgatgtagtcccaaagcggcacagagctgtatctgccaaagcgtccatttaaattcgtgcgttccaaggaaaattactgcttagtttctatccatttgcaaaagtttatgatttttttcaggcattcctcacacctgttaggttaaaatcagtaacactcttaaaaagaaagcgagagaccggaaatgatatgagaatagaattggccactccagagacatctgcaaatgacactccatttttccttctcgcgctgcaaaatgtaccggtaaaccggacttcccgggactcgctgggtggccgacattttccctagcaggaattttacgtttccaagatctgaatggatgttaacggtcgggctaaatgccaggcaggtcttcattgtggaattaaacagcggtgggagcaagcggaataaccgagttcccctcccgcacctgagtgccggcagcgagccgcgagccgggacctgtcacccgcgggaagccccggccgcccgacgaacagcatctccggtttccgcctccggctccggcgcggctcccccggcccgcctctgcgtcagggacgcggaaaccccgtaggagcagggcgggcggggaaagcgaggtttaactaactccgcagctatattcttccgccgcgaggtaaagagtcccaacccaaccccgggccctaggatttccagcgaccctgtaatatcgagaaattaccacatttgggtttttctaccaacttgcttaggattttatccgaggtaacgaccccaggatcacaattttgtagctgaccgaagcacggcgagaaaattcctccgcaagaaacgggttccggccacgagcctataaaaaacgggtggttgggcgccgctgtcttttcagtcgggcgctgagtggtttttcggatcatgtctggtggctccgcggattataacaggtatgcagtctgttggcggtcgcggtctgtagtgaaggtcatagggcgccaggggagatgatagtggatggcaaggaggcaaaaactctaaattaatggacgttttcttagggtacagcactcctgtgcccttccagaagcttccatgatgggtagggcccggattgtggggagataggacggtggtgcgaaagcagtggctaaagggcgtttttcctccctaagacattacgaaacttcggctgctttccttcccagtgtagagcacgggaaacatggagtaaaaagccgtggcgcagtccgagttcggtacactgtaaccaggacccgaagctttattttcggtcatccacacgagttgggggagggtcctaggctttacttggggaagggttggaggcagcggtctccactcggccacggcgcggaggcgacgggacaggaccggtgccggtgaaccgttggcatcgccctcgccaggccgctccgcccgcgtcaatcacccggcttgcgcattgttgggggcggagttcggcgctccgagctctcgcgagacgctccgcagttgaaacgggatcgccatgcgctcgggcctggggggctgcctttccgggcatccgcaggccccaacctttagggaaggcgcacagtgtggatattcgccctgaggctgctgctttagcttgtgcaggggaggctaacgtgctgagacgggttgcaaagggctatgcgcttaaggtgcagttgaggtggcctggaaggggtgtctgactgcagtattcttgtcagcagagaacatggcggcccagagggaatggaccccgatggtgtcatcgaggtaagaaacggttgtggatcttgaagctttggaaaggtgagtgtgttcatctcatttatgcgtgcattattttttctaacttacagagcaactggaatgagattgttgataactttgatgatatgaatttaaaggagtctctccttcgtggcatctatgcttacggttttgagaagccttccgctattcagcagagagctattattccctgtattaaaggtaaaagaaactggcatttttaggaaattgttctacatagacatgaaccataaaagggaaagtaacctctgggggactagcacctgtttgtattccttaaagtgaaatgatggcaatcatctttcgggactgacctgaaatgaagagaatactcattgctgatcacttgattatttgggcataatgttccaaatggaatacatggtgtgaagtagaagtgacaatttgatgtgggatcggtaaatgtgtatcctactttttttagggtatgatgtgattgctcaagctcagtcaggtactggcaagacagccacatttgctatttccatcctgcaacagttggagattgagttcaaggagacccaagcactagtattggcccccaccagagaactggctcaacaggtattgatagtgtagttcaaaaaaactgcttgcgtgttgcataggtttcaggtttcacaactgtgaagaatttaaaacttagtataaattggtcctaccagatccctccttttaattgtccatgcatgcagggagtttttgttgaaagttttaaaagaactgggtatgcaggtatggtttgtagggttgtatactaatagattgagaatccgaagcgctctcttggatgtactagatctgtccccattttttaagtttgaatgcagttgtgcaacatgaaaactgcagtgacatgttaccatttgactgtctccgtagttcgtgatgcatctgttgcatgctatgttttcaaagctcactgctatattggctttgaagtaaaccttcctaataaagctgtaggctttattgaggtcaggattatataaggcacaataccctctgggggaaaaaaatcatttgccctagctgtaattacagaacataaatttcactacgtactccctacctacagtgaagaataatgtaggaaacgttattcttgaattgtctagctgatgcgtggagcagcagcatcccaagtttgacaaggcataagaaagacattaagggaattttaccttgcagcagttaggtcgtctgcattttaagcttggaagtagttttgtgctgtgcatgcataaaagctgttggcagaccagattatatttgcctttatgctttaaaaattagtcattgatcctggagttctgcggaataataattaaggcttgggttttagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacctttgtaagtattgtctttaagagagtattttttttaaaactgttaacatagttgaaaagtcaaattgtatcactgagtagatctagaaatgacagtatgactttgtttctaacagctccaaaatggatcaaaatgtttgttttggatgaagcagatgaaatgttgagccgtggttttaaggatcaaatctatgagattttccaaaaactaaacacaagtattcaggtaagcattacttcacccccctcttaaaggtagagatggggtttatttaatgcaggtactgttacaatacaactgatgtgttttgctgtcgttccccctgcttaaagcacttgatgcataactctgtctaccttcattccgtagtaagacagagacgcttggcttcagacattttcctttgggtattaatgtgtaagttgtgctacaacataattttctctttttaaggttgtgttgctttctgccacaatgccaactgatgtgttggaagtgaccaaaaaattcatgagagatccaattcgaattctggtgaaaaaggaagaattgacccttgaaggaatcaaacagttttatattaatgttgagagagaggtaactgtctgattgttagacattattttaccttcttgtataagcactgtgctaaaattgcagacactaggaccatgtcttggtttttgcaataatgctagcagagtacacacaagaagaaaagtaacagcactagattgtaaagactggggtggacctctttcttaatgtccaatgtcctttgtcttaagatttggtgcaatatctcattagacctaacagaatgaagttaatttttataatttctacgttttgagactgggttatgagactggctaagactggccaattttggtattttgggtagagacagtttcactttcttgaaaccctggtctggttggaactctgggctctaagtgctaggatcccaaagggctgggattacaggcattagcactgtggctggcccagaatgaatttttaactgaagagttggaaaaactaaatgactgttaactttaacttctaaacattacaggaatggaagttggatacactttgtgacttgtacgagacactgaccattacacaggctgttatttttctcaatacgaggcgcaaggtggactggctgactgagaagatgcatgccagagacttcacagtttctgctctggtaagaggtgttctaaaatgtctggatttccactaaagcaggattcagactacaatatagctgctaagtgctgtgttgtcgttccccctgcttaaaataaagttgtttcttaactatacctgtctgctattctcctgtagcagccagggacgcttggtctcatacatgttgattaaaattaaataccgacctgactggtgattcttgaattaaggtttattaatttgcagcatggtgacatggaccagaaggagagagatgttatcatgagggaattccggtcagggtcaagtcgtgttctgatcactactgacttgttggtaagtctcttaatgctttttaaaaatctaccaaaagttagctttttggggggcaggtttttaagtaacctttgccaacttgggctatttggaagagtaaaagaccacactccacagtgggctataccacttagtatagttcgctactattttgtggcctacatgacaggtgtcaagtttttttgaatcaatttttaaaacatgccattgtgtttcaggctcgcgggattgatgtgcaacaagtgtctttggttataaattatgatctacctaccaatcgtgaaaactatattcacaggtgagaagccagcatcttggctgtattgaaaaaaattcatacgtttttctactgtgatttgtatgaaaggtaacatcaaatcaaggaatagattcagtaaagtcagtagtgttcagtaagatgatgtaattaaatttgtactagggaaggttgatgagaacaaagtgggaaaacttgtaaacattgcccagattgtggacatagggtttttttccacaattgttggtcttaccttatgcttgagcttttagtgatgttcttgtgtccatgtgtttttcttggtgattttttctatagttgggattttcttggtgtcgcctggtagcaatttgagtgaaccctggtttagttatagtggctttatccctaaataaattgaattgtactttgttatatgatgtaaaaaaagactttttaaaaaatacaggagtcgatagcagcagttggtgacgagatggcactcagaaacggcgttgacgtaatttaggacgtggaatcataagcgaaacagcacactgtttgaataaagagcgagtcggtatttatatttgtttttcttttgtcatgattatttgatttttaagttgctccagctaaggcatttttttgtattagtatttctattagggaacctttcttattaggtggtttgtattgtctggtttctaacatgcaggtagctgtttggcagttaaacacgtttagagtaatttgagttacaacgtgtgaaactgagcaaaaaagcagtgataagtttgggttaccataccaaatatttgttttcccactggaaaaaagtaagttttagaaaatagttaacctttgcagcatttgtttacagtttacagttccagaagtgcgtcgaaatggattacataactgctcttttattcctggtgttcacatctgtcccaggctgacacctgctcttggctggcccactttggtatgggctttaatttcactaccccaaacacgatactgtcatctgctttataataatgctcaagatgcctgataaaaatctcattttgcagccagacaagccttgaatccttttggcactaactgcaaaggaagatttttttctctagatatgcattagcagctagtgctccagttagaagcacgaactataaccttgataagtaaacagcagctggtggttaacaagtggatcgtcatgttcagtagtttatacattatgtgagaagtaacgttctgattctttttcttacacagaattggcagagggggtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtataaaagatggggtctgtaaaatctttctttcttagaaatttatttcctagttctgtagaaatggttgtattagatgttctctatcatttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattcaataaagtatttaattagtgctaagtgtgaactggaccctgttgctaagccccagcaagcaatcctaggtagggtttaatccccagtaaaattgccatattgcacatgtcttaatgaagtttgaatgttaaataaattgtatattcactttaaaggtgcttttggtcattttatttttattacaacttcattatttacaaaaccccccatccagatatattcacgttaacaattctgagataactgctgcatcacagttgcacaaaggctgatgagttgcaaatgttcatcagcaccatctgctaggcatttgtcaacttcctacgagaaaaatttaagaaattagcatccttcaggtagttaaatgttccattgacatgtgcaaagtacctacttacggcaagtttttctgtgataatagacttctgtttatcagataagttattttctacaaccacatcatggagttgattgacgagctgagttgctgcatgaccctcatctattaaatcctataataaaaaaaacttttggtatgatgacttaatattcctttccccaaagttagtaagctgactttaccttgaccacagcttctagtttgtcaaaagagccactctgacaggcagcaaatactccatcaattttctcagctggtattacctaggtaattgaatgttcggtattaaagatgtttctaggtgagactagacatacactctgccaactggcccccgtgcccccagtcatttctgttccacacctaagttccatacttttctgggaaggctttgggagaacggaaagggccagagtaactccagccaccactaagcaaccaaggtgctaacaactgtgcttttaaagccctttaatggctttgtgaacttccaagtttgggcacacatggattatagcttgttctggtcagtggatgaagattaagttttcccctagcggctataacgattcctcagaacagtggccaagatcaaccaaaaagactgatttctttaaaggggaagtgccctttctctcaatgtctccatgtaaagatgccactaatgagattggtttaaaaagtccacaatatccagaaaattaaagaggattagtggtaccagtcttgtcatatggaaggcctaccgtgaaggtgaaaaacgtcatagaaacaaagaggattagtggtaccagtcttgtcatatggaaggcctaccgtgcaggtgaaaaatgtcacagaaacaaaagttgttaagtagtagtgattctgaagtgagtttttacatgggagtatccaaagacaagtggggtactccattctctttaataaatgattactgtaagttggatatgccttttgtttatatacaactggcaaaatagttttcatgtataagaacatctgctaaaattgatttaactgccaaaggcatctcttataaaatctaaaaactgaaggctgggtgcggtggctcccacctataatcccagcactttggaaggctaagcggggggcggatcacctggggtcaggagttccataccagcctggtcaaccaacatcgtgaaaccccgtctctactaaaaatatacaaattagctgggcatggtggcaggtgcctgtaatcccagctaattgggagggtgaggcgggaggtggaggttgcagtgagtcggtattgcgtcactgcactccagcctgggcgacacagcaagactctgtctcaaaaaaaaaaaaacaaaaaaactaacaactgaaagtgtccttttctttcctgaaatgtctgttacatgcctgacaaactgaaaagtcagtgctatctcctcacctcaaacactctgatactcccaggttattcccttatacttcctagtgcagtacttggcacttgctaaacacccagtatttgttggatgaaaatttcctaaaagccacaaaaaagccaactaaaaagaaattcagaatatccagtactcttaccccagcaatgtctgtaatcactttctctgtgatctcctttccacctgttaatcgagtagcgctttgaagaaatgtaatggcttttcttaagtctccttctgacactttaacaagataagctattccctgaagagaaaagagttgtttttaacctatgatggccaattaaggatt

SEQ ID NO: 14899 - DNA, 12440 bp, Human; identical to SEQ ID NO: 14109

SEQ ID NO: 14900 - DNA, 12440 bp, Human; identical to SEQ ID NO: 14109

SEQ ID NO: 14901 - DNA, 6907 bp, Human
  misc_feature (1)...(6907): n = A,T,C or G
aatgctcatatattcaaggcttgctatcagggagaagaaacatacacacatacacacacacgcacgcacacacacacacacacacacacatagaggggcgtgcgcgcatctcgtcttttttattctaaaaggtgcccacccttagacaatagctggaccttctgatctttccagaccacggtgggaaaggtgaggcgggcagtgcgcatgcccgggtagctacaggtgcatcacctgcgctgtccttgctggtggtcactataagagcggctcccacgcgctggtcgcggccggacgagcgcgcgcgcgcgcagacgcacggggccgccgagaaggagagcgcgcgtcagacagacggagacagctgatgcctgtcagcgcggtggggccgcgagctctcgcgagagctccccgggacggccgcgagaagtggggctcaggtgttagaggagtgcatcccgtcggcgcgcggggctagagctgtcggagaagcgggaccgcgaggccggcgcgcggcgctctgcgcggtcagagggagcgcctggcagcagcaggagcagcagcagcagcccgcggcggggccgccgccagccgccgcgaccgccgcggctgcagcctccgaagggaggccgggtgagccggcgtacgcactttcccgcggactttcggagtgtttgtggatatacatgccaagccgccacgatgatgtccatgaacagcaagcagcctcactttgccatgcatcccaccctccctgagcacaagtacccgtcgctgcactccagctccgaggccatccggcgggcctgcctgcccacgccgccggtaagcgccccacgcccgcggccccggcccgcgcgcccgcccctccccgtctccgaaacgctgcatgtcgggggctggtgtgtgcaggtcccggtgcggggaactgcgggcagggggtgtagagcagtcccgcagcgaggcacgttttgtccggcggcccttaatgtcgtgttcctgtctgcctctgcctccgcgtcaggcgcctgcgatcggagtagggagcgctggggccaggactctcgacttccctctactttctctgttaatttcacgcctcagaaaggcagtctctgtgcgtgctcgggtgtgtgacacgggtccccagctgcgagttacatttccatttcttcttttccctctttttcgtctcccacgcccgtttccggaatgtgttcttgtgtccccctttctccctacttctgtccccctctccacgctcccatcccttctcgtctgccccctccctggtcgtcaatgtgccccctctccgtctttcccgctctccactgcccccaaacccgttgttattttggttgctttgtgtttgcccttcgcatgctgtgctttccggcctgtgtgtgtgtttcttctgttgttttgttttgctcttttggttttgtggtttttttggtttggtttgtgtcgcctgcagctgcagagcaacctcttcgccagcctggacgagacgctgctggcgcgggccgaggcgctggcggccgtggacatcgccgtgtcccagggcaagagccatcctttcaagccggacgccacgtaccacacgatgaacagcgtgccgtgcacgtccacttccacggtgcctctggcgcaccaccaccaccaccaccaccaccaccaggcgctcgaacccggcgatctgctggaccacatctcctcgccgtcgctcgcgctcatggccggcgcgggcggcgcgggcgcggcggccggcggcggcggcgcccacgacggcccggggggcggtggcggcccgggcggcggcggctttttgttggcggcggccccgggggaggcggcggtggcggcccggggggcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcggtaccacagcctgggccacctgtcgcaccccgcggcggcggccgccatgaacatgccgtccgggctgccgcaccccgggctggtggcggcggcggcgcaccacggcgcggcagcggcagcggcggcggcggcggccgggcaggtggcagcggcatcggcggcggcggccgtggtgggcgcagcgggcctggcgtccatctgcgactcggacacggacccgcgcgagctcgaggcgttcgcggagcgcttcaagcagcggcgcatcaagctgggcgtgacgcaggccgacgtgggctcggcgctggccaacctcaagatcccgggcgtgggctcactcagccagagcaccatctgcaggttcgagtcgctcacgctctcgcacaacaacatgatcgcgctcaagcccatcctgcaggcgtggctcgaggaggccgagggcgcccagcgcgagaaaatgaacaagcctgagctcttcaacggcggcgagaagaagcgcaagcggacttccatcgccgcgcccgagaagcgctccctcgaggcctacttcgccgtgcagccccggccctcgtccgagaagatcgccgccatcgccgagaaactggacctcaaaaagaacgtggtgcgggtgtggttttgcaaccagagacagaagcagaagcggatgaaattctctgccacttactgagggggctgggaggtgtcgggcgggacagaatggggagctgaggaggcatttttggggggctttcctctgcttgcctcccctcggatttggagtgtccgttatcctgcctgcatttggggagtcccttctcgctctctttcctccacccattctctgattttcctgcctttgctgtcccctagccttgaggactggggtgctgggtgtggggattggagtatagggtaggggagaagggggggagcattcgggggagtggggagtggggggaaggaaagcggagacccgagcaggggttttaaggagcaggatggttctggggtttgggtggggggagacgcgggaagggtaggaaaatggactgtttctgaccagagacacttacctaaatatcctggggaccaaggaactatgtacaaaaacaaacctaccaaccaccaaaaactagacaaataaagacaaactaaaacaaaacagaacaaaagcaaaggaaaatgctttagaaattttaactccggggagccataatctgcaacttcattttcccccatagaagagaaaaaagagcaccaccattattaccacctccccaaccctacacgcacgaactgagtcgaaaaacgaaaaccaaacgagcgagaagttgaagttctgggtatcaaagctagttgttctgtctgcgtgtttaatttttccctctctcacctccaccccatccatatcctctttatttcctccgttccaatgagaggcctatggctgctctccaatcccgggaagtgagtgggagcacagctgaaaagagagggtcagggggaggctggctgcttgcttaggtggaatccaagttttcccgtggccctgcctatactctggtggcctggtcctgttggggtgggggtctttggagagaagggcatagtctttgagctactaaaaagcagaattccggagcttcgagatatcttattctaggaaaatgaaacaattttaacaacagttttttttcctcttatgtcgaagatctagttttagacaatttcaaaataagcttttcccactcatagaactttaacttgccctttcagttttatcttttttttagagagaggtttaaactactgatttttcctgttgattcaaatagactaatggggtgaaagttattaggagagatactctctcctgttttctccactgaacgagactcatcttgctcttctaggtcccgtttcttcctctcttggaggacatgaaattatagaaatgttgagaagttcctgctttcttttgcggtaggacttggctgtgagaaaatcacctaaatcccagaaaagaggaagacagatttaaagtgcccccacccccatttgtttcaaagaggtctgcatgttgggcgaaaacagaacaactgtgtttccttttacttgttcttattattcaagagtcatttattacaggggataaatgttgggtagcaagaactttaatttgcactaccagtctcccaaatagaaaatcatgtatagtatttcatagtaataatcaggtaccttacaagctgctggtggattttaaaaaattaagatagttgaaggtggttaggtaaaatgcctgctttgtgtacaagatactctttggatctctcgtagagatggtttgttaccatcctttaatcataactaaaacattgaaaacagaacaaatgagaaaagaaaaaaaacctgccgattaacaagactgaaatcatgcatgatctgaaaggtgtggaaagaaacacaattaggtctcactctggttaggcattatttatttaattatgttgtatatcattgtttgcagggcaaacattctatgcatttgaaactgagcactaaactgggctagctttctggtagaccgttttgtggctagtgcgatttcacagtctactgcctgtttccactgaaaacatttttgtcatattcttgtattcaaagaaaaaggaaaaaagattattgtaaatattttatttaatgcacacattcacacagtggtaacagactgccagtgttcatcctgaaatgtctcacggattgatctacctgtccatgtatgtctgctgagctttctccttggttatgttttttctcttttacctttctcctcccttacttctatcagaaccaattctatgcgccaaaatacaacagggggatgtgtcccagtacacttacaaataaaacataactgaaagaagagcagttttatgatttgggtgcgtttttgtgtttatactgggccaggtcctggtagaacctttcaacaaacaaccaaacaaaaagaaaacacaaagaaatggggggagggtagggtgttgaagggggacaaaaaggggagagattgagaatgatgtatttttttgctgaatcagaattcactttcagataactcatgaaaagtggtgctctaaataaaatgaattctatattagttgcctgtgtttataaaagttattattttttaactgcagaaactcttaaaccacagcacttgatccagagtggtgaaaaccaataaataaccaggcacccaaaaaacatttaaatttagggtcagggacagaggaatttggaggtttagatgtgatattctaccctaaaaacacctagtaactgaatggcttttctttggagggtaatacattttaaaacatttagtgtgccacctactgctccacagtgactagagagcctctatttcttggtgacttgggactagatcagatgccaaatgtacaaagtttcttaagagttgagattatatcatctgaagtcatcttattttagccaaatctttttaatttcaccggcaaatctgtgaaggaaaacacttgatgttcaaaaagaatagtacattttaaaagctgcgattttaaacagttgttaatgttaaaaaaaaaaagcactagaggtatttttaaacatagaactcttccataaaaagttgatttgtttttgctgttattgacttgaaacatcatcagttttaaataaaatgcatttgtaaaaaaaccgttattttatagaaaagtatgactggatttcattgttggaaaaacaggacagaacaaatgaaaagatttacaaagggttttttttaaagtctgcctcaagcagaaatgttgcaggcaaacacatgtgtattatataataatgatcaatgtaggtattaagaatttaagaatttgctttaaataaaacctttaccacataaaaataagagtattatgttaataaaacatcatgaaaatgaatttcctattttatgtagtaggaaactgtgcaaaacaaaaaaaaatgctttgctttctggtaagcgaatctatatatggcttgaaggagtagtaagactattctaagacgcctttaactgtcaatccatgaaaaaaaaacaaaaagggacctcctgaagaggccaaactatcattgaagtgggtgtcaatgagtgatagtttggcctttcaaagttttctagttctgaagagaagttcactctaagcggattcctccaccagttttggggtgaatatgataaaatgtgtgtctcggattcttttaaagaataatctcaaaataagtttgagagagtgggaaaattgggctccgtttgcatttcagcttctcaggaaatccaggcggcggcgggggtggaataggaaaagcaaaagacaaataagcattaaagcatctgccacatttatgccatccatttgtcttaaatttcctcttttccccagttctagctccaggtcgtgttccttctgtaggtctaaaaaaattatgtcctcaagacccatcaactaacttctgaataatttttgtttaatgcgtgttctgaaattgctctcaacttcgattacagtttcataaataaactgtaggcacccactgccgtgattgtatcgatttttgttttcttgtgatactgagactacttcggtccagttcctcctacacgtggcagcgcacgtgagagaacagggcgccccaagcccgcaggactcactcagcgatccctgccctctgcctctgccccgccgccccggcctctcctgatagcacctggcacctgcgtgaagtatccctactcatctttcaagttgataggctttcgcagtttttcgtccgtgaagttggaactggggcttctgatcctggctaaaactagcctttcccaccccattc

SEQ ID NO: 14902 - DNA, 44019 bp, Human
  misc_feature (1)...(44019): n = A,T,C or G
tttttgctgaatagtgttcaattgtatggttatatcatattttatttattcaccagttgatagacatttaggtagtttctactttttgcctattatgaataatgctgctgtgaacattctgtgggcaagtttgttctattgggtacatacccaggaatggaattgttgagttgtatggtaaatttatatttaattctttcagagggctgtacttattttttattcccttttaaaaacagctttattgagatacaatttgcatatcatagaattcatctgttttaagtatgcaattcaatgaattttagtatatttatcgagttgtatagacatcaccatcaccacaatctaattttagaacatttctatcactctaaaaagaaattttgtgtccacatgtggtgttttgggtctggcttcttttaccaggcatgtgtaagattcattcacattgtacaatatattagcactccactcctttttattgtcaaatactatttcattgtatggatatgccatattttgtttatccgctcagtggttaatggacatttgggttgtttccactttttgtctcttgtgaacaatactgctatggacatttatgtacaagtttttgtgtggatgtgtgttttcatttctcttgcataggtacctaggagtgaaactgttgtattatatagtaagtatatatttaaccttgtaagaaactgctaaactgttttccaaactggctgtactatttatttgtttatctttattttttattttttttgagatggagtctcgctctgtcaccaagctggagtgcagtggcgtgatctcatctcactgcaacctcctcctctcaggttcaagcaattctcctgcctcagactcctgagtagctgggactacaggcgtgtgccaccatgcccagctaatttttgtatttttagtagagagggggttttgccatgtttgccaggatgatctcgatctcttgacctcgtgatccacctgcctcggcctctcaaagtcctgggctacaggcatgagccactgcacctggtctggctgcactatttatgagggttccagtttctccctattctcaccaacatttgttattgtctgtcttttttattgtagccattctagtggaggtaaagtatatttcatgtgtgatttttgtttgtttgttttttgagatgaggtctcactctgttgcccaggctggagtgtagtggcatgatcatggctcacttcaggccccaccacccaggttcaagtgattctctgcctcagcctccctagtagctggaactacaggcatgccatcacacccagctaattttaaaaatatttgtagaggtggggtcttgctatgttgcccaggctgatctcaaactcctgggctcaagtgatcctcccaatttggcctcccaaagtgctgagattataggcatgagccaccatgactggatctcatgtggttttaatttgtatttccttaatgactaatgacactgaacatctttaaatgtgcttattagccatttgtatatctattttggtcaaatgttttgcccatgttttaattgggttgtttgttttcttattgtattgtaaggattctttacgtattatgggggtattatcggatacatgatttacaattgttttctcccagtccgaggctaatcttttccttttcttaatggcatctgttgaaagatttttgaggaaaaaaaggacaaaatacagccatgcttcagaaagataggcaggcagcagtacgtgggatggatcaaaagggacagagaactctttttgaaagttgtaataaaaggaacaggcacaggccaagttttaaaaaattctccaggaatcaaagggttataagcagctatttattgaagcctgtttacagtccagttaaccagtaaaccagaatcagtgaaactacccatctggggaagtgcaaaaaacctttcaaaaggctttcctggattagagaaagaaagggagtgagggaggagagatgagtggctattccagaacgacataaagaatttccagccttggacggacagctgggaacgtcttccaatttggactggtgtttacaagcgggaagctaggtggaccttggattttggcgggtgaagaggctaggttgtttaaggaggtggggcgcgtttcagtggctctctttgaaaaagcccagcaagatgtcagacctgctctcagtcttcctccacctcctccttctcttcaagttggttgccccggtgacctttcgccaccaccgctatgatgatcttgtgcggacgctgtacaaggtgcaaaacgaatgccccggcatcacgcgggtctacagcattgggcgcagcgtggaggggagacacctctacgtgctggagttcagcgaccaccctggaatccacgagccctgtaagtcctgaacagctcttgagggtgtgtggggcagggcctttcccttgcaaatccagtaattggagtggtttctggggtggtccgtggacgcctccgcctacaaggtattatctctttctcagcctgtgctatttccctcttagccctcaaactgccactgcctctggggagctataaccctccttcagccttcagacctttcctcctttttgggttctgtttgctcaaaactttaatggtaaaagatgagtcttcttccctgctcatgtcccatatcccttcatttcccccatttcctttcttttccccttactattgttctgtctttccccacccaatggctcaggagacataggcaaaaacaatgagcccttctagttctgccaggaaacttagaagggtataggggaatctcttcggggagtgacagtgtggtattccagagagagtttggggacttgggtgtcagttttatttactggattcttttttattttttatttttttgagacggggtctggctctgttgcccaggctggaatgcagtggcatgatctcagctcactgcagcctccacctcctgggctcaggtgatcctttcccctcagcctcctaggtagctgggaccacaggcatgcaccaatacgcccggctaatttttgtatttttagtagagacagggtttcatcatgttaaccaggctaatctcaaactcctgggctcaggcgatccacccaccttggcctcccagtgttgggattacaggcgtgagccaccgcacttagcctggattcctttttttagtttgtttctactgtaaaagcaatccatgtttggattaaaatttagagattagataaggaaaaaaaataataaaactcaccccaaatcccaccactgttaatgtattgatgtatatccttccagacttttttctatgcatatttaaaccctgactcaaacacatgtaattgtttctataaaaatgaaattgtattataactgcccttctcatttcacaatctgttatggatagcttccatgtctataagtgcagatctacatcactgtggttttggctgtgtaatagctcattgcatgactgtgtttaactgtccatatattgatggacatttaagttgtttctaatttctcacttctttccttaccagttcctccttcaaactcaacttcaaatctccctttacctcttcgcttccacatcccctgcccaagtccagactccatcacaagctgcctacatgattgcactgaactcccaactggtttctaacttcattttttttttttttttgagatggagtctcactctgttgcccaggctggaatgcagtggtgcaatctcagctcactgaaacctccacctcccgggttcaagcaattctcctgcctcagcctcccaagtagctgggattacaggcgtgcactaccatgcctggctaattttttttatttttagtagagacggggtttcaccgtgttggccaggctggtctcaaactcctgacctcaagtgatccacccgccttggcctcccaaagtgttgggattacaggcgtgagccaccgtgcccagccaggtctctaacttcgaactgctgcactctgaatcttccatttggtacacagatgccagaaaaattttcctaaatcttgacataatcccactttcctactttaaaagcctcacactcaatggactggccatgggattcagaatattgcatggaggaggctcatagaaggccatggggttacctgggataattgcctcgctttgaaactgcacttccatagcaagcagcctgctgtcaatcagatcatatgttcactgtggaagctcgtgagtgttcatggacatcatggggttagccccccaacactccaagcccccttgttggtgctcctgtactttctagctttcaaggccttctttgaagctttttcacaggactctagccctcactgttccctcttttctctgaagcactataactgctattcacccattcattcctttaattcattcattccacaaatatttaccaatcacctacaatatgcaggcacttttgtagactctggaagtacagcagagaataaaacaaagaccctgccctcatgggcccgaattctagtggggtaagactgacaataaatgggtaactacgtaaatacatattacatcagatggaaataagtgctgtagagaaaactaaatcaggaaaaagagataaggatggcatggaggaagacaaggaggagcaggagaggcactcaggagaggcgtctccactgaggtggctttgaacagagagctgaaggatgggtgtgatggcacatgccgtgctgatattgaggaggaaaagatgacgggcagagggaagagcaaaggcaatgctctggagcatgcttggcacatgtgaggaacagcaagggggccagtgcggctccagccgagtgaatgaggggagagcaagagaggaggtcacagccatgtgatggggacaccaggcaacaggagatcacgcagggcctcataggccctggtaaagatctgggcttttactttgagtcaagtgagaagccactggagggttttttaagcagaagggggagacgatctgtcttaaattttgtaaagatcactcagaacaggggtcagcaaactacagcccaagggccagccacctgttttggtaaatgaagttttatgggaacataatcacgcccattcacttttatcttgtccatggctgcttttgctggaagagttgagtagctgtgacagagacatcacggcccacaaagcctaaaggatttactctctagttctttataaaaaagttttgccaacccctgactctggagaatagactttaaaggggctaggcagctgcagggagaccaagtgggagatttattgcaataacctaatattgccaatagtaccaagcttgaaggtgcaggggcttgaaccaaaatggtagcagtgattgttatgagaagtggttgtgttccagatatattgaaagtagaggccagctgtggtggcttatgcctgtaatcccagtactttgggaggactgcctgaggccaaaagtttcagaccagtctggacaacatagtgagacttgtctctgtaataaattttttttttagaaaattagcctcgtgtggtagtgtgcacttgtggtcccagctcctcaggaggctgaggcgggaggatggcttgaactgagaaattcgagaggctatcctgagctatgattgtgccactgcactccagcatgaatgactgagcaagaccctgtctctaaattaaaaaaaagaaaaagaaaaaagaaaaaggagagccaaaagaatctgccattaagcatctgctaagtgcatggcactgtccaaagttctacagggcagtggttcccagacttacagatttcataaagaagttaaaaaaagtgttgttgttgtttttttttaaataaataggagaccggagggaactaaaacagatcttccaaattttattttactgaataaggatgtgaagaaaactacctgtcatctactatatccatccttttctaacagaaaagacattttaacaccaagaaaagtaagaaagacataatctatgatttaaaaaaatacactaagattaaagaatactcgctatggaaaatccaccacatgatccttatggattataagcattcctttgagaaaaactgctgtaggtatactaagataaataataatggatggtgtcacaagttaaaaattatgtacactgctaaggccaggtccggaaaaggaaatagaacatatataaaaataggtaaaacccagccgggtgcaatggctcacacctgtaatcccagcactttgggaggccaaggcgggtggatcacctgaagtcgggagtttgagaccagcctggccaacatggtgaaaccctgtctctattaaaaatataaaaatcagccaagtgtggtggcaggcacctgtagtcccagctaattgggaggctgaggcaggagaattgcttgaacctgggaggtggaggttgcagtgaactgggattttgccactgcactccagactgggtgacagagtgagactccatctcaaaaaaaaaaaaaaaaaaaaaggtaaaaccggggaagtcaacagagagctctctctcatcaaggagaacccaagatgacttcacagagtatcatgtgaactgggcctagaagggtggtgagaaggatttggaaatgagaagatgaagaggtacagaaccagaaaagtcatggacgcaggaaagtattgggtgtaagaaaaatcatttggcaagagcttttctccttcctcttaaaagagggcaagaatgattttctttaggtgaccccagaaactttcagatcctcaattcttacctcaagttgaacagttaacatggcccaagagaagactgaggaatgagacatagcaggtgccttcctattctgtgccttcagatttggcctgcttagatttgaaggagtgattttagttttcctgtacttcagtggggacaatggagaacgagctcagtcctgcccccaatcctattcttcatggtaggtggggtgggagggagtggggaaaacccctgccagcccactgaatcttagatccatcgctgcggagctggtcacctctgctcacctgctgtgttcttgttcagatggagcaagaaacttttcaagtgccaagaaaactaagttttcaactgggatcattagcggctgttacgctaaaacctagagtacttcatgaaaacaggttctggggaacatccttatcctgaaagatttgtctctgagaagcagcatgctactgtaaatggcactgtaagtgccacctgggcttgggcctctatagagccattagctaggcaacctcagacaagttacttaacctctcccatccttattaccctcaccctgaggctattaatgcccactttacaagttttctgtgaattttagcagtattgaacataactgtctagtacactatgggggttcaatacatggcactcattatcatccctggcatgaatttttgtaggttttgtaactgtaattggttaggaaggggctcagggattattgcaaaagacccaatgaaagcatgagattttctttcattcgttactgaaaaagagaaaaaaggtccttctgcaaggttaggcatcaatgacacttccaagcttcccccatcttttctcttccttgcagtggaaccagaggtcaagtatgtggggaacatgcacggcaacgaagcgttgggccgcgagctgatgctgcagctgtcggagtttctgtgcgaggagttccggaacaggaaccagcgcatcgtccagctcatccaggacacgcgcattcacatcctgccatccatgaaccccgacggctacgaggtggctgctgcccaggtacgaggtccaagggagatgccggggagagatcaaggccttcttaggaaataaagtccagtggacaagattccctctctgtcccactgtaaatatcacaaatgttaaaagtaaaagatgaaatggccaagagaaaaaatccatcagaaatataagaaaggatgaagaggtgggttcagtcctacagcacctcaggcaataaacatgggctctctctgagcctgcattccctcaacacctttccagatgacctcagggttttattgtgaggattaatgtggcaatatctgtgataacactttgtaacctggaaaatactcaacagatgtggagggatattgcaaaataaagctcctttcctggactttcagcatcaaaccctacatacctttctttcttccacactacatttccatttgcatttgtggagaaaataacaaggacaacaggctttccccagaactgggggtagggggctaattctacattcttcatactttattatatttccatagagttgtttcctctactagtatagcacttagtctattgattctatattttagagttatatttgcagtgggaccgataagaaaaaatgtctaagggctttctttttttgggatagagtcttactttgttgcccaggctggagtgcagtggtgcgatctcggctcactgcgatttctgcctcccaggttcaagcaattctcctgcctcagccctcgagtagctgggtctacaggtgtgcgccaccatgcccagctaattttttgtagttttagtagagacgggatttcgccaggttggccaggctggtcttgaactcctggcctcaggtgatccacccacctcagcctcccaaagtgctgggattacaggcgtgagccaccgtgcctggcaggactttttactttattttctaacataaattcaaaatgtcagcgtgcctaacatttgtcttattattattagtaacatcttaagtgtttcagatcgatatgcgtaactttaaatcaatggttctcttctgtggctgtgcatcagaatcacagatgaagattttgaagtacagattcccaggtcccaccgcaggcctactgagtagtattgtcaagggtgaggccaggcatcgatctgccttatgcaatggagatgttcctttaaaagctgtgtttaaaaggcagggttttcggccgggcgtggtggctcatgcctgtaatcccagcactttgggaggctgaggtgggtggatcacctgaggtcgggagttcgagatcagcctgaccaacatggagaaaccctgtctctactaaatatacaaaaaattagccaggcatggtggcatatgcctgtaattccacctacttgggaggctgaggcaggggagttgcttgaacccaggaggcggaggctgtggtgagccgagatcgtgccattgcacagtcctgcccacatcctttgcagtaggtggggtgggagggagtggggaaaatccctgccagtccactgaatcttagagccatctctgggaagctggtcacctctgctcacctgctgtgttcttgttcagagagagcagatcttgaacctgaacccgagaggacccatcaggttctcagactctcagagatacctgccatgcccagaggcaagctgtctgcgtggctacacagagaagaacttcctggccaccagactttgaagccacttgtaggtggccagaataatgccccccaccaaagatgtccatgtcctaatcctcagaacctatgaatatgttatgttactgggcaaggaggaattaaggttgcagatggaactaaggttgctaatcagttgaccttaaaataacctggagtattgtggggggggggatggggcccagtgtaatcaattacgagggtcctttaaatgtagaagagggaggccaaaggtcacagtcagaaagagctctgaagatgttacacggctggctttaaagatggaagagccttggctgggcgccgtggctcaggcctgtaatcccagcactttgggaggctgaagtaggaggatcacctgaggtcagaagttcaagaccagcctgaccaacatggagaaaccctgtctctactaaaaatacaaaattagccaggcgtggtaacacatgcctgtaatcccagctactcgggaggctgaggcaggagaatcacttgaacctgggagatgaaggttgcggtgagctgagatcacgccattgcactccagcctgggcaacaagagcaaaactctgtctcaaaaaaaaaaaaaaaaaaaaaagatggaagagccaaggaatgtgaatgatctctagaaactggagagacaccttgcttttaggcctgtgagacccgttttagtcttctgacctccaaaactatgagacaatacactcgtgctgttttaaaccactaaatttggggtaatttgttacagcagtaataggaaacacaacactagccctgtttatgaaaccttctgttaggggaagccccttcctgccaacttaactattgaccagtgtgcagggaaatcagtggataatgcccatagctgtttatgctgacagtcaagagttgccttgatataaataagcaagcagtgacaagcccctggaagcataaagaaaatcattatgtcacagaagtgtacaccaaaatgaaagatccaataaatgttttccactggaacacaactgatgtaggaaacttaaaggaacttcaaaacaattatgttttcaataggatctaaaaatgaaatacaagcagggtgccatgaaaagaggagaaatctgagaataatactgaattcttagaaaaaaatgtaatctgccgcattttattggttagaaaagggaaaatatgagaacggcgattcatctgtgagattgtagcttcccggcatccattcattcacttccaggaacagccaacaatttgggctccaccttctcagtctacagggacccagttggcactatttcccttctccaatgccacacaaaacattaaatggaatttcaattttgaatgagccttttaacatatctctattctatcactctatgtatttaattatttatgtgtgtgtccatctccccatgtgtactatgaattcctagaaggctagactacaatgtctcacttatctctttccccagtgtctatctgagagctctgaatagagaaggacttaagtaaatgttggttgactaaatagatgacctaatgagtgagtgaatacatgagcaaataaatgataaaatctgaaatatggacagagaaattaagggatccagaaagttgatattgctcaaaagaaagataagtaagcatcctaaattttttgaaggggggaggagtgagtttccatagtgtaaccactttgaaaaacagtttaacagtttctcaaaaagttaaacataaggccgtagtggctcacgtctgttaatcccagcactttgggaggtgggtggatcacttgagcctagaagtttgagaccagcgtaggcaacatggcaaaaccccatctttacaaataatttaaaattagccaggtgttgtggcgcgtgcctgtaaacaccagctaccaggaggctgaggtgggaggatcacctgagcccaggaggttgaggctgcagtgagccatgatcatgctgttatactccagcctaggcaacagagtgagaccctgtctcaaaacaaaaacaaaaacaaacaacaaaaaacagttaaacatggacttagcttatgactcggcagttctacttacagatatctacccagaggaaatgaaaacatacatccacacaaagacttgtacgtggatgttcaaagcagcattattaacaatagccaaaaggtgaaaacaacccaaatgtccatgaatctccccctaccacccttcgccaaaattcgcattcacctgaaatctgtgactatgatcttatttggaaatacatagtcatccttcagtatccgtaggtgattgattccagggccccccaccaatatcaaaatccttggatgctcaagtcccttatataaaatggcatagtatttgcacataacttatgcacatcctcctgtatactttaaatcatccctaggttacttatgttacccagtacaatgtaaatgctatgtaaacagttgttataatgtactgtttaaggaataatgacaagaaaaaagtatgtacatattcagtacagatgcaaccatcataggcctaactacattttcaatcagaggttggttgaatccacacatgtggaacccatggatatggagggcctactgagggtctttacggatacaattgagatgaggtcacctagaatcaggatggactctaaatccagcataactggtgtccttgtaagaagaaagaaatttgcgaatagagatgcagacagactggggaggaggccatatgaagatgaaagcagaaattagagtgatgggtctaagagccaaagaatgccaaggacttcctctggccaccagaacctggaagaaacaaagaaggggaccagagagcgtgccgcccatccagttgacttgattacaacttctagcctccagagaataaattggagaataaattgctgttgttataaaccacctagtttgtggtgattgttatggcagccctaggaaactaacacagtttcctaatactaatagtattaaactaatactaatactggtgaatggataaacaaaatgtgataaatccacataatggaactattcagcaatagaaagaaatgaagtactgatacatgctacaacatacatgaacctcacaaacattatgcccagtgtgggggaaaaacccacaaaagaacagataatgtatgacccacttatgtgatctgtccagaagaggcaagtctaaggagagataaagttattacctacgctaggatgaaaatgagaagtgactgtaaatgggaatgaggtgtctatttggtgtgacagaaatgttctaaaattagattgcaatgatgattatacaactccgtaaacatactaaaattcattgaattgtacatttaaaatgagcaaattttatagtatgtgaattatatctcaataaagctgttcataaaacattggggttcccatgatcccgaaacaccctactcttattagaacttctcttgagatatgtacctcttacacgtgatctgcagggaacttgaagtccaccactgtgactttggataagtcaaagtagaaaatgattcatcttcttgtgacggggactaaaggaaaaaaaatgctacatcatttgattaagctaatatctaagaactatacaatgtgcttcaaatataggattcatggctgcatgtagtagctcttgcctgtaatctcagcactttgtttggtttgttttttttagacagagccttgctctgtcacccaggctgtagtgcaatggcatgttcttggcccattgcaacctcacttcctgagtttaagtgattctcgtgcctcagcctcccaagtagctgggactacaggcacacgccaccacacccagctaatttttgtattttttagtagagatggtgtttcaccattttggccaggctgatcttgaacttctgacctcaagtgatccacctgcctccgcctcccaaagtgctgagattacaggtgtgagccactgcacctggcctctcagcactttggaagggcgaggtgggtggatcacttgagcccaggagtttgataccagcctgggcaaccagcctcatctctaccaaaaaaagaaaagaataaagaacaattagcgggtgtggtggtgtgtgcttgtagtcccagctactcaggagactgaggtgggaggattgcttgagcccagtaggtagaggttgcagtaagccaagattgtaccactgcacttcagcctgggcaacagtgtgagaacctgtctccaaaaaaaaaagttagaaaatatagtattcaatctgaaaccttcatttttcatcttttcattttcctttagggcccaaacaagcctgggtatctagttggcaggaacaatgcaaatggagtggacctgaaccgcaacttccctgatctcaatacctatatctactataacgagaagtacggaggccccaaccaccacctgccccttccagacaactggaaaagtcaggtaggagatgaaatttgcaaacaaagcaggtaaatcagcatctggaatttcttgcagaaagactgctaagccatctttacatcaactaaacaagcaagaattaagcatcaactcaactcagtattaacccatctagagcaataatatatatttcttccgtgtctttgtatttattttctcctcagcatagagccctccatggagcacacactaagtgattttttttttttttaagacagagtctcgctctgtcgcccaggctggagtgtaatggtgcgatctcagctcactgcagccttcgcctcccaggtccaagagattctcctgcctcagcctcctgagtagctgggattaaagatgcacaccaccatgcccagctaatttttgtatttttagtagagacggggtttcaccgtttgaccaggctggtctcaaactcctgacttcgtgatctgcctgcctcagcctcccaaagtgctgggattacaggcgtgagccaccgtgcctggttaaatgtttgatattagtggtgattgtggtgaaggatatgaaagcagtatcatttggttgcatggttcttaacaattttccagaattatttcacagccagtttcagttgatcatgacatcatgtgaaatgcaccaagcagtgttatccatctctgttttatagctattacacttagagagaaaataatttacattctcacaggtagtgattgatggaatcgggatgaagatgcaggccttctgattcttattccaacattctttctactacactagactgtggacagaagcattctatagagacgtctgtcttactcgtgataagctgtgtgcttaaccaacaattagctatagaaagagtctcaggctgggtgtggtgtctcacacctgtaatcccagcactttgggaagctgagacgggaggattgcttgaggtcaggagtttgagactagcctgggcaacacagtgaggccccatctctacaaaataaaaatacaaaatttagctgggtgtagtggcacatgtcatagacttagctatttgggaggatcccttgaaggagtttaagagttcaaggttacagtgaactattgtcctgcctgctccagcctgggtgacagagcaagagaccctgtctccaaaacaaacaaacaaaaaaaaagttcaaggaatctaacccttagttttcgggactgggcgcggtggctcacgcctgtaatcccagcactttgggaggccgaggcgggcggatcacgaggtcaggagatcgagaccatcctggctaacatggtgaaaccccatctctactaaaaatacaaaaaattagccaggcgtggtggcgggcgcctgcagtcccagctacttgggaggctgaggcaggagaatggtgtgagcctgggaggcagaggttgcagtgagctgagattgtgccactgcactccagcctgggtgacagagcgagactccacctcaaaaaaaaaaaaaaaaagaaatatgatcagcttagagcgtatgtaagttaagctgggagcagtagcacatgcctgtaatctcaccactttaggaggccaagggggcagatggcttgagctcaggagttcaagaccagcctgggcaacatagtgagaccccatctctaaaacaaaaaatccaaaaattgggcgggtgaggtggcatgtgcctattgtcccagctacttgggaggctaaagtgggaggactgcttgagtccaggatgttgaggctgcagtgagctgagatcacaccactgcactccagcctgggtgacagagcaagatcccgtctcaaaaacaaaacaaaacaaaatgtaatagttaagagcacagactatagagccagactacctagatctatatggcagctccatcccttattacagcaannnnnnnnnnnnnnnnnnnnaccccagcccggagggtaaaagagcaagactccgtctcaaaaaaaaaaaaaaaaaagttcagggaatctaacccttagttttttcttttccctttctttctttttttttttttttgagacagagtcttgctcttttaccctccaggctggagtgcagtggcacaatcttggctcactgcaacctcttcctcctgggttcaagcgattctcctgcctcagtctcctgagtagctgggattacaggcacgtgccaccacccctggccaatttttgtatttttagtagagacagggttttaccatgttggtcaggctggtctcgaactcctggccttgtgatctgcccacctcagcctcccaaagtgctgggattacaggtgtgagccaccacacctggccccttttccctttctatatgacctttgactactttatcattactataccctccctgatttcccttactcttccaatcagaggatcccattccatattcctaggcctcactctccaagaggcctataatggaagtccttggtaatgtgagtggtttcaccctgctggtgggcctgctcctgaaaataactaggcattctctaagcatcactgccacccctggtgatcacgctgtgtgggatagtttgaaatgttctatttgtgaatgtctaaatttagagactggggaaagaaaagcaaagcaggtgtaagccttttaattgggagtttcccaaatggagtattctggggtttttttctcccttgaaaatgaagcaaaagccatgctgacatgttagatttcaaacagcaactatcctcttggttcaagtaaatagtaaataaaaaataactttgtaaggctgggcgcagtggctcacacctgtaatcccagcactttgggaggcagaagcgggcagatcagctgaggtcaggagttcgagaccagcctggctaacatggtgaaaccccatcctactaaaaatacaaaaattagccagctgtggtggtgggcgcctataatcccagctacttgggaggctgaagcaggagaattgcttgaacccagatggcggaggttgcagatggcatcactgcactctagtctgggcgacagatcaagactccatctcacaaaaaaaccaaaaccaaaaccaaaaagcaaagaacttcgtgttagtcaggatatccaaccagaagaatgttctgatgtaataaacttgtttctctaagtaaaataaggtaattgaatcaatgataactaggctcccactcaatcctctgtctaaattttagggggaaaagcaaagaggtttccctcgctcctgatggaatatccttgaggaagaggaacagtgaaaagctggccttgttctgatagaggcttaggacacaaagacagaactgccccagagggtctgagccctggtcacagaccaagactggtgccctcgcaattatattcattctgattaagactcaaccctatttatccagtccccttgggatggaaaagatggagcctgtagagctgaccttggtccagaaggagccattaacacagtaacactacataatctctaaacttgttcatcctgagaggaggaaaaatgctgtagactgtaaattatttacttacactgcaagtcccagtggattcaaggctttctttggaatattgtcactcactagcaatataatatgcaatagaaaggtggaatttcactgcttagccaagactggcccatctgacagtatgtctaacccatgaaatttggatttgaccacaggagtgtgttctacatgtcaatattacagcagggaggaaggaggttgaaaaccatcactgtaaactagcatttttaagattgatttattggagtcctaaatttctgctaagatgacttagaagtcactggagcagtgggtaaaatgggaaacccttttctagggtccagagagaggccaagttggggctctgagctctccaatcatgatatctcttcatacagaacttctcttttttggctgggaatggtggctcacgcctgtaatcccaacactttgggaggtggagatgggcacattgcttgaggagctcaagaccagcctcagtaacatggcaaaaccccatctctacaaaaaatacaaaaattagccaggtgtggtgttgcatgcctgtagtcccagctactagggaggctgaggtaggaggatcgcttgagtccgggaggtggaggctgcaatgaactgagattgcaccactgcactccagtctgggtgacagagtaagatcctgtctcaaaaaacaaaacaaaaaaaaaaacttctctctctctctccctttctctctcaacagactttattttttagggtagttttaggttcacagcaaaattgagcaaaaagtacagagttctcatatactccccaccccactccacccaccccaccatcaacatcccaccccagaggggtgtgtttatcacagtcagtcatgaacctaccttaactcaccatgagcgctcccagtccatacttaccttactgctctcttggtattgtgcattctatgggtctcaacaaaggtatgatgatatatagccaccattatggtatcatacagaatagtttccttgccctaaatgctctctctttacctcttttgtatattgggattccacataagatttcattttgaaaaaagttctatacacgccattgttgaaaccatcattccaaaggtcaacatttccccatctccacttttcatatccgccaggacgctcaatgtttcattcagacattttatctcctcaggccacttcctgacagacttactctaaccgccgtttgtttggtagccccagttgccccttcaccgccaacctctcgcctcctcccaggtggaacccgagacccgggcggtgatccggtggatgcactccttcaactttgttctttcagccaatctccacggaggggcggtggtggccaattacccgtatgacaagtcctttgagcaccgggtccgaggggtccgccgcaccgccagcacccccacgcctgacgacaagctcttccagaaggtatgtggagaagcagcttgtcccgccaggggaacttggggctcaggaggtgagcttaaggtcagtaacacagaacccttttcagtgcgaggccacagaaaataattgaaaataccgcttgtttgtgaggagcttacagtctagtaaatgacatttggttttgaatgataagccatagattcataacaaagtaaatacaaagaaagcttcatagtaattaccacgatgcagaaaatacttaggctaatgatgagcaagaaatatgcccgaagactaatagcacgagtgtcattaaatgtgaatttttgggggggtctaaagtagaattttatgataataaatccatattaatgaaaaatagactgtgatagtattaggtggggccttaaagaaaaaaagaaaaatagactacatgaaaaaggtttaaataacagttcaaaacgatatgttaacattaattttatattaatatataaaatggcataatataataaatttgtaattattggcctggtgcggtggctcacgcctgtaatcccagcactttgggaggccgaggcagacgaattgcctgaggtcaggagtttgagaccagcctgcccaacatggcgaaacactgtctgtactaaaaataaaaaaattagccaggcacggcggtgggtgcctgtaatcccagctacttgggaggctgagacaggagaatcacttgaagctgggaggcggaggttgcagtgagccaagattgtgccactgcactccagcctgggtgacaagagtgaaactccgtctcaaaaaaaaaattatatactaatatattaatatataatatatctatataatttaaataaacattaatgatattaagtattaatcattaatgaactacatggtgaatagcacattgtttttttctccattgatctcactttgtccactgtatagtaaatagtaatgaaggagaattatagagttcgaatatattcctctccctgcaacgcacgactctcaccccctaaatatgcattacttttactggagaagtcttgccttacttactccttgatttctttgacaaaattcggctagaaaatggcacaaaaacaagggaccttcaatatcatctagtgcaactcctcactttgcacaagagaaaactcagccccaagatagtgacaaaatcagaatacagatctcctaactctagtctaccacacatacactctcttagacacacagtcacattcacacacatgcattcacacatacccacctacatatacacacatacacacacacatacacacgctgtttctatccctgatcctattttctttcactaaagcaaataatccactgtttatatacccagcagggcttcttggcttcaacctagttgtgagtgggagcattgccatttgagttgggaatcatcaaggtcgttttcctcctgcttttcctctagctggccaaggtctactcctatgcacatggatggatgttccaaggttggaactgcggagattacttcccagatggcatcaccaatggggcttcctggtattctctcagcaagggtaaggggagtcctgggaactgctcaagctgaagtggaatagtgctcatttctccttctaaattcccagttttctcagggaaacaatgggaatagcatagaattttgcactcaagttgagatctggaaaatgaggaagtctcaggttggcatttagtgatcatattgtgattctttaaaactaaggtggggatggctgggcacagtggctcacgcctgttatcccagcactttgggaggccgaggagggtggatcacgaggtcaggagatcgagaccatcctggctaacacagtgaaaccccgtctctactaaaaatatgaaaaaattagccgggtgtggtggcgggcgcctgtagtcccagctactcgggaggctgagtcaggagaatggcatgaacccgggaggcagagtttgcagtgagccatgatcgcatcactgccctccagcctgggtgacagagtgagactccgtctcgaaaaaacaaaaacaaaaacaaaaaataactaaagtagggacaccttttggtcctgtaaaactggtggtttacacaatagattagggcataggaggaaaataatgtagtcatttgtggtatctgagagtagattgggttgaaactctcatgcccatttactagtcatgtggctctgggatggataattacttattctctctgtgctttggtttcctcatctgtaattaagaataataaggccaggcatggtgactgatgcctataatcccagcaccttgggaggccgagaagggagaatctcttgaggccagttgtttgagaccagcctgggcatcatagcaagacctcatccctaccaaaaaaaaaaaaagaaaaattaggtgggcatggtggtgcacacctgtagtcccagctaatggggaggctgaggtgggaggatcacctgagcccaggaagtcaaggctgcagtgcagtgagccaagattgcaccactgcactccagcctggacaacggagtgagactccaaaaaaaaaaaaaaagaaagaatacttgcctcgtaattttaatatgagtattaaataaaataatacacataaggcatttggaaatgcctggcttataaatggtgtaactgtattttaaaaagtagcacagtagtatgcctcacacaacaacagatgagcagaggagctggcctgggcacaaccagttcccctgagatacattccctggaccctaactgccaggcccccacaagcaggggtttgccatggacattggccattgataatgtaaccttcaagagcagaaacctccacaagagacttctgtctctatcccctgggccttccccatgaccaggggtcaagatagaacctccgtttatgagccttcactggattgaagaatagagaagagtctggagcaagaagctgagttcttttaggaatcattctctagcacctgtctttccccatccttcaaatctgacctggccatggcccaggcagcagattggtgagaactgagttggtggctggtcctgtggagagtagagaggtgcaaaactgaggagttgccatgtactgggagggtagactggggacaaaaactcgcttgaatacaaggcacggctgggcgcagtggctcatacctgtaatctcagcgctttgagaggctgaggtgggaggatggcttaaggtgggagttcgaggctacagtgagctatgatcatgacactgcactccagcctgggcagcagagcgagaccctgtctctgaaaaataaataaataaatacatccgtaattttaaatgtttttttaaagttactttctttagtttgcattaggaaagcaaaatattttttgccctccaaattgaaaataaccaatatactttttcaaattatgcttgttctttttttctctctctcctccctctccctctccatcctctgagagagcaaggcccatgcctccactgagaatcattgccctaaattaagctggtacaattccaaagtcattaaatttatcaaaatggttcttccaacagtgtggtgtcttgattagcatatcagcatgagctgggaacttactagaaatgtacatttctaataagtggtaccccacctcgtacctactgaatcagaaactctgagggtgaagcccagcaagctgtatttagccagaagtttcagccttctaggtgattctaatgcatggagagaaccaatttacttatttattttattcaagcattttttaatttttatggatacatacgaagtgtatatatttatggggtatatgtgatattttaatacaggcatgcaatgtgtaataattacatcagggtaaatgacatgtccatcccctcaagcattcatttctttgtgttaccaacattccaattgtactccctcagttattctaaaagttacagcaaattattgctgatggtagtcacccttttgtgctatcattcattctttctaactattttttgtatctattaaccatccccattctccccacccccaccatccttcccagcctctggtaaccatccttcctctttattttcatgagttcaattatttaaatttttagctcccacaaatgagaaagaacatgcaaagtctgtttttctgtgcctggcttcatccctgtttttgcaaatgacaggatcttattttttttaatgactgaatagtactccattgtgcatatgtgccacattttctttatccattcgtctgttgatgcacacttaggttgcttccaaatcttggctattgtgaatagtgctgcagcaaacaagggagcgcagataactcttcaacatactgatttcctttgttttgggtatatacccagcagtgggattgctgaatcaactagtagttctatttctagttttttgaggaacctccatactatttggagagagccaatttaataggctgtagttattattcttcaactttccccattctttctgtaacagctgcttgcattcatcagcttaaaaagtaagtgataatttttttcatcttcatttatttatttattttgagttggagtctctttctgtcacccaggctggagtgcagtggctccatcttggctcattgcaactctgcctcccggctcaagcgattctcctgcctcggcctcccaagtagctgggactacagggacctgccaccacacctggctaatttttgtatttttagtagggacggggtttcaccatgttggtcaggctgttctcaaactcctgacctcaagtgatccgcccgcctcagcctcccaaagtgctgggattacaggcatgagccaccatgcccagcttcatttttattgtggtaaaatatacataacataaaatttaccattgtaataatttttaagcatatgattccgtattattaagtacatttgtgatgttgtacagtcatcaccagcactcatctccagaactcttttcagcttgtaaaactgaaaccctatacccattaaacaataactctccatttccccttaccccagcccctggcaaccaccattctactttttgtctttatgattttgactgctctaagtacctcatataagtgggatcatgcaatatttgtctttttgtgaatgccttatttcacttaccataatgtcctcaaagttcatccatgttatggcgtttgtcagaatttccttactttttaaggctgaacaatattccattatacgtttataccacattttgtttctcatttatccaccaatggacacttgggttgctttcacattttagcttttgtgaataatggtgctacaaacctgatgtgcaagtatctccttgagaccctgatttctgttcttttggatatataaacccagaagtggaactgttggacataaggtagttctatttttaatttttttgaggaactaccatactgttttccatagaaaacaccacctgtgcacgggagtttcaatttttccacatcctcaccaactctttttttttttttttttttgatagtagccatcctaataagttcaaggtaatatctcacagtagtttgatttgcatttctctaatgattagtgatattgagcatcttttcatgtgcttattggctatttatataccttctttggagaaatgtctattcaagtcctttgcccatttaaaaaatcaagttgtttgggttttgttgttgttgttgttgttattgttatgttttaggagttctctgtgtatgctgaatattaatatcttatcagatatatgtatcacaaatatttttcccattccatggttgcctttttactctgttgacattgtatttgtttgtttgttggtcagtttgattctgtcgtcacctattctgtcctagagatactgtcttttgatgaacaaaatttttccattttcatgaagtctaatctgttattttttttcttttgttgcctgtgtctttgattttatatccaggaaatcattgccaaatccaatgtcatgaagcttttgccctatatattcttctaagagttttatagttttgggtcttacgtttaggttgccaatccatcttgagttaatttttgtatatggtgttaggtaaggctccagcttcattcttttgcatttggatatccagtttctccagcaccatttgttgacatgactgtcctttccccattgaatggtcttggcattcttgtcaaaattgctttgaccatatatgcaagggtttctgggctgtcttcctttccattgatctatatacctgtctttacaccagtaccacattgttttgattactgtagctttgtagtaagcttcaaaatcagaaattgtgagtctctagctttgtttttctagctttgttcttctttttcaagattatttttgctcttctgggttgcttaaaattccatatgaattttaggatgggctttctatttttgcaacaaacatcattgggattttgatagggattgcattgaatctgtagatcactttgggtagtacagacatttttaagtggataatttttaacccaaatgaaattataatgtaaataaccatcctaataatgagaaacatattaaaaagtaattgattcaattgaataatgtggaagatcagaacaagcaagtattttatagaaaaagaagaaaatatagctgtcttctgcttcttcaggagtctgtttttctgggatgggtattttcagattaatattgtgttcttagataggagaagggatgtgaaagcaaaatattaatctcattcctaacctcccaggtctgaagaacattgtagtttaaggagaaaaatctattcttttaaaaacaggtcatgtgcatagtctatagtaaggcacagctaatatgcagactttggaaatgttaaaagggacaagaagtgaaattcagtcatgaaatggaaaaaaaacataaaggatgaagatgacaaaaggggcatttatgaagagaggaaacgaaactgcagagagagaggcatgtgaactgggaacttgggaaaaatgttatggaggaaagaaagaaatagaggtcaagaggtagaatagaagttgatgaagaaaagaaaaaaagaaggtaatgaagggggtgctggatgtttccaacacaaagaaatgataaatgtttgggaggatggatattctaattagcctaattagcctgattagccctcgccagagttcactgtaaagctaacccagcattaaccttttaagttaaagactaagagaatcattatctctttacagtgaaatgccacagctaaataccactgtatgacctgctatcatcaccccaatactcctcacgttatttctcatcacccaactaaaaatactaaacacacactgccatctgcccacctcaccaaaatttattaaaataaaaaactacagtaagccctgagaaccaaaatgaacgaaaatttattcgcttcattcattacccctacagtactaggcctacccgccacagtaccaatcatcctatttccccccttactggtcccaacctccaaatacctcatcaacaaccgactaatcaccactcaacaatgactacttcaactcaccttaaaacaaataataacgatacataacattaagggacgaacctggtcccttatactaatttccctgattatttttattgccacaactaatctcctcggactcttgccccactcatttacaccaatcactatacatgtgtctattgaaacgtcactatgtgtgccccatgaatatgtacatattattatgtgatgtacatgaatatgtacacattatgtgccaatgaaataaataaaattaaaaggtaattcccaaataaataaaaacagaaaattttaaaaagagagagagagagatgagatggggcattgggtgggaacctggttatggaaatctgctgctgccctctttcccttaggaatgcaagactttaattatctccataccaactgctttgagatcacgctggaactgagttgcgacaagtttccccccgaagaggagttacagcgggagtggctgggtaatcgggaagccctaatccagttcctggaacaggtaaaatctcatttgttaactctcatgtttgcaaaaagagaagtgcttctcaatggcaggcaaggtgtttcactggttcaggtctgacttttgctctgactcagtccaatagatctgggcgtcttcttccattgagatttattcattcaacattattgagcagctgaacgcagtggttctcacctgtaatcccggcagtgtgggaagctgagatgggaggatcacttgggctcaggagtttgagaccagcctgggcaacatagctagaccccatgtctactaaaaaaaaaaaaaagatagccaagcatggtggcatgctcctgtagacccagctacacaggaggatgaggtgggaggatcgcttgtcttgtgctgggaggtcaaggctacagtgtgctgtgatcatgccattgcactccagcctgggcagcagagcaagagccttctcaaaaaaaattatcaagcacaactatttgtcagaaactgtactatatgctgtgaattatgaataaataagcaaatatccctgcccatatggaacttaccttctagtgaggaaagacaggcagtaagcaataaattgtataacatgttaaaagagaaatgctatgaagaaagtcttacagaggaggtgacatttaaacaaaaatttcaaggaggtgagggacagaaacatgcagatatctaggggacaaaagggttccttgaaatggacacaactgcaaatacaaaaccaacaaaaagaatatgaaaaatgctcagcaccactaatcattagggaaatgcaaattaaaactacagtgagattccacctcaaattgattaggatggctgctatcaaaaaaacagaacttcacaaatgtttgcaaggatgtggagaaattggaacccttgtgcactattaatgggaatgtaaagtggtacaatcattatgaaaaacagttactggcaattcctcaaataattagaattcctatgtgctccagcaatgccacttttgggtatatattcaaaagaacggaaataagggcctcaaagagatatttgcacatccatatttgtaacagcattatttacaatagccaaaaagtgggagcaacccagtgttcattggtggatgactgtataaacaaatgtggtatatccatacagtggaatattatacagccttaaaaaggaaagaaattgtctctaggtgtggtggctcatgcctgtaatcccagcactttgggaggccgaggcgggcggatcacctgagtttgggagtttgagaccagcctgaccaacatggagaaaccctgtctttactaaaaatacaaaattagctgggtgtggtggcgcatgcctgtaatcccagctacttgagaggctgaggcaggagaatcgcttgaacccgggaagtggaggttatggtgagctgagattgcgccattgcactccagcctgggcaacgagagcgaaactccatctcaaaaaaaggaaggaaattctgacacatgctacaacatggatgaatcttgaggacattatgccaagtgaaattagccatccacaaaaagacaaatactgtattattccacttatattaggtacttagagtagtcaaaattatagagatgaaaagtgttgataaaatggtggttgccaggggctggggggggggataatggagaatcattgtttaatagatatagggtttcagttttttaagataaaaagagttatgcagatgggtggtgatgatggtcgcacaacattacaaatttttttttttttagatggagtctcactctgttgcccaggctggagtgcactggcgtgatctaagcccactgcaacctccgcctcctcagtttaagcgattctcctgtctcggcctcctgagtagctgggattacaggcgcccaccaccacacctggctaatttttgtatttttaatagagacggggtttcaccatgttggccaggctggtctcaaactcctgacctcaggtgatccgcccacctcggcctcccaaagtgctggaattacaggcatgagccactgcacctagctaaatgtatttaataacactgaactgtacacttaaaatggtaaattttattttatgtgtattttactatagtctgtcacagcaaataaaaaaaattaaaaaaaaaaaaaaaaaaagaaagaaagaaaagaaaaccaggacaccagtgtggctggactgatctcagaagtaagggagagaaaaggtggttggagatgggatcagagagctaacaggtagctttacagacagaccatcacaagaactttagcttttgctcaaagtgagttaggttttgagtaggatagtgacatgatttgagtcaggctttaacaggaacgctctgaccactctaattgcgaagagattaattggggcagggagagaggcaaagagaccagttaagggactattaccatcatctttgtgaagataaaatacaaaaacataagagaaagggctttgagactctaaaacactgtacaaatggtacaaatgttttatgatcataactatatacttgttcctgcaggttcaccagggcatcaagggaatggtgcttgatgagaattacaataatctcgccaatgctgtcatttctgtcagtgggattaaccatgatgtcacttcaggtaggtggtcactgcttaggggtaagaaggaagcgttaactcctgcatcttcttcagcataatcaaggggccagtttgtaagctagtgaaaccagcaggggtgtcaaggatgctgggagtgggggggatggaggaaagaagggcaatgaaaatggagacagtaaattaagaggctgaatcaaacaaccaagatgttttaatggaaaatcttttgcttctgatgcaagcaatccctgagaggtcaggaccaggaaagactgatgtaaatgtaacttctcatcagcattcaggagttgctaccacatacaattttgttaggggtattttctgggcttaagcctgttaatagctcacatactggtgtgaaatcgggtagaaagaggactgtgaaacagatagttagccttgtcgctgacttggcatttccctacacctccattgggaaagttagcaagattctttccatcataggcttactgtgggggcaagattgatggtggaggcggatcttagagctacctggaacctcctagaagggtacagaattatctcacagcagaatggtgttgtaagctgactcagcccagcttgatcatgcacaacttgtaggattttttttttgttttattttgcttttaatgcataacagtggctacaaatggttatggttacaggtaggtgagatttgcctaaatccccacctttttttctttttctttttttttttgaaaaggagtctcattccaccatccaggctggagggcaatggtgtgatctcactgcaacctctgcctcctgagctcaagccatcctcctaactcagcctccaatgtagctaggactacaagcatgcaacaccacatctgactaattttttgtgttttttgtagagatggggtttcaccatgttgcccaggctggtttcaagctccttggctcaaaagcctcccaaagtactagggttacaggtgtgagccaccacacccagccctccacacaaccttaatactagcaagtctcacctgaattttactacactaacatttattaccaagcagccatttcacaattcctacaatctgtttaagctggatgaactctcagctttctgtcctttaaagtgatctcagtgcatcttacatgaaaggttcattcaaggcaaaggtaatgtctaaaggcagaatcctgtagcctcacagtgaagtatcagacaaccagagcctattagccaaatgtctggacacaggactgtttaggaatccaaactcaggaaccatcctttttatttgtttcttctttttcctttttttacagaaatgtttctgagtcgtaggaatcatccttatgagcacagccttcttcagggcttgctagattctttctagcaaggtgatggggtctcactatgttgcccaagctggtctcaaactcaagcaattcttctgcctcagcctcccaaatagctggattacagggtctcactctattgcctgggctgcagtgcagtggtgcagtcagggctcactgcagccttgaccttccaggctcaggtgagcctccctcctcagcctcccaagtagctggaactacaagtgcataccaccatgctcagctaatttttttattttttatttttatttttttacagagacagagttttgccctgttgtccaggctggtctcgaactcctgagctcaagtcatctgcctgcctcagcctcccaaagtgctgggattccaggaatgcacacctggcttttgctagattttatgctctatccaagcaagtgtgggaatgtctgtaaaacattccagccaatcaacatatattgctgggcacagtggctcatgcttgtaatctcaacagtttgggaggctcaggtgagaggaacacttgaggtcaggagctcaagaccggcctggccaacatggtgaaacccctgtctctactaaaactacaaaaattagctgggtgtggccaggagcggtggctcacacctgtaatcccagcactttgggaggccgaggtggggggattgcctgagctcaggaattcgcaaccagcctaggcaacatggtgaaaccccatctctactaaaatacaaaaaattagccaggtatagtggcgtgtgcctgtgatcccagctactcaggaggctgaggcaggagaatcgcttgaacccaggaggtggaggttgcagttaggcaagatcatgccactgcactccagcctgggtgacagagtgagactctgtctcaaaaaaaaaaaaaattagctgggtgtggtggtgtggtctgtagtcccagctactcgggaagctgaggcacagaggcatgagaatcatttgaacccgggaggtggaggttgcagtgagccgaaatcacgtcactgcactccagcctgggcagagtgagactctgtttcaaaacaacaataaaaacaaaacatattaaaccccactaatttttccaataagtgccactttcaccagccattgtgttaattaacaaattattaggctgggcacagtagctcatgcctgtaatcccagcgctttgggaggccaaggcgggtggatcacctaaggtcaggagttcaagaccagcctggcctacgtggtaaaaccccgtctctactaaaaatacaaaaaattagccaggcatggtggcaggcacctgtagtcccagatactcaggaggctgaggcaggagaatcgcttgaacccaggaggtggaggttgcagtgagccaggattgagccactgtactccagcctgggcgacagagcaagactccatctcaaaaaaaaaaaaattttttttcatttcatcagggaaaaaacccattgtaaacattcattatattacttagcaaagcatctagtgttgatgagagagaaagctagctgaagccctcatagtagctgcatctggaatgcggcctttctgatacaacactcgctaaccacttcaggattcaagtccccagttaagaaaatgacaacccctggggtgtcatttcaactatccaacacatgtactttgctgaagtattttaaagtaaattacagacatttaatagggggcagaaaaagacttcttcattattgtttgtctcaatgtttattgtatttattatttcaaatattcattgctatatacttaaaatgaattttaaaatcactgtcataattgagtctaaagggatggaaagtcattagccaaaatgcactttccttgttatagaaaaacaggcttcttttgaattttatttttcccttgccatacttttgaagatgataaaagaaatttttttgttttttgaggcagagtctcgctctgtcgcccaggctggagtgcagtggtatgagccactgcaaccagcccaatagaagaaatattaaaaataagattctcactgggcacaatggcatatgcctgtaatcccagcactttgggaggctgagctgggagaattgcttgaggtcaagagttcaagaccatgctggtcaacatagcaagacctccatctctacaaaaaataaaaataataaaatttaccagtcacagtggtgtgtgtctatagtcccagctattcaaaaggctgaggcaggaaaattgcttgagtctgggagttcaaggttgcagtgagctatgatagcaccactgcactctagcctgggcaacagaatgagaccctatctcaaaaaaagagataggactctcaaaatcgtatctttactggtcatgtagtccagccttcccattgaatataagattacacccatataacaccaccggcagctttttgtccaacccagggcctccatgttcagtggtacaggttttgcactgtacatctgcgtggcctttccaggcttctgatctagtctgtgcttgagtgctcacaattgcataaagcagtccattcctttttttgtagctctgtttctctcaacagatttgtttgtttgtttgtttgttctatttgagacagaatcttgctctgtcaccaaggctggagtgcagtggcgcgatctcggctcactgcagcctccacctctcacggtccagcaattaccctgcctcagcctcccaagtagctgagactacaagcatgtgccaccacgcctggctaattttcgtatttttagtagagatgggggtttcaccatgttggccaggctggtctcaaactcctgacctcaggtgatccacccacctgggcctcccaaagtgctgggattacaggcatgagccaccgcacctggcctcagtaggttttatttctgtctagcaaaatctgcctccctgcaacttaaacccatacttctcattcttatttctttagatagacatcatttcttcacagtggcctttcaaatatcaaaactgtggtctcatgtagtttctttattaggcaaaacattcacagacctttcaacctttcctctctcctagtgatcctttactggaggggagtttgtattaaactacagggtctagaattacatttaacatgttcagtgtagagcacagtaaaattcctgcttcgtaggagctgaggccgtactcctattaagatagtccacaaatgatttaaatctttactagtttcatgctattaagaaaagccaggctgggggcagtggctcatgcctgtaatcgcagcactttgggaggctgaggcggaaggatcacttgagcccaggagtttgagaccagcctgggcaacatagtgagaaccggactctgtttatttattttgaaaaagaaaagacggccgggctcggtggctcatgcctgtaatcccagcactttgggaggccaaggctggcaaatcacctgaggccaggagtttgagaccagcctggccaacatggtgaaaccccgtctctactaaaaatataaaaattagctgggtgtggtggtgcacgcctctaatcccagctacttgggaggctgaggcaggagaattgcttgaacccaggaggtaggggttgcagtgagctgagatcataccactgcattccagcctgggcaacagagtgacagagtgagactccatctcaaaaaaaaaaaaaagccaacgggctcagcggctcacgcctgtaatcccagcactgggaggctgaggcgggcagatcacctgaggtcaggggttcgatattagcctggccaacatgatgaaaccccgtctctactaaaaatacaaaaattagctgagcatggtggcatgcacctgtaatcccagctacttgggagactgaggcaggagaattgcttgaacctgagaggcagaggttgcagtgagctgagatcacaccacttcactccagcctgggtgacagagcaagaccccgtctcaaaaaaaaagaaaagccaaccttgtagtcagataaaaaccctagcttatttgggacagatttttaatcagtagactgagttatatctttgtgactttcaggtgaccatggtgattacttccggctgctgcttccaggtatctacactgttagtgccacagcacctgggtatgacccagagacagtaactgtgaccgtgggtcctgcggaaccaacgttggtgagttaggctgagcttgacggtgcactgtagagatcacttatacagtctttttttggaggacagtgtcctgctctgtcacccaggctggagtgcagtggcaccactgtggctcactgcagcctcgatctcctgggccgaagcaatcctgccgcctaagcctcccgagtagctgggagtgagtataagcacacaccaccatgcccgcctaatttttctttttttagaaaaaggatttcgtcatgttacccaggctggtcttgaactcctgggctcaagtgatctgcctgcctcagcctcccaaagtgctgagattacaggcatgagccaccacccttggcccttgcaaaatcttaagtgattgcacagctctaatctttgcccagcttctttcttttactgttttttaaagaattaattgctcgcacatcctaatttttgttctgtcactctcctgttatatccttcctcacttccttttggcttttcctcttctgtctaacatagcatagtgatttaaagcactgtctagttctaaattcagctcatttgcccacagaccttggacaaattacctaatctctcttattctcagtaaattggtaataatagtgcctccttcaccagaggctgaaatgagaacatgcacataaagcctttagtatgcaggggccaaatcaactctcaaaaggcagattaattggagaaaagccataccaatttatttttattttattttattattataattattattgttattttgagagggggtttcgctcttgttgcccaggctggagtgcaatggcatgatctcggctcaccgcaacacccgcctcccaggtttaagtgattctcctgcctcagcctcttgagtagctgggattacaggcatgtgccaccatacctggctaatttttggtgggtttttttagtagaaatggggtttttccatgttggtcaggctggtctcgaacttctgacctcaggtgatctgcccacctcggcctcccaaagtgctgggattacaggcatgagccaccatgcccggcctgttttttctttttttgttttgtgtgagcataccaatttatttaacgtgtatacacaggagccttcagaatgaaggcccaaagataccggggaaattgtccacttttatgtgtaggttcaacaaagtaggtacagctaggtaataaatgcaactggacaaaaaaagtatcagctaatgctatgcactgagtgaagaaatctagcaaggcctatctttccagattcttctgggctctctgaccatgaatttcttccttctgtgtgtgggtcagtaccctctctggaaagagggactcatgacctatagtcaaacaaggtagggtcttatgacctacagtcaaacaagggaggtcagatatgtcctcctcctcctctctttcttctcctcctccttctccttgacctacagtcaaacaagataggtcagatatctcctcctcttccttgtcctcctcctcttcctcctcttcttctttcatagagacagggagtgtctctgtccctcaggctgtgcactggcgtgattatggctcactgcagcctcagactcaagagatcttctgcttcatctttccaagtagctgggactacaggcacatgccgccatgtccagctaattttttttttttttcgacagagtctcgctctgccacccaggctggagtgcagtggctcaatctcggctcactccaaccactgtcttttgggttcaagcaattctcctgcctcagcctcccaagtagctgggattacaggcatgtgccaccatcttcagctattttttgtatttttagtagagacaggggtttgccatgttggccaggctgatcttgaactcctgacctcaggtgatctgcccacctcggcctcccaaagtgctaggattacagacgtgagccaccgcacccggccatttttatttttattttttgagactggagtcttgctctgttgccctggctggagtgaatggcacattctcggctcactgcaacctccgcctcccgggttcaagtgattctcctgcctcaacctcccaagtagctgggactacaggcatgtgccaccacgcccagctaatttttgcatttttagtagagacgggttttcaccatgttggccaggctggtcttgaactcctgacctcaggtgatccaccctcctcggcctcccaaagtgctgagattacaggcgtgagccactgcacccggcctaatttttgttattttttgtagagacgggttctctgtgtagcccaggctggagggcagtggtacagtcatggctcactgcagccttgaactcctgagttcaagagatcctcacaccttggccttccaaagcactgggattacaggcgtgagccactgtgctccctccgcctagactgtgatcggcctaaatctgatggtttctttaagaccagtttttacagagaaggcagcgggcttgcattcttctgtgccactggcaaggactgccaccagagggcgctctaccatcccttctggtgctccctgggccctgatcttgctttccactcatgccgcaaaaagccagctactcttcaagattaaactctccagggctttcttttatagataggatgagaagcaaagaacttctttgattttacagcctggatcttttcagttttggttgtattaagatctcagagctaacagagctcagagatcgtagacactaatcctcagatttctcaaatgaggacaaaataatgaggcagtcctatttaacagacatctacagatctcatttcctaaaagtcagcctttcctagggccgcctcactcctgtacacaacccttagtagaccctcccaccacctttccctattaacacaatgcagtccagtcaagcttgtcttttactatttattgaataagtactatgtatgacatgatatgagagctttccagcattatctcatttaaccttcacaacaaccctgtgaggtagatgcaagtatccccatttgtggcttagagaagataaaaaaaacttgtgtaatatcacatagcaagtggtgggagtcaggattcgaacctatatcaggctctctggctcccttcttagccaatgtgttacagaactcatactaagtgtacaacctgtgtttgtagctccttattgtaacacaaggatcaggagaaagaactatgctttaagtcctttgagaatttccagatagtttcttcctccatcccctcccctagtcccatctcctaaataatgtaaattacttctgcttacagttgcaggaaacagagagtaaatctttcattgcagcctatgagctgatctggggtcctctttcccttttttcttgttatatcctaaaattgaatgactgttaagcagctacatatataagttttgcattaccagcaagtctgttcaacgccaaattcaaacaactgcacgtcctcttgagtaacacactcaatttcaaaggattttgccccccttttcacatattctttaaataaattaacataacccatcattatgtcaaatatactcagaggagaaaagatgtctgtcatttggatacaatttccagacacagtaacaactaaaaacccatttattgatcacaaaggagtctatctcccttcccagtctaaagcagatatccatctgtctgggaaagaaaaaaggaaaaaaatattgcccaggtgtggtggttcacacctgtaatcccagcacttcaggaggctgaggcaggcggatcacttgaggtcaggaattcgagaccagcctggccaacatggcgaagccctgtctctactcaaaatacaaaaattagccaagtgtggtagctcatgcctgtaatcccagctacttgggaggctgaggcaagagaattgcttgaacccagggggcggaggttgcagtgagccgagattgtgccgctgcactccagcctgggtgacagagcaagactccatctcaaaaaaaaaaaaaaagattgtttactacagagtttccagctttaaaatgtctcagctgggtgcggtgactcatacctgtaatctcagcactttggaaggctgaggctggcagatcacttgagcccaggggtttgagaccagcctgggcaacatggcgaaatcatatctctacaaaacagttcaaaaattagccgggcatggtgtcatgcacatgtagtgccagctacttgggaggctgaggtgggaggatcacttgaacccaggagatggagcctgcagtgaaccgtgattgcaccactgcactccagcctggatgacagagtaagaccttatctcaaaataaaaataaaatgaaataaaatatcttccggagcccagtgttttctttgcttttccccaaggccttccacatgtcaccactcctttccttttcctctgtccttgcctcattttcttgtctctcttctctctcatttttttctgtctagattcctatgttactaaataggaattggtaaataatacagcacagttggctctgattctccccttccctcctggaggaactagcagaaaaactggctatcaatttttgcggaaggggcaggaaataaccctacagagaggcctcttagtcagtgacatgttttttaactcccagctggcttcaggggctcaagctgttccaagggtgggaaagcccaggcctgccccagaggagtgtggttaggacactgtgccactccctctccttcctcttcagcctgggatagttctacggctcttccacacccagaatgtcccacatttgtcagtgaaaagtatctttccatctgcgtgctgtggccagaagagaggttgcaatgtagtgcttgaaaggatgcattaacacacatggaaatttccagtttaagaatccaagcaggatgtggtggcatgtgcctgtaatcccagctactcaggaggctgagaggctgaggcagggggatcttgaacccaggagtttgagtccagcctggacaacataacaagaccccatctctaaaattaaaaaaaaaaaaaaaagtaaaataaatccccaagtccataccaacactctttatcatctctactatctttgaagtcaaacaagtaggcagaaggtttagttctgaagcatggtgacacttactggcatgcctgagcatggcacctgtgagtcacccaggcagcataaagaagattgttacagcaccgtcaatcatggctcttgtcctaagtggcagtattggtgaaatcatatttgatgtgtagatatatttttctttcttttctttactttttttttttctttttgagatggaatctcactctgtcacccaggctggagtgcagtggcgtgatcttggctctctgtaacctctgcctgctgagttcaagcaattctcctgcctcagcctcccgagtagctggaactataggcatgtgccaccagcccagctaatttttgtattttcagtagagacggggtttcaccatgttggccaggctggtctctaactcctgatctcaagtgatctgcccgcctcagcctcctaaagtgcaaggattacagccaccatgcccaacctaatttttttcttttttttttttttttttgagatggagtctcgctgtcacccaggctggagtgcagtggcaagatctcagctcactgcagcctccacctcctgggttcaagcaattctaccgcctcagcctcctgagtagctgggactataggtgtgcaccaccacacctggctaatttctttgtatttttagtagagacagggtttcaccatattgcccggtgtggtcttgaactcctgacctcaggtgatccaccacctcagcctcccaaagtgctgggattacagccatgagccaccacacccagcccatctttttctaatacatgtaaaatcaatgtatattaagttcatccagtcacactctatctatcaccaatgattgcataccaattttgggggaacgttagccaagtctatatgacaccaccagtgcttctctgggtcactgctataataattttccctagtacccagccctcagaaactggaactatggcaaaagatggtccaaacggatctcgtagctcctgctttttttcttccaggttaacttccacctcaaaagaagcatccctcaagtaagccctgtgaggagagctcccagcagaaggcacggagtcagagccaaagtgcagccccaagccagaaagaaagaaatggagatgaggcagctgcagagaggccctgcctgaaacccacagtgccaggcaacccttcagaaaggctttgctcctgctctcagatcagatcaagcattctttctattttattatctgggacatatttaaatacaaacatattcagaacaattcagaatggtctccatctgttccaggggtaagccatctctaggtcatcatgaaaaaaattaggatctattgaaaggtgatgtggtggccgggtgtggtggctcacatctgtaatcctagcactttgggaggccgaggcaggtggatcacctaagttcaagagttcggaaccagcctggccaacatggtgaaaccctgtctctactaaaaatacaaaaaattagctggtcatggtggcatgcacctgtaatcccggctactcaggaggctaaggcaggagaatcacttgaacctgtggggtagaggttgcagtgagctgagatcgcaccacttcactccagcctgggcaaaaaagtgaaactctgtctcaaaaaaaagaaagaaagaaagaaaagaaagctgatgtggtagtacatacatctagtggtgtttggtaaggtttttctattctgagagtctggtttaggctccatgccagtccacactgcatccagagactggttctggctggttggcagctgcacctccagaatctagcacagagtttgcagaagagttagtgctcagtgaagatttctgaaccatgtctgaaatgctgaagtaagtgatccatcattgatgttgttcccatagcaaaattaggtgaccagttcttctgaaatcccagaggatcatttcagcaatagccaatagcatcttaataagcaaagaatttgacatgcaaatacctagtgccatggctacccttctttgtacatggacatttaataaatatgcatctttcaaaacatttgctggatatggaaatatgtgcagctgcccctaaggcatggctgcatcctggctctgtccccagcacgacatagcactctccacctctttgagttccccaggaagaacccatttgcactaaaaacattattgagcaaagtagatgttactaaagattttgaagggatgtgtagtctttcatcacctaccttgcagcactcaagtttacaaaccctcattgggcatgtgggggttcctgagtcccctgtgggaagtggttttttgccatacaccttgtttcagagctcagcctcagttagacagggcaggctccagtttcctcatctacccctctccccacagcacctctaattaaccagcccttttcttaccactgagaaattgaactctactaaataattacagccttgtgccacataatgacgttttggttaacagtggaccgtgtgtataatggtggtctcataagattataataccatggttttactatacttttctatatttagatatgtttagatttaggttagatatgtttagatttagaatacgtaacacaggctgagcacggtagctcatgcctgtaatcccagcactttgggaggccgagttgggtggatcacctgaggtcaggagttcgagaccagcctggccaacatggtgaaccccatctctactaaaaatacaaaaaattagctgggtgtggtggcaggcacctgtaatcctagctacttgggaggctgaggcaggagaattgcttgaacccaggaggtggaggttgcggtgagccgagattgcaccactgcactccagcctgggtgacagagtgagactccatctgaaaaaaaaaaaaaaaagaatatgtaacacaattaccactgtgttacaattgcctgcagcattcagtatagtaacatgctgtccagatttgtagcctaggagcaataggctgtacctttcagcctatgtgtgtaggaggctataccacctaggtttgtacaagtacatgctataatgtttctgcaatgattaaatcacctagggatacatttctcagaatgtacccacattgttaagtgacatggtatggtgatcccttggcacccagttggttccagcaccctctcagataccaaaatccaagagtgctccagttccttttataaaatggcatagtatttgcatttagcctaggtatatcct

SEQ ID NO: 14903 - DNA, 11847 bp, Human
tggtcattgtgaatgacctttttattgtattgttgaatttggtttgctagtgttttgttgaagatttttgcattagtgttcatcaggtgtattggcctgtagtttttttttttttttttttttttgatgtgtcttagtctgattttggtatcagggtaatactggcctcatagaatgagtttggaagtattctcttctcctttattttttggaatagtttgagtagggtcggtattagttcttctttaaatgtttggtaaaattcagcagtgaagctagccagtcttgggattttctctactgggatgattttatttctcgtttgatctttgtgctggttattgcatgttcagattttggatttcttcctggttcaatcttgatgggtcatatttgtgtagggatttgtccatttcttctagattttccaatttattggcatatagttgctcatagtaaccaataattattctttgaatttctgcagtatcagttctaatgcctcctttttaattttttatttatctgaatctactctttttttttttcttagtctggctaacggtttgtcaattttgtttaacttctcaaaaaagcaactttttgtttcattgatcttttgttttgttttcttcacttaaattttatttatttctgctctgatctttattattccttttcttctactaattttggttttaatttgcttttgcttttctaattctttaggatgcatcattaaattgtttgtttgtcaattttctccatttttgatataagctcttgtagctataaacttccctcttagtactggtcttgctgtaacccctaggttttggtatgttgtgtttccattatcatttgtttcaagaaatttttcaattttctttttaatctcttcatgggtccactgttcatttatgagcatatttttaaatttccatttatttgtgtagtttccaaaattcctcttgttattggttgctggttttattacattgtggtcagagaagatgcttgatattatttcagtttctttgaatattttaagacttgttttgtgacctaacatacggtcaattcttgataacaatccatgtgctgtggaaaagaatgtgtattctgtagcagttggataaaatatcctgcaaatatctatgagatccatttgatctatagtgcagatgaatttcaatgtttccttgttgattttctatctggatgacctgtccaatgctgaaagtggggtgttgaagtctccaggtattattatattggggcctatctctctctagttctaattatatgtcttttatatatctgggtgctgcattattggttgcatatatatttaaacttgttccatcttcttgccaagctgaccactttatcaccaatagtgatcttctttgtgtctccttatggtttttgttttgaaatctactttgtctgttttaaatatagtaactcatgctctttttttcatttccattggcaggtactgtctcattcaattcctttattttcagcctatgtgtgtctttataagtgaagtgtgtttcttttaggcaacagattaataggtcttgtttttccatccaggtcagtaacaggtcagtatgtcttttgattggagattttattccatttacattcagtgttattattgataagtaaggacttacccatgcccctttgttatttgttttctggttgttttgtggacttctcttccttctttcatttcttcctgtcttcctttattgaagagaattttctccacttatatgtgtacagatttttcttaatatctggtttatggcagttacacatttgtgcatctgtaaccatcctctctttaagtttgcatatacttccagcactataatttaaatttataatgatgtttggataccttcatgattcatatacccctgaattgctacaacaaatgtgccatttttctccttttccatcagtttttacttgtgtcttatcagctaaagtccaggaagagattgaacgtgtgattggcagaaaccggagcccctgcatgcaagacaggagccacatgccctacacagatgctgtggtgcacgaggtccagagatacattgaccttctccccaccagcctgccccatgcagtgacctgtgacattaaattcagaaactatctcattcccaaggtaagtttgtttctcctacactgcaactccatgttttcgaagtccccaaattcatagtatcatttttaaacctctaccatcaccgggtgagagaagtgcataactcatatgtatggcagtttaactggactttctcttgtttccagtttggggctataaaggtttgtaacaggtcctagtgtctggcagtgtgtgttctccagatttattatctttcttcaagattggtttggctactcttaggtgcttatatttccaaataatttttaaaggtattagtttgtcaatttcccaaaaccttgggctggaatttctggcagggtgacactaaatttataggctagtttggaaagaactgaatcttgacacgttgaggctttccattcctgaatataattatgcttccaatttgtttggggtttcttttatttaaccaggaatgttgtgaatttgttgtcatggctttcgagtctttggttttccctagataattaatatttttgttgtagaacataaatagtttttatcattctgatgatgttaatctgtcaactttgctaaatttactagtcactattcgtaatttatttctggattcattgtaatttctgtgtatattatactgtatctgagttaatattgttttatttcttattttccatttctcatgggcttaatgtctctttatcgcattcattattgcattagctagaatttctaggagagcattgaatagaattggtgacagtggggatccttgtttctcatttctaatctgcaggaagcagtggaagttttccatttcaatattgagaatgatgcttgaagtagattttggtagatattttttatcagattagagaagtttgctgtcatatatatatatgtcataattgtgtgtaaaatcttgtcaaatcaacactctgcatctatttatataattgtgtgttagtccatttccattgctataaaggaatatctttgactgggtaatttataaataaaagagtttcattttggctcatggctctgcaggctgtgcaagaggcataatgtgggcaggcatctactcctagtaaggacttcaggtagctttcaatcttcggagaaggtgaaggggaagcaagcatgtcacatggcaagagagggagtaagagaaaaaggagtagaagtgactttaaacaaccagctagtgtgtgaactaacagaatatgaactcacttattatcatgggaagaggtttaagccactcatgaagaattcacccccatgtcctaaatacttctcacaccagaacccacctccaacattgagaatcacatttcaacatgagatttggaggggacaaatatccacacaacatcagattatatatattgggcttacatttctcactaaatagaaataagtatgcacatagagatgaactggccttcttcatattgtttaggacttcagtgtttacattcacaagagatttggtttatagttttatttctcagaattttcaagatttttgatattaagattatgccagccttataaaactatgcaagaaatgtttcctaatgtgagactgtttttattgccgttccctctccccacttttcttcttgtgatcacttagttgtatctttgaaatgcctgataacttttggttaaataccagatggtatatgtaagaaattgcagaattgcagaggaggtttatattcttcaaagaaagattcattcctctcccatcggcagtcataatgacatgatacctgttgtcatgattcagaattggacataatgtgaatccagttgaaaattgagtgtcagtgttagcttagctctctgaggttctcctacctttggaagcttgagaccaatttttgtcttgacagctttgcagtgccttctatcacatggtttctgtatttatccagacactccatttgccatctcaaacctactcttttccaatcaaaaccaatatatattattagtaaaataaaaaataatataactgaaagttgtattttcaaggggaaaaagcaatgagacttggtaaggttgcaattactaatgtcatcttttgaagaagacagaattgataatttacttagagattatggggcttaccctagtggtcactgagttagtacaagagaaaagacttcaatgcactctgttttcacaaacacaggagataaccaggagactttcgcttctcaaaattagggtctgagggtaatggtaatgaaacttacttcttctcctataactaattaaatgagaaatatactgaagaatcaggcacgagttgccagtctccccagttcactgcatcagctttggtgacctcctggaggggaacgctgcatctgatgagctcatgctgtgcctgatgtcttttgagccctgagaagccagagcccaaggggattacccattgaatcccttcttcgtggaatagcccagtgcagaaaaaagcagcactgtgtggccaattctaccctctttacaaatcagatacatgtgttcttctgctacaggctggatccacttatctagctggagatgatagtctgagacaggagttggcaaactgtctctgtaatgggccagatagtaaatattttagacttttcaggcaatgtggtttctgttgcaattcttgacatctgctattgtagcatgatagcagtcacaaacaatctgcaaatgaatgaggattgatatgttccaatttttatagaaacaaatgtaaatttcctataaaatgtttgtttcaaaaatattgtttcttgtttgcatttgttcaatgtaagtacttttagctcacatactatacaaaaacaggtggcagggtggacttgtgcagggagtattttttattgatgcctaatataagacatccctgtccagtagaattttctgcaaagatgtgcgattgatttgtgcttttatgtcatatttaaagaatatttgtcagcacaagattccaaagactggctttcaactttcccagaatttttttgttttagctcttatatctagatcaatgacatatttcaaattaatttttatttcataatatgaagtaatagtggtcatgcttcaatgtctataaatttctacttattcaagtaacatttgttgaaataaatctgctttggtatcaataacattttaatatagtacttgtttataaatattcaagggaatatttttaaaaaacaaaattatagactatttatatgaaaatttagggggtagaatttttcctaacatttttattataaaattttttaaaataaataacattacacacacatatgtatatgtacatatggcagtgtgtatacatatctactctgatatctgtccatccatctatttacacctcaatacttcagtatgtatagcacaataacaatggttttctcctacataataatagcattcatactgtggagttattaatacaataatattatttactatacagcttttatttaaaatttcccaactttaaaataatattttaatcacttttttcttgcaattcactctccagtcaagaaataagcacatagtttcagtatcctgttactttccatctcctgtaatcaagaagagtccatttcctctgtttcctttcagtatgttgatctctgtgaagagttgagcaattagtcatttaaattttcctggggctcgttttgggtaattgttttctaaatattatattccagttatgactttggcaagaaaactacatagtattttgaatattctgctgaatcacagtggtgaggcaggggcacataatgtcacatatgccattattggttatgctaagatcctcacctaataagttggaatctgccagatctttccattgaaggggttctgctttttatgcgtgaatgatgaaaatctatggcatggtacttcaaggcagaacaccctgtttcccaagtcacacatccaatagttttatctttcattaatgatcctcatctgacctgatgatcttgacctgaatggttacaaataggtgatttttctaatttcatcattccttccgtatttttaagctaggattaatctgtaatgaatatctctcccatatctttaaatgaagacaaacaaactgcatggcaatgacaagaactcaatagttttatccttgccactacacttgttaccatcccagaagatgtcatttgaaattcaatcatatgtttattcacaaatgccctgtgaacagatactgtggccatttcccatgtcaacagagacttcaacttttagttatactctacacataaggttggtgaaaactgaagtgatggaatagagaagcaagtgtggacagccactagtttccaagcttgatgaaaaggaggacagattcagaaggttgcatccaagtatccaagtactcaggacttcaaatgtgattgcagggcactttagcaagattattgtcatgggccttaagttcatgactcttattacttggtctatccatctggaaatggtactgcccttctttggaacgggatttcctcatctgcacatcaaaagatttaactacatgattaccactgtttcttcaaccttcatggcttctttacagctcagttcatctatgtctcttgtttctagggcacaaccatattaatttccctgacttctgtgctacatgacaacaaagaatttcccaacccagagatgtttgaccctcatcactttctggatgaaggtggcaattttaagaaaagtaaatacttcatgcctttctcagcaggtaatataaatttatttccatttgtgtttcagggtacaagataacttttttgatccattggaacttacatgtgcctcctctgcagtggtacaattactctttgtacatgatcaagagcactgttctgaatgcctgtgtacaccctgctcatgatacatcctaattattgggccagattagtggactttggggagttaatccaattcttccaaattgagaaagctgaaatataggttggttgaattctgcctctaggtacaccagtgaggtacccaagaactcctcctggaagataaaactaattacattttcctcactagccatgaggaagttatctcactccagaacttcactgagtgtcttccacatggtgtccctcaccccctaggctgggcttgtaggataaaattatccacaaacacagaatagggtcttaaaaggctcacttctgagtttggaaagcagagtaaacagatcattgtagttcaataggactgaggctgtgatatggaaagaacaggctgttgggggttgggaggtagacggaaaagctgtctgcttcttgtactcttataccccaaagtgaggcataagtaatattttaatagcagtaaagacatttgagctacctcaaaggaggcagagaggatgaaaagaagagaagacagggctattaaaggagataatgagccacaggagcaggacattggctctaaataaaggatattagaacctttgccaaatgaccatggatgggatgagggggacattgggaatgtagcaggatactctgcagtgatgcagagcaccatgctgttcccctagtcatggccatgtatattggatgttggatctccatacttgaaatgtgtgtgctgagcatctggtgatagaatctccttcctttattctatgacctttaatgtctgctttatatctgccactgtagataccaagacaacaagaaaagaaaccttccttcaagcattcacatttagcacatgtattagtccactcttacattgccttaaagaactacctgagattgggtaatttatgaagaaaagaggtttaattcactcacagatccacaggctgtacaggaagcatggctgggagacctcaagaaacttgcaatcatggtgggaggcagagcggaagcaagcacatctttccatggcagagcagaagagagagaacaatgaggaaaggctacatacctttaaacaaccagatctcatgagaactcactcactatcatgagaacagaaagggggaaattatcccccatgattcaatcacctctcaccaggtatctcccccaacattgggaattacagtttgacatgagatttgagtaaggacacagagcccaaccatatcgcacactaataaataaataaataaatcagtaattattattctaggtgatccatgctgtctgtttcttctgccataacaaaatatccaagactaggcaattgataaataatggaaatttatttctcacagttctgaaggctgggagttccaagatcgatgtgtcagcaagttcagtgtctgatgtgggcctgttccttacagataatgccccctctgtatccttatatggcagaagggcaaaaaggcaaaaggggagaaatggctcccttgcatctcttgatgttattattttagcaaggacagagccctcctgacttattcacttcctaaaaggagccatctctttagtaatgttgcattgggattatgtgtcaacatatgaaattgggggaggcatattcagaccatagcacatttttcaatggaaatataatgttgaggaaacccagagaaggcaacattttcttgctcaaggagatgagaaagagggtaaaaaaggagataaaatttgacctatgtcctgactgtggtaatagaaaagttcatcttggctaaaaggagcagcatgatataaaatttgaaacctcatggtgtgttggagactgatgatgagtggctatgcctagagttgacagtatcggatttgaagagtgtaaggagtgatgtggatcatcagactggaaacagaatgtgagggtccagatcaatccattgggaccttatcctataggacatacagggaagccatttaaagttttaaagtgagaaggtgacatgtttagacatgtgctcctgaaagtacctagaggaaaaaaatctttggctgcatattgagccagaaatacaaagggaaatacagtatgttagcctcctcctctaagcccttctcagttcaacccactggacaagaaatgtatgtttctaaagaaagattgatgaagacatttaaagtctcttgaaagattttaataaagtgcttggcatgtagctggtactcaacaaatatttgttgaatacagggtgcctgttaagatctgatattaggtgaagagtaagtatgtccattcatttttcagttgcctatacatccatccattcatccatttatccatccactcatccatccattcattcatgcatgcacccatccacccatctatctcttcatctcttctacgattcactgaacagttattgcatattctgtttgtgccagttacagagacagtgtttgtcactgtcacagttacgcatgaggagtaactgctctctgtgtttgctattttcaggaaaacggatttgtgtgggagaagccctggccggcatggagctgtttttattcctgacctccattttacagaactttaacctgaaatctctggttgacccaaagaaccttgacaccactccagttgtcaatggatttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcttttctgcatgttctaaataaaaagcattattatttgctgagtcagtttattagaccttccttcttttatgcataatgtaggtcagaaattaaagaaaatagagttccaggaggccatgctggttctcaaaatgataaggacagaaaggacaaagaggaagagggtagggaagctattttgggtgagtgttagagttacttgaggattggatttgaaagtgagaaactgtgtccaggggcagctctaacctctagggaaatattcagaggatcagtcaaagggtggaatggacattaaatgctagaattcttatatccacattggtgttcctttttttttgagacaaagtcttgctctgtcacccaggctggagtgcagtggtgtgatctcagctctctataacctccgcctcccaggttcaagtgattctcctgcctcagcctcctgagtagctgggattacaggtgcatgccaccacacctggctaattttttgtatttttagtacagacgggttttcaccgtgttagccaggatggtcttaatctcctgaccttgtgatctgcctgcctcagcctcccaaagtgctgggattacaggtgtgagccactgcgcctggcctggtgttactttgaagtgtcattactttatctctaaataaagaatcagattacttttattacttcatgtttccaacttagaatgatgtaatgaagtataaatacatgctttcatatcgctgctcatgtgttctgtcatgtttctctcttcaaacataaacaaaatttctttttggtttttgtttgtttgtttgtttgttttgagatgtagtctcgcttttgttgcccaggctggagtacaatggcatgatcttggctcactgcaatctccacctccagggttcaagtgattctcctgcttcagcctcccaagtagctgggattacaggtgccaacccccataccaggctaatttttgtatttttagtagagacagcatttcaccatgctggccagactagtcttgaactcctgacctcaagtgatccacccatctcggactcccaaagtgctgggattacaggcatgagctaccatgcttggctgggcaaaatttctaagaagaattacaaagatttaatctctctcagcttctcctacattattttacttttaacataagtgggatgataattttatgctatggtcctaaatataattagcctcatgtcatctccaaagaatagacaactaagtatcttatgttaaattatattcaccacttttcctgtcttctacttgaaatgtaagaaataagaagtaacataatttgttatgcttctcacagctcatctcccagaagaagttacttacattttggaatacgttttaaagataatatgtggatacaggtgtacatgaacatctatatatgtctgtgtacattatgtgtatttacccattttatatatatgcatatatatatatatatacacacacatatatgtaacttatgcacacatacatatagggttaaatgtttattacaatattgggctcatatcacacatcttgtattaaaacttgttattttcctatcaagtaatatggcagcaaaacctctaaggtgatagaaacatagggaaatgattgagagagataatagaagagaaagtggaa

SEQ ID NO: 14904 - DNA, 5405 bp, Human
  misc_feature (1)...(5405): n = A,T,C or G
gcactccagcctgggcaacaagagtgaaactccatctcaaaaaaaaaaaaagaaagaaagaaagaaaagaaatgttaaagagagttcttaggccaggcgcggtcgttcacgtctgtaatcccagcactttgggaggccaaggtggatcacttgagcccaggagtttgagaccagcctgggcaatatagtgagaccttgtctctacaggaaaaagaaaagaattagccaggcatggtggtgcacacctgtagtcccagctccttgggaggctggggtgggaggactgcttgagcccaagaggtagaggctgcagtgagctgtgatcatgccactatgctctagcctgggtgacaaagcaagagcttgtctcaaaaaaaaaaaaaaaaaaagttctttaagcaagaggaatatgatatcacagaatctggtattatacacaaagcaaagaaatctacacacaaaaaatgaagatttctggaaatgactaaaattaaatataaaaacttttttacttttatttttgatctctataaaaattattgactttcaaaaagaaatatagtggaatgtattatgggtttattgcacatttataaataaaaacaatcatagaaaagattaaagagaagaacttaaagtgtactgttactaggttcttcttttttttgagacgaagtttcgctcttgttgcccaggctgaagtgtaatagggcaatctcagctcactgcaacctccgctacccaggttcaagcgattctcctgcctcagcctcccgagtagctgggattacaagtgcctgccaccatgcctggctaaatttttgtatttttagtagagatggggtttcaccacgttggccaggctggtctcaaactctcgacctcaggtgattgcccgccttggcctcccaaagcgctgggattacaggcatgagccactgcgcccagccaatagtactttttttttttaattaaaattttttaaaaaagaaaataagtaaatagtgtcctatcatatattaaagaggnnnnnnnnnnnnnnnnnnnngccccggcgcgccgccgcggccgccccgagcggcgaaggcccgcccgcgcgccccccggccccgcgtccggccggccggcgcggaaggttcggcccggcccccaggcccgagcgcgagagggcaatcccggcgcacggcacccccggcgccccaggctcaagcgattctccggccccagcctcccgagcagctgggatgacaagggcgggccaccacgcctggctaaagagaagtatttttagtagagatggggtttcaccacgtcgcccccccaagtctcaaactctcgacaaaaaaaaattgcccgccttggcctcccaaagcgctgggattacaggcatgagccactgcgcccagccaatagtctttttttttttaattaaaattttttaaaaaagaaaataagtaaatagtgtcctatcatatattaaagaggcatcaatattgttcgtagaattaattagcagatatgaaaaagttcttaaatgttacaattttaaaaatattgtgcacccataaaatatagctgtttacactccttaaaaaaagaacctggtatacgggccgggcgcaatggctcacgcctgtaatcccaccactttgggaggccgaggcgggcggatcacgaggtcaggaaatcgagaccatcctggctaacacggcgaaacactgtctctactaaaaatacaaaaaattagctgggtgtggtagtagacgcctctagtcctagctactttggaggctgaggcaggagaatcgcttgaacccaggaggcagaggttgcagtgagccgagatcctgccattgcactccagcctgggcgacagagcaagactccatataaaaaaaaaaaaacaaaaaaaaaaaccctgatatacaaggagatagcccttgatccaaaaccaagagaaaagacagacaatagaaagaaagaaaaacaacaacaacaacaaagcaccagtgcggtggtgggagaggtaccggcaggagcagcgctgcagccggggtctggggttgacccgtctgacttcccgtccgtgccaagcccactcaagccgcagccatgtctggggacgagatgatttttgatcctactgtgagcaaaaagaaaaagaagaaaaagaagccttttatgttagatgaggaagcggatacccaaacagagataacccagccttcagaaacaaaagaagtggggccagagccaactgaggacaaagatttggaagctgatgaagaggacactaggaaaaaagatgctgctggtgatctagatgacttgaacttctttaatcaaaagaaaaagaaaaaaaaaactaaaaagatatttgatattgatgaagctgaagaaggtgtaaaggatcttaagattgaaagtgatgttcaagaaccaactgaaccagagaatgaccttgacattatgcttggcaataaaaagaagaagaagaaggtcaagttcccagatgaggatgaaatactagagaaagatgaagttctagaagaggaagacagcaaaaaagatgatggtatctcattcagtaatcagacaggccctgcttgggcaggctcagaaagagactacacatatgaggagctactgaatcgagtgttcaacatcatgagggaaaagaatccaggtatggttgctggggacataaggaaatttgtcatgaaacctccacaggtcgtccgagtaggaaccaagaaaacgtcttttgtcaactttacacatatctgtaaactattacatcatcagcccaaacatctccgtgcatttttgttggctgaattgggtacaagtggttctatagatggtaataaccaacttgtaatcaaaggaagattccaacagaaacagatagaaaatgtcttgagaagatatatcaaggaatatgtcacttgtcacacgtgccgattactggacacaatcctgcagaaggacatgcgaatctatttcctacagtgcgaaacttgtcattctagatgttctgttgccagcatcaaaaccagctaccaggctgtaatgggcaagtgagcacaccaccgtgccaaagctaactaatttgctaatcactgattttgcaaagcgtgttgtggagatgtggctggacaggtttgccatcagagtggatataccgttgtattaaaaacaagataaaaaacctgccaagatttttggcgagtggttgattggtctgaagtccttacaagacgctgatgctcaagctgttgacatactcattgcctactttaacacctgtcagagaaacatgatatgaggtaaggaggtgctttttaaaaattgttcatagatttctgtaaaatgcaagataaattaaagttattataactgtgaaaaaaaaaagcaccatacagctaatggagttgcaaaacaagattttgagacagggtcttgctctgtatctaggctggagtgcagtagtgtgattatatctcactgcagcttcaactcctgggctcaggtgatcctcccacctcagcctcccaagtagctaggactacaggtgcatgccaccatactggtgtaattttttaatgttttgtagagacggggtctccctatgttgcccaggctggtcctgaactcctggcctcaagcagtccttccacctcagcctcccaaagtgcagggattataggccacagccaccaggcccagcccaagcaagatttttaaaaattgaattttcaaaaactttaaagacaagatggagtactttggctggaaactataaaaagtaatcggatggaaattctagaattgaaaaatgcaaaaaattacaaaacgagatggatttacttactggctagtcagttaaaaagagaaaaagactgggtgatagttgtaagaaaatagttacagttgacccttgaaaaacatgggcttgaaccgtgtggatccacttatagattttcttccacctctgctgctcctgagacagcaagaccaacccttcctcctcctccccccctcttcttcctcttcctccttttcctcctcctcagcatgaagaccataaagacaaatacctttatgatgatccacatccacttaatagtaaatatattttccttatgactttttaaataacatcttattccctgtagcttacttattgtaagaatacagtatataatacatatacaaaatatgtgttaatggactgtttatgttatcagtaaggcttccagtcaatagtaagctattcatagctgagctctggggggagtcaaaagttatacacggctgggcacggtagctcacgcctgtaatcccagctactcgggaggctgaggcaggagaatcgcttgaaccctgaacccagcaggcggaggttgcagtgagccaagatcatcccactgcgctccagcctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgccataaaataccctagaataggtggcttttctttttagatggagttgtgctcagtctggagcagagtggcgcaacctcggctcaccgtttcctccgcctcccaggttcaagccattctcgtgcctcagcctccctagtagctgagactacagatgcgtgctatcatgcctggctaatttttgtatttttagtagagacgtagtttcaccatgttagccagactggtctcgaactcctgacctcaggtgatccttctggcttggcctcccaaagttctgggattacaggtgtgagccaccatgcccagccagaatgggtggcttgaacagaaatgttttcaaattgtggaggctggaagtctgggatcagggtgccagcacagttgggttctggtgagagctcacttcctgggttgcagatggtgctttttcgctgtgttcttacatggcagagtgggatgcggggtaaagggcgctctctggtatttctttacaagcacacattctgtagtatcagaaccccaccctcaagacctcattaaaccttaattcactccttatagggcctatttccaaatacattcacattgagagttagggcttcaatatgtggattggggggtggggagacacaattaggtctatagcactgtataaaccctaa

SEQ ID NO: 14905 - DNA, 9490 bp, Human
  misc_feature (1)...(9490): n = A,T,C or G
gtggtataatccctaatgtatttttaaagcttaaatcaccccaaattttgccgatggaaaccactccaaggtggtccctattttcttttcacggtttctgacacaagatgtctttgagcttaccttgtacttttcttgccctagatctagaatcagccacttcttcaaggacttacttatacgacgaataggtcatacatccatctagtgcaagtctccagatattcacagctatacatgccccctccaatcccacccctttcttcatagtcagccaatgttcgttatccttccagagatagtttatatcatggagtaatataaaaatttatgatttatatgtactgtataatagagcaattatattcttacctacccccaacatgctttaactcgaatgatagtgtagtacacttctgagtttgtctgggcttgtagctcttgtctgtcattagattctgaaagatacctattaacaataccctaaaaagatcaggagcctttaggccaagtctcaaacgtttcagatgagaaaaactcagggatggtgacttgacggaagttgcattaactaacaacgctcacatgctattctccggacttggaatgtccaagcaccctgggcttgctgacacccactcacttttcaaacatcaattcttgggaagcttttcccttccttaatgtcccccagataggtgatgtccccttgttacaggttttagaccattatgtacatctccttcctagcacatacatatattaaaatttgtttcctgtctccatgaggagagggactacatctgtccttttcactgctggcacacagtagttgctcaacaaaaatgtgcgaagtgaaactcgaacaggcggtcaggctcacagtccacgcctcttcctactgtggtcccgctgtgtttggacaaatagttccaaattataaactttaaaacctgagaagtctcaatagaaaaagcagggaagtctttccatttccatgattaatggaggaccttagcagaaacggctcaccgcgaggtgtgacgaccgcaggagggcgtcaatcaagaaaatgcccccttgccccggaggcgagtggagccgcacagagccgaggccatacgggccagcagtacggactgcttcaatagaaaacacgtgcaaaaccagagagccagactgcgcacagctgcgaccctcaagagccagcagaaaagacacggagcggcccccactggattgaagactgcacagcctctgcccggcgctgtaggacccgggcctccccttgattgctgctcgcagcggcttctgccagcatcctcgcggaagtggcttgagtccgaggcctccaaatgaaaccaggtggagcggccaagagtccgcagcacctgaactccagccatccgaatcccgccgggccgcagctaagggccgccgagcagccctaggaacccagggcactgtcccgctctgagctcgggaaacggccggtgtgacagccagcgccactgttaatccagggagcgcacccaccgaggaggcgtcttaggccagcggcctctgctcccgccgagtcccgctgctccccgcctggaaacagctgctgccaccccgggcccaggcctggacggcgcccccgaatttcggcagaggtgcctcggggccgcggacagggccgctggagcccgcactccagaaggcggtcttcctcgcgcctcccccgacggacgcggcccagggcttcctcgagggcgtcctcggccggggtgcctggagtccccaggggcgacagccgcggcggggcaccagggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccttcaccagcctcgtgtccccctaccggaccccggtgtacgagcccacgccgatccatccagccttctcgcaccactccgccgccgcgctggccgctgcctacggacccggcggcttcgggggccctctgtaccccttcccgcggacggtgaacgactacacgcacgccctgctccgccacgaccccctgggtaaggcggccgggcgagggtgggggcgaggaagcgccacccggcaggtggcagcgcccgggaggccgagggggcgaagggggcaggcggtagacggctgtggcaaaagcgatggaaaagcagctgtcgggcacgcgcggggacgggaggcgcgcggccggggctgaccgcaccgtgactcagattggttttcctgcaccttgcaggcgtcggggcgcgcgggccggcggtagacctcgcggcgagggcagccgtggaccgcgcgtgttacccggggtggggctcccttagcgggagggacggggaaaggggcgtcgaggcgcccctggccggcccccgtggggcagggatcgcagccgggcccgggtggctacggggctggacctggttcaacaggcttgtgcagtgaaagagcctgaccctttccgttcatacaggaaatcttgagttctcgataggagtaaatctggtttcagaagctgttaagtgttttcctggctgcatgaagcagacccttcccccggagtagtgcacgctgctgattattttatcgacatcctcaatacagacaaattcaggaaacactcgacttctgatagccgggatccgtttttctgatattgttcatttcctctgtgtgggatgtgactttatggcagctaaaataaccagttgcttcctattttttttcgaggctgttttgcaccagtctgaagcctgacgcaagcaaaatctcgaaaaaacaatgctagctttcaaagcgttgaggtgcaggcctgcagacggacggacggaccgaccgacactactttgggagtaggaagcagcagctcctggtcgccagttaggaagggaagcagggacacatagggcatatattccagaacttcggggcttgtcccctcaatgtgcggcctaacaaataagccgcccgtggtccgcgctgtgggtgacccttggcgccttcgaggtctggagccctagggtaaataaggaaacggggcgcctctagagttttaaatgaactctgttattggaagcttcagtagggaccctgaaaacaattaacgtcttaattagcattttaatgtctccattattacggcgcgggctctagctcagccctttaccttaccttctcaccgttaacaggggagggggattgtatttttagttcatctttttatgtttttgagttgttatcctgtctgtctgattccagcctcgagggtttgatgatgcggcccgagcctggctgtggtcgcctgtcggggctggagcgggaccctcagccgggccgggcctgggggctaacgttttcacagtgcgccctgagtttccttgggttactgctgggaccgcgcaggaggaagcaaagagtttttcgagctagaccaacaggaaacacattgacggaaatgttgccatagcccatggggtggctttaactggccgcccccgcgggctgggtgtgaaatcagaggaggccgcggctcccccggccaggattggaggctcctcgcgcaacctaatgcgggtgtccgggcccgagcgcttcccgcgcagccaggccttgtcggtgcagcagccccgctcctccccaacacgcacacacccggtgttcgcaagtgcggctcaccaagggagatccaagggggcaaaaagttatgtataaatccgagagccactggggaaagagggtcgtggtattgtaagcccagccggtagtgcccattctttttggggttaaaggtatgtctggatttagttctaggtgtgacggctgtgtgtctgtctgtgtgtgtacaaggctgtgtgcatctgcggtgtcagtgtgtgactttgggtatgtttgtgtgtcggtgggaacgtgttaggtccacgtgccggtgggtgtatgtgaatgtgtctggttgggtggcctcctggcctacctttgtcatccctggggcccgacagctctggggtctggccaggccgctccagggcagtgggtgagcgccgctcttcccgctcgcaggcaaacctctactctggagccccttcttgcagaggcctctgcataaaaggaaaggcggccaggtgagattctccaacgaccagaccatcgagctggagaagaaattcgagacgcagaaatatctctctccgcccgagaggaagcgtctggccaagatgctgcagctcagcgagagacaggtgagctcgcggggggcctggggccgcctccggggaagggaaggcttctggggtaggggtcgccgggccaccgagagagaggcgaggagccaccctgccctctggcacgtcccgacgcgggctcgttgcaagttttctttctctctttcctgtaggtcaaaacctggtttcagaatcgacgcgctaaatggaggagactaaaacaggtatggacatggttctgtttctatggaaataaatatttttatcacgttatctcagtgcaaggctgttatgggttgtatgcaaaagtcatttaagagactatttaacctcttcaccttgattaaaaagacaaatagtcctgctgaaattcaggatgagttgctcaggtggcagtaatgctaaaagcacctaatggggttcctatatcaattatgcttgggttttcacacactggctagtaaaactcccagctaattgttttataaatcccatatgttgtttatctaattaacgcaggaaagataaagtaattgacagtaaatgacttaagcagttatctttgggagaaaattgtttcttttatttacacagccataataaaaccaggcagaactcaagggtaaatataaagaaacaaacacctttaagtcttgtttgcactgttttttagaagaattaaatgtcagggagtttaaaaattattttctatctaatgccagctcttaaaatgaaatataaaacttgtaagaaaatattcaagcctgtttggaaagtagcttaaactttctgacagtctttcttccagtgaccttgtttcgcaatatgtgataaaaagtaaaggctaatttagtttttaaaagaaggtctattgacttaaagctaaacattcatttttgatgtcctaatctggatatactctccaaagttatctgataattgctgaattgttcacttgtcattgtatatacggtttataataaatactttgaaacaatgagtggagaaatttaaagcaaagtggattttaaaatttattgatcattactttttcattaaaaagaaagtgtcccaaagaatattttgaaatagaaaataaaattcccataacttcattactgtaatgtgatttaaatatttgcagatccactctcaatttctgaccgtgtgcatctatttgttgagactataaggcttgcaactatataacaaatagatgttgtaatatttctatgtagtatttatatgcattttagacaagtataggattaaaaattcactagcttatatacttaatagttcttggtcaaaggcttgactctagtttaccagagaccttaaaaatagtggtttctatgtaatatggggatatttcccagaaatttgccccagattttaagtaaattgtagctaattgtctaccttctcagttggcagcattcttccagatccacattttttttctttgccatgattttgtaacttgttaaacatttacacatgtagatgtttataaatttactccagaaaatgaatgaaaaaagatccagtctaataattgaaactttattcttaattcaccagttagcattcttatttttaaaatgtctgaaagactgttaattggcaaggtttaaatatttaaagaatgaagttaaggtgtatctgtagtgatctgattttctttcccccttaaacttttgagaatattgaaaccatgggtctgggctggtgttaagtaaccagaatttgtgttcaattggtataatgtatctgcccttatgttcatgactggttctcatcttttaagcatataatctttgatatgacagaaacttttcttccaaagtgagcaaaaagcacaagtatgtatctcctgaataagattataaactgaaaacactcagtaaactaaaaattaaaagatggaataggatgaagagacattttgatttattcctctcacctatccatattttatgatccttccaatctccattttcatttcctttattcaggagaaccctcaaagcaataaaaaagaagaactggaaagtttggacagttcctgtgatcagaggcaagatttgcccagtgaacagaataaaggtgcttctttggatagctctcaatgttcgccctcccctgcctcccaggaagaccttgaatcagagatttcagaggattctgatcaggaagtggacattgagggcgataaaagctattttaatgctggatgatgaccactggcattggcatgttcagaaaactggatttaggaataatgttttgctacagaaaatcttcatagaagaactggaaggctatataagaaagggaatcaattctctggtattctggaaacctaaaaatatttggtgcactgctcaattaacaaacctacatggagaccttaattttgacttaacaaatagtttatgtactgctcttaggttgttttgataaagtgacattatagtgattaaattcttccccctttaaaaaaacagttagtggttttcactatttataaaaaattaattttgaactttttgttaaatttttaagttatagctttaaaggttttaataggaccttcttgaacgacttttctgtaatctgtttatctcccacttaatggaaaggcaaaggggtaccccaaatccagaggtgcctacatttcaggcagccttggagtattttaaaaggaaaacattctttacttttatatgacattcttatactgctgtctcaaatccaaaaacatttcagagctcttgtctcagagatgtgtgttctttttgtcagagatatggttgatgagaatcttaaatgcttgttttgcactatcacttagtacctgtttgaccaaggtgttaaggggatagtacctcccaattcaagcagagaaactgacctgactaaagttaatcgcagatgaactagaagtcacaggttaattaaatgtaagtagattgtagatactgttttatatcaaacaatgtttataatgtgtatatagaattgttcactgtaaaaaaaatggccaaaatgtgttttttttttaataagtaacttgactataaaataaagccgtccgtgggacgactgacctcgttgcaagtctaattctttgattttaaaaagtctgcacaccttttcttgacctcctgggtgcttggcgcggtgctgggctctggggacaggaagtgactggggctggatcttgctggggctctcgttccgagtcccaggaccgcgggtgggtgcctggaacgtgggttggggcctctcccgggccgtttgccttggggctctgctcctgccggcggattctgagcctgatgggttcgagtcccgggcacgccaggcgacgggaagagccgaggcccaggcccgctgcgccgtgaagcgcggggccgtccggaccccatcgattctcctcggcagccgggctggccctcgccgtccttgaccggctgagtcaacaccgcgtcatccctcggcggccggggctcgggaacccgctccgcgcggcggggcccggggtggggaagtccgagtggggggatggggggccctggccgaggggagcggggaggtggtttgcgctgagaactgttctcgaacccggggaacttcagaacctccttcagggcttgtggaaacccagccctgttcctggagttctgatctgttaggactggactgggctgggaccgggaatttgtatttccaacaagagctgaggtgacgccaaagctgcgggcccggacaccacccctggggaaccactgatgtgagcgcacggggtgcggaagaagcaggtgggaccggcactcctcctcccacctgctttcccgggtaactttggccagcaagaggctggggcggagggctgagaggagggaaaggcgagggggaacagaggaacgaggggcttatccaggctagtgggagtgaggtttgatggctgagcagagggcgcagggtggaggaaggggcaccatgaaatggagggagaatggggtgctgaggttaggtgggtgtgggggcccaggtttctgattgttcagggtattgctagtctgtgccagctgcttgcctagctgagccatcaggtctctgacattccaggaaaaccatgacagagatctgttggggagaggcctggaaatctctctctagccttggcctccatggaggaggcctctagttgtagagttgggtacttctggctaaggacctgtgaaggaatgacccgacccctggcctggcttctagggctgtggcgcccccagatatggacactcagatgaagacagtgaaaaagtcattgctgttagggagttgtcacatccggcttccttagattctaagaaggcccctggaattgcaggggaattaagatttctgagaaaagcagtactagtccttaagcagagaggtgtggatagacttggaagtttgaagatttgggttggtgttttagttcttggcctcaaatcatttgtagaacgaagatggtctagttgaaccatatgaaccccttccagctctcaaattcccaactcagttcatgccgtccttattgttctccctactccccatgtctcctcagccttggcacccaaagtggccacccagtgggagagtttcccttcccatcagctgtaggctccagaccctgcctaaaagattacatcaaggtttcaaaggtcataatccatctcgtctgaaaatgggactgtccatatcagatttttggagaatgggaggcttatggatgtaatattgaattaaagtaatcctgaaacctgtgtgtgtgtttcgcttctggagataaaccctagttaatgtttattcttgagagtaactgtatcatgactattcagcagagaaatacagactaatgtattgattcacactagaaaacttgaggggtaaaatctagttttaaagttgacaattccctgaaaccaggctgctttccaatttcaagcttatcctaactctcaccaagttgctcccattctgaatctaaacatgtccttaagaatcaagagcatgttaactggaggaggtgcagtattctcaggacacaggtaggcatt

SEQ ID NO: 14906 - DNA, 9490 bp, Human; identical to SEQ ID NO: 14905
  misc_feature (1)...(9490): n = A,T,C or G

SEQ ID NO: 14907 - DNA, 10834 bp, Human
  misc_feature (1)...(10834): n = A,T,C or G
cacatggtgccatatttgtccccaggtcaggtgaagggctaaactggaggtagttagaggaaggatgatatccaggactgtgttcccctaatcattgggtcaatggagaatcttccagcacttattccatgcctttatttcacttctaaaagctttctatcttcaatttggttagaaatgtttctaatcaaaggtcatgcacaagtgtcatgacccagataacaatgataccaaagtaaattataaaaatctttcatcaagaaatcttttctttctataatttttgcattgagagtttatcagccttcctataactgatataataaatacaagaatacttctccacccattaaagcaaattgccagatgacactctttgcagtatccaccccactcaggagtacagataaattctgctgtcatttttatagcagctcttatataaatctggatatttgattatttgagatttttcattgacaaatttccaaaattagctcattttatattattgcaaatcatcacagtagggtaatgaagtggggtaatgggtgtttatgacaggaaatggcttacagatgctgcagagtacatcagtcatcttttttgttatcttccttcctgctttagtcccttcctctatgcaatttctttcctgaactatgtcaatattatgagactgagtttctagaataaagatggccaataggctacatctcatgagctgactctagttaacagtgctgtcctgactttgtatcaagaagaattctgaaagcttgtctgagcttagtgggagaaagtactgggaccgattggtgatgactgtcattggcataggaaaaaagatgtattagcacatgtgccagatacttcctaccctggcatctttcaaaagagatcatgaggaaaataaaagtttataactcataatatggatcaaatatcatggaacccagcatctgagagagggttgttgctgctgtactgacattaaaatatggggaatatagtttaaccttgacattcttgagtaatattatgagagagttttgcaaacccacaatcttaaaaacaatctttagcatctattaaacatttagtgtgagccaggcactattccaagtatttttctttttaattttcacaatagtcctgtgtactaggcattatatttacattccttttacagaagaggaaatagagaagttaaataacatgcccatggttgcagacctagggagtggctgagctgggactctaggccaggaggtctgagtccagcattctaacccctttgctatatgggctctagaatgcagggaactaacaccaactgagatgtggacataggacagtcaggtagggatgcttattacctgctactccttcacaccagcctcatggccaatatgattcagtcctaccactttccattcactgcctcatataaactacaaaaaaattctatggggtcgctgtgattattcctaaacacacaccttcagggttgcaagcaagtggtcaaaattgtgaatactgtagatataataatctccaacaggctattagtgctgcgtaactcatcaccacatttcaaagatcaggatatggagaacaacacaatagggacaagtagaaaaaaacttgtggaagtccctgttcattcccaataatgggaccttttaatagaaatgcaaaaaagtggtgtgccatgggaaatctggatgtagtaatgagctaaactttttttttctatcttcagatagtgtcaaatcctacttcactgcaggtaaatattttctggaacttgtttgtatttataactcattatgtatctcagttctttctgtttggttatctctggtttattttaaagtatatcccttaggaaccctattctgaaagagctggttaatcaggacattgagccataataaaatgatgggaccctctttctagccttggggaaaatctctaagaaaacatacactggctttaggtgaaagtgataaagtgctttcactgtggaggagggctaactgattggaagcccagtgaagacccttgggaacaacatgctaaatggtatccagggtgtaaatatctgttagaacagaagggacaagaatatataaacaatattcatttaactcattcacttgaggagtgtctgctaagaactactgagaaaacaccatcactaactagaagaattgatgataccatcttccaaaatcctatggtacaagaagctatatgaatggggttcagtttcaaggatgttaagaaaataatggaggaaaaaatgcagatatctgggagcaactataaataacttgaggttctggttgcagatctagtgaatgctcagaaagacagtacacaagatgagtcaagtcagacttcattacaggaagagattagtactgaagagcagctaaggcacctgcaagtggagaagctttgcaaaatctgtagggatagaaatattgctatcgtttttgttccttgtggacatctagtcactagtaaacaatgtgctgaagcagttgacaagcgtcccatgtgctacacagtcattactttgaagcaaaaaatttttatgtcttaatctaactctatagtaggcatgttatgttgttcttattaccctgattgaatgtgtgatgtgaactgactttaagtaatcaagattgaattccattagcatctgctaccaagtaggaaaaaaaatgtacatggcagtgttttagttggcaatataatctttgaatttctggatttttcagggtattagccatattatccatttttttactgttaattaattgaaaccatagactaagaagcatcatattataactgaacgcaacgtgtattcatagtatactgatttaatttctaagtgtacatgaattagtcatctggattttttattcttttcagatgggcttaacaaatggagctttctgtatataaacgtggagattagagttaatctccccaatcacataatttgttttgtgtgaaaaaggaataaattgttccacgctggtggaaagatagagattgctcttagaggttggttattgtgtttaggattctgtccattttcttctttttttcttttttttatgattattacactttaagttttagggtatatgtgcacagcgtgcaggtttgttacatatgtatacgtgtgtcatgttgttgtgctgcacccattaactcgtcatttggcattaggtatatctcctaatgctatccctctcccctccccccaccccacaacagtccccagagtgtgatgttccccttcctgtgtccatgtgttctcattgttcaattcccacctgtgagtgacaacatgcggtgtttggttttttgtccttgtgatagtttgctgagaatgatggtttccagcttcatccatgtccctacgaaggacatgaactcatcattttttgtggctgcatagtatttcatggtgtatatgtgccacattttcttgatccagtccatcattgttggacatttgggttagttgcaagtctttgctattgtgaatactgctgcaataaatatacctgtgcatgtgtctttacagcagcatgatttataaaccttttggtttatacccagtaatggtattgctgggtcaaatggtatttctagttctagatccctgaggaatcaccacactgacttccacaatggttgaactagtttacagtcccaccaacagtgtaaaactgttcctaattctccacatcctctccagcacctgttgtttcctgactttttaatcattgccattctaactggtgtgagatggtatctcattgtggttttgatttgcatttctctgatggtaagtgatgatgagcattttttcatgtgtctgttggctgcataaatgtcttcttttgagaagtgtctgttcatatactttgcccactttttgatggagttgtttgtttttttcttgtaaatttgtttgagttcattgtagattctggatattagccctttgtcagatgagtaggttgcaaaacttttctcccattctgtaggttgcctgttcactctgactgcagtttcttttgctgtgcagaggctctttagtttaattagatcccatttgtcaattttggcttttgttgccattgcttttggtgttttagacatgaagtccttgcccatgcctatgtcctgaatggcaatgcctaggttttcttctagggtttttatggttttaggtctaacacgtaagtctttaatccatcttgaattaatttttgtataaggtgtaaggaagggatccagtttcagctttctacatatggctagccagttttcccagcaccatttattaaatagggaatcctttcccccattgcttgtttctgtcagatttgtcaaagatcagatagttgtagacatgcagcattatttctgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttttggtgtggatgtcctttctgtttgttagttttccttctaacagtcaggaccctcagctgcaggtctgttggagtttactggaggtacactccagacgctgtttgcctgggtatcagcagcggtggctgcagaacaacagatattggtgaaccgcaaatgctgctgcctgattgttcctctggaagttttgtctcagaggagtacccagccgtgtgaggtgtcagtccacccctactggggggtgcctcccagttaggctactcgggggtcagggacccacttgaggtggcagtctgcccattctcagatctcaagctgcatgctgggagaaccattactctcttcaaagctgtcagacagggacatttaagtctgcagaggttactgctgccttttatttgtctgtgccctgcccccagaggtggagcctacagaggcaggcaggcctccttgagctgtggtgggctccacccagttcgagcttcccagctgctttgtttacctagtcaagtctgagcaatggcaggcgcccctcccccagccttgctgccgccttgcagtttgatctcagactgctgtgctagcaaagagcagggctccatgggcgtaggaccctctgagccaagtgcaggatataatctcctggtgtgccatttcataagcccgttggaaaagcgcagtattagggtgggagtgacctgattttccaggtgccgtctgtcacccctttctttgactaggaaagggaattccctgaccccttgcgcttcccgggtgaggtgatgccttgccctgcttcggctcacgcacggcgcactgcacccactttcctgcacccactgtccggcactccccagtgagatgaacccagtacctcacttggaaatgcagaaatcacccgtcttctgcatggctctcactgggagctgtagactggagctgttcctattcggccatcttggctccacctccattttcttttaaaattataaacatgtacttgtgcaaattatttttttaaagtgatttgccatttttgaaagggtatttaatgatagaatactatcgaaccaacatgtactgacatggaaagatatcaaagatatgttaagtgtaaaatgcaagtggcaaaacactatgtatagtctgagccaaatcaaagtatgtatgttttttatatgcatagaaggaaagatttggaaagatatacaccaaaaaaaaaaaaaagaaagaaaacatacactggaccctttatgagaaagcagttaagtcaatttattgaaaaacactaactacagggaaaaactgtgttcttagaaaggggtttgcactaaaagagatcaagtcatttaatgacaacatttgagtttttttattcaatccaaaaaaagcatatgccacagactccctttttctattcttccaagtccctaaccagtcatgaaattatgtttttaaaactataattcttgaatacagaaaaatagagacctcagtggatgaagtaccatttggcatgtttaaatgatagaaaacaaaagggagtgattgaagtgggaaaccacagctctagtggactgcagcaggaggcaggagcttcaccaaaatttctccatccctggagtgaagaatgcaggaagcatgagggacccatgagaattgacccccaccaatccttttctttttattgaggtgaaattcacattgcataaaattcaccatttaagagggaacaattcagtagcatttagaacattcacaatatagtgcaatcattagctctaactagttccataacatttcatcaccccaaaagaaattctgtacccattaaaccatcacttcctcattcttcttcccctgcaatccctggcaaccaccaatttgctttctgtctctatgaatttacctattatggttatttcatgttaatggaatcattcaatatgtgtatgattttttgtatggcttctctcaccaagcataatgttttcaacgttcatctaccttgtagtaggtatcagtaatttatccctttgtatagttgagtaacattccattgtaggtataaaacatacatattttttacccattcatttactgatagacatttgggttgtttctagcttttagttattgtgtatagtgctgctatgaataattgtatacaagaatttgtttgagtatcaattttcgattcttttgactatatagctagttatggaatttctggatcatatgctaattctatgcttaatttgttgtgtaaataccaaactgttttttccagtggctgtaccattttatattcccaccacaaatgtttcatgcttccactttctccacattctcaccaacacttattattttccactttttaattatcattattatgaccattctagtgagtataaagtggtatctcatggtttttatttgcatatccttaatgactaatgatgttgagtctttttccgtgtgcttggtggccatttggatatattctttggagaaattatttgttcaagtccttggcctatttttcaattgggctaatctttgtgttattgatttgtaagtgttctttatgtatttgagatactagacccttgccagatatatgacctgcaaatattttctcccattctgtaggttgtttattcactttttaaataatatcctttgataagtaaatgttcttaattttgatttggtcccatcgaaatttaactattttcatctatttttcttttatttatgtgtatctttttttcgttgcttgtgctttcaatgtcccacccactatgcctcttgacggctgctcatgtctcagtcctcctccagttctgtgttttcatgacctgcaagtctccttgccttctgctctctcttgatacacacttctgatagtttgatctacccctctccatcctgccccagtgcctgcctatggttattcttctatggttattatcctggtcttccaaatgtcccttcagttttcctttttcattcacacaatcctcatattttcaaaatacttttcctgattcctagcctataaacaagtccaaactacttacactgaggaatcaaaacaaagaaattcctccccagatatcctgcaatcttctctagaaaactccctgcctctctcctcctatcaccaaaaccacttgggtcacccacattgacattctccacattctcaccaatt

SEQ ID NO: 14908 - DNA, 11261 bp, Human
gttatccctttaaggtgcgcctgagacaaatgcatatctaattgcttcccctcccctattgtttacctaaaaatgataattcactgagccagactaaattgtgtattcagtggaaggctgatcaaggactcaaaaaaatgcgatcttttgcctcttatctactcatgacctggaagccctcacctcaagtcccgctttacctgactaaagtacatcttacacatactgattgatgtctcatgtctccctaacatgtataaaagcaagctgtaccctgaccaccaagggcacatggtcatcagggccttctgaggctgtgtcacgggtgcaaccttaatcttggtgaaataaactttctaaattgatggatgccggatgtggtggctcatgcctgtaatcccagcactttgggaagctgagacggacagatcaactgaggtcaggaattcgagacaagcctggccaacatggtgaaactctgtctctaccaaagatacgaaaattagctggttgtattggcacacacctataattccagctgctcaggaggctgaggcaagaggatcgcttgcctgggaggcgaaggttgcagtgagccgagatcatgccactgcactcctccagcctgggtgacagagcaagatgccatctcaaaaaagaaaaaaaaaaaattgatggagagttaacttttggtttacaatgtaaatgtttatttaaaaacagacattattttatgtaccattacaaatatactgctacccagctgctcgggaggctgaggcaggagaatgcttgaactcgggaggcggaggttgcagtgagccgagatcgcaccattgctctccagcctgggcgacagagcgagactccatctcaaataaaacaaaaacaaacaaatatactgccaactaaactgtgattttgtcaaaaataaatgttgttgatgactttacttccattaaagccactgtagtagccaagggaaagcttcctttttgtcctctgaaggttcactgaaaagtcaactgacaaaaggcacattaattggagaaagggcatacaaatttattaacatgcacatgggggagaaccagagtgattttgctgaagccccaaatggggttcagaaacttatataccatcttgaggttacagaatgggggtttggattgtggcataacaggttatgcgggtggagacctggctgacaaccacggtcttgttatgtaaatgaaacctcctaagtagaactccttaaagagaacaggtggtacatgtttctttcagacctttgcaaaccaacagtaaaattctaaaccctccaaccgactgatggaccctctgcttgcccaagggcattctgaagttaacctgaaaaactagttcaggcaatgatgggaagtgggggttggccatgcctcattatacactcctcccttggaattcaggtacagcaagccagcactaacattaaaacagagaccttaagactgacagaaaagactcttctgcagaggcttcttcattactctcaggcacacaggattcttggtttccgctgtagggtcctcactttacctgttcaaccttcatttgtctttcactgcctactcttggttagcactcggccagcgcacaggtttcccacaccctgaggtggacaccagcagggaaggtttgagggagggctctgcctccctggcggccacccgcaggcccacagcaagacatgtgcagaggtgagcggagcgccgtcaccagctgccactctcccaaagaccagaaccatcccagagcacccggaggcaccaggaaagcggctcggaggcagaggcgccaggggcggggctgatgccgagaggtttcctctgccccgttccctcgcattggtcctgcaaccgctcccgtcagacgcgtttccgcctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttccccagcaaggtgggcgggcggccggcatggctgggcgcggccgggctgccggggccccaggccctggcctgcgagctgtgcggccgcccgctctccttcctgctgcaggtgtatgcgccgctgcctggccgcccggacgccttccaccgctgcatcttcctcttctgctgccgcgagcagccgtgctgtgccggcctgcgaggtgagccgccaaacggggtcgggacggggccatgcctccgacgcgtgcgcggcgttaattccgggagcgaccagggggacggcggcaagcaccgctgccgccccagcctcagagctccctctccgcgctgccccaggagcaccttctcccgggcccttccaggatgtgctcatttttgctacataagcttctaactgtgcccacgcgcattggtaacccccagcttttaatcagtgggtaccaggtatggtgttaattcagataatagaaattgtcttggaaagatggatcccagtagctttttcgtatttttggcagtcgttcttaacgatcagtcttattaatttgattaactcaaaccacctctaggaggcaactcagttgcgtgtaccggacgaaatctagtttctggattttaaaagcttattcctgaaagcaaaaactttcatttcttttttgttgttgttgagtattttcagttttacgtgcagaggataaaatatgtgaattgctgttttgtttgaagataaaacttttctctgcattcttttttagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccaggtgggtaatcttttttttaagtctcagttcagtttcatcgcctttgtcaacccagatatttccaggacaactttaaaggtaaaattaggaaaggtatagtactttaaaaatttttcatgcctggaacacctttgtaaaaaaaaaaaaaaggctgtgaagtctgaatcactgaataatgtcaccatataggcatttaatttatgaccctttatctaaaatgccagaactatagggaatatagtactttagagacagcaaattattagactgtcttcaaaactaaatgattactaatagtgctgtcctttttgtttcagatcatctggaccatataattccagaccacaacttcctttttccagaatttgaaattgtaatagaaacagaagatgagattatgcctgaggttgtggaaaaggaagattactcagagattatagggagcatgggtaagcagtttcaggacttcattcattaagtggttaaacataatgcttggaagaaagggctccatgtgcctagaagagaggtactgagaggaagactcactttggaggctgtagcatacaattttcagatattgcctcaggtaaaaatatacttcctggactttgttttctgacacataagaggtgtgttctgctccctgtaaagacaagggtgggtatccagatggtcccatgagtagggctgcacaagatgctggaggcttggtaagttcctctgggtcgcagatctgtttctcgggtcgggatagtgtgagtgcctagcacagtgtcgggcacgcagaagggccccttaaaagtttctctttcatctggccagttttagatacacaattttgtcagtttacttacagtgcatactcttgggtagtacttgtgctgaccaagtatcttagaggcttattttattatagtagccaacatttatccagcacttaccttatataaagggctgtttgtgcatgagctcattaaaatcgtgacagcagaccaatgagtgagaaactgccccattttgaaggtgaggaaattgaggttctgggtataactttctttggtcacataatattaaattttacaatttgagccttgagccatacacaaaaccaccacaaaattagatttatagactcaaaatgaaaacatcagcttactggtttgtagttcataccagtcatacattccaaaacatgttttgagtcttactctgtgcctgaccttgtgcttgataacagggatataatgggaagcaacactccagtggtcagatgctcacagtcttatggaggagcccaaataatatctggggaagttaaagtccatataatgactgataagagtacaatacaggtgccatgggaacacgtgacatcactgaagactgcctggaaggggccgcgcgtgtgttcatgcctatacgataaacatgatacataatgaaaatgcttatctttaggagaaaggagagcctagagtagcaggatcaaggatgaaagctggacttcaaatatgccttgttagtgtaaatgtgactgtggaactgtatgagtattttaagattatggagtaaagtaagttttaaaaagcagtccctaatcatcaaaagtaaaaaactcttgatgtagtcatataaccacactaagaactcttccaggtgacttcaaaacataggacagtacatctctagtagaatatgccctgagaatgaaaagaatgtaacagtgttagtattttgaataaacatgttattactagactgttgcttttattttgagatggttgtgtgtgtattggggggaaaggaaacgagtaattatgttggtgttactgagaactgagatgttgggcgtaggaggaagataatgttgattgtgtctacgtaccatttctctctaaaaggaactccaggctctttggagaggtggttgattccagaactaggtcaggaaacgttcatataatgtgggaacatggtcatatcaaagattaaggataaggattactagggccatgtcagaactcaagcaacatgaaaaggctcctgcttgcaaaagatggacagtttgaacatccacaaggacgctaactgcatcagatatgtttaatgggttcaaaatgatactttaaaaaaactcagtaatcatctttataggatacttgggaacagactcattttcaaattggtaaataaaaggaaagagtttgccttcgaggggtacataacttaattatgaatgaagtgatatgtgtggaatttacttcagagtaatggaggtggaagtggcagagaaaggaaacactggacttgatagtgttgaaactgattaatgatatgtggcggttcattatagtatttccacttttctgtatgtccaaaattttctaaaataaaaggagaattgaatagaaaaatgcttcctggaggtagctgtgtcttacctgagacttggcaggaggcagtagggcctgagggaacagcatttacagtgtcctaacggttatactgaaactttccacgtatacttgatggaacatcaatctgaaggcatcctacacttcctccatcagacctgatggtgcaagtgaacaccatcagtgcctttccagtttcatcaaagcagttattttagcttctctgacccaaggtatatcagttctattttaacgtacattacaaagactaatggttatacttagagacacgggtctgttggggacagcagtggcttagggtggctgtaatcccaggaaggaatgtggagaaggaaatgaacatttttttttttgagacggagtctcactctgtcgcccaggctggagtgcaatgtcaccatctcggttcactgcagcctctgcctcccaggttcaagtgactctcctgcctcagcctcccgagtagctgggattacaggcacctaccaccacgtctggctaatttttatatttttagtagatacgggatttcaccatgttggccaggctggtcttgaactcctgacctcaggtgatctgcccgcctcggcctcccaaagtactgggattacaggcgtgagccactgctccaggccagaaatgaacacttgatgactgagtgagtgagcctaccagctgaggatactaatgataagggctcacatttgttgggtgtcctgtgatgtgctgggcagtcctaagcccttgaccattctgttattttgaagctttaaggagatgcactaaatggaagtccatataatagagttggatggagtacctggaaattcagatggtccaacttgaatgagtgaataaatagggaaagctatctgattaaaagtgggtcccctctccatgtgtgaattgtcaagttgtggggattactcctgtttttcataatagttacgttgatttttcaggtgaagcacttgaggaagaactggattccatggcaaaacatgaatccagggaagataaaatttttcagaagtttaaaactcagatagcccttgaaccagaacaggtaaagtggagctcatagctcctcatcgtgttctcttcaggccatgttttatgagtataatctgtaagaaataacttcatagtaacattagtctgttccttaggagcctataaaagcaggcttttgttatcttgttagaggagttcctcacacagatgggccatgtagaaaggtgttttgcagtgctgatccatttaatagttactaaaagactaaaggttatactgtttatcatacagggttcattttctaaagcaagcatcagggatgggagatgaatgagatgttgcctaaggtacatgaggtttaggcaccattggcccccccgccagaaagaaaaaaggttatttttgcccatttccaacaggtaactttggcttgtaaaatgtgacatgttaacatttttctccttaacctcccctaccataaacgtaaatcacgaaagaaaactaaactcccataaaccagtcactggttcaaataaatacacaggaagaatagatctaggtcttaaacactaaggcagtttttagcaatgcatatgcttttagacaaaatacagaaaaccactcagttgctgtaggaagcttattacagtgaaatttacttatgtttgtagtagttttcaaaacactatgtttcacttggtatttgtccctcctaaaattttttaactatgaaggtaggcacagactctgggcagaattctgcaattagagcagaggccattcttagtcccttcacaatatattcataggattaagttgccaacattaggtagtaaaagcatcatctgggagatatattttgatgccctctgagtcagataaactgaaataatcactttgaggtgattgagaaggcattagtggcacactggcacagccaggtctgatgggggaactgtgacatgccttttgggtcagtgctacatcaagagtaggaacattcatggagtagatagcatgttaccattggcaacttataggtaaggtattgattatttgaacatgatcttcattgattttagattcttagatatggcagaggtattgcccccatctggatttctggtgaaaatattcctcaagaaaaggatattccagattgcccctgtggtgccaagagaatattggaattccaggtatgaccttaaataaggaccatttagtgtgtaatcaccatgattgtttttaaacattaaaaacttcaccaaggtaatttgtgcacatgggtcaacatggcagtatggaagggtaccctataatgaaaatcatcagtttcctgcctcaccttggggctagttccctggaaggaactgtcttgtttttttctgtttcctagttttcagacacggtctattgactgacttctgtgacaatgaggatatctacagtgctctccacctccagtgtggttatgtcattattattagtgcctctgttaacttttgttattttaaataatgtataccttcctttcttgttctagtaattaaagtctttgactatatactttatgagaggagtctttactgtttaatcttggtttgtggatttgttagaaaaaatggatataagcattaaagataaatgtccttccctgcccaaaaggatttgttagcatcaaaatccatttgggtagggtggaaatgctcttgagctatggattcactaaccttaccaaagtcatagctaatattggtttgtttctttgggtaaaaaaggaattatgaggaccatacacaaaactctgcttggttcttagtgccaaagctctcaatgtccaaattgaggtgacaggatttgtataaagtgattccatatcagggtggctattctgcctattcactctttgagtcagactacttctaagattcctctctggtctctataactacattgatagatgtcctttctgtattcattactagtaattagtgtttcttgagtcaagagtaacaacatctgcaatgatacaaagtaaaagttgcccaaatagaagcctcagcccttttgagtggcatattagtaatgaaaataattcattaacagccacttgtgaacttctttctcaaatggaaaagaccaaacagaaggtgagaggggctttgaagtcataaggaagttttagattgttaaacatgttaattgtataatgtctataatcctgctttgtagtatgaggattgaaagaccaagatccctataatcatcctggctgagaaggtctcgtgctccctgctgtgaagcagctttctaactgtgtgtcaccctcttctcaggtcatgcctcagctcctaaactacctgaaggctgacagactgggcaagagcattgactggggcatcctggctgtcttcacctgtgctgagagctgcagcttgggtactggctatacagaagaatttgtgtggaagcaggatgtaacagatacaccgtaaaggcatcttaaagccttgaaaaatgttaataatcttttataccttgcaattccatttctgggattttatcctaaggaaatacttataccaaaaatagaggtgcagagatgttgacggattgcttacacagtgtctacttattagtgaaacaaaagtgtccagtgacagggaattaaataaattttggtacatccacagaggaaggctacacagtcttaattataacacctatattgacaacagacataccattataggtggtattcatggtatgatcctattcttgtaaaaatatttgtatgtatgcacagaaatctgcaaagatgtacacttagtgaactggttaccaacgaatggtgggactaactaaaatggtctttttacttatatgtgcatttctttttataataaaaatgggttatatgcctaatgaagtcaaaccatctcactctgagcatttcccaccctaggtttttaaaacacaaaaatacttaggtaaaactcccaacaaacttgtctgatcattagctgattatcacaggctctagtatgtactggaagcccagaatatttgagaaataccaaacctcaggttggtgagtatgatgaacaggaaacccagtaattctgaagcagcagtatcacagttggcaggatgaggaacaacagtggctttgtgatcacagaactggaatttaaagaggctggaccttcagaactgatcttggtcagccggcggccctgcttacagatgagacactgaaaggcaaaaggcgatggtcttccctttccgtgtcagcattgtatacaggttccctatcgcacatacaagggttatggaatgtaagccaaaataagggtctggcctaggaggcagcagcctgaggaaaggaaggccctgaagtcagttttcaaagggctgacccttggcctattatgtttctgatacatctgtttaagcaagcggctcctaagactacactaaggtttcttccatcccctagcagctcacagttgacaattcccagttctctcagcaccagtgatgcctgcccttaagacacattgctgttgatcagtgcttgaatactgacggctaattctgataaatttctcaggcttatttccttaatctacattggctcacattgtcccctaacacatccctgttaactgaaatgcattgccaccataaatcctcacgttttcataggtaacatcacttgctaatgtaattgtctacttggctattttatttgtaatttaaaaagttctgtcctagtagtccatattatataagtatacatatgcaatttgtattaattgtataagatagttatacatagcaccatatgggaaactgcagtatggagtttctcccatggggaggttatcagctacttaagagctagaggatactagtttcgaacctgggatggctaaatctatgaaaatcacctataactatggtgtcacagccctgtggctactggagtaagttgtcatcaactagtgacaagagctggtcgcaacacttagtaggaagcacagtggcataaggaaacctggactagtggggcctttatatctaaaattatgtattattccttataggcagaatctgtaagtacgttatgactgctaatgacttttaaagcaaacatgttaacgatctttctatggtaaaaactgttatttggggacatcaccagatgatgtggacattcttgcaggtattttggcatacccaggcaagctgtcattggtgtatattccagttaacctctggagatgatcgtaacagtttacagggcctttccatttgggatggatatatcaagagggagacaaactggtccaaatcaccagaaagaaaatctcacagcaccgacttggcatctgtgttaaaaaatagcaactatatttaaaataaactgtacaacataaaaaatttaaattaaaaaatgcattaagcaagttgcctttagaaatgtgaagacattttaaaacactacaagataatgagcaagtctcacctacataatcatggctccacagacggtgccagtccatgcatccaccatttctcaacacctacaaagttttaagatctgcttggttcagatactgtccagccacagcagctccctctgctgtagagagcagcatattcagctttgcctttttatttcagatactgaata

SEQ ID NO: 14909 - DNA, 22121 bp, Human; identical to SEQ ID NO: 14359

SEQ ID NO: 14910 - DNA, 13006 bp, Human
aggaattgaactaataagaatacataaatcccagaatatgtgcaacctgatcatagtacacagagatctctctatatatctcttttcttagttcatgctgttctttcaggtagaaagcgccttattttgaattagttgtctttagagcaaaaatccctccaagagtgctgtgtggtttcctatgcacaacctggaatagtccattgcttcatgcctaccctggacatgaagggccatgccacagcggaagtctctatgcacccacccccgtctatacctgagcaacacattcctctttgctgctctcttacaggctacagagtgcggtggcgccagcacagagctctgctcaacgtccctctgtgctttcacgatgctgatggattatgaaggtagggaagaatgtacagccaggaggccattgaggagggcaactaatttataaaatcacatttgtagaatttagtgcatccaacaactaccagggggaaaggtgggcaaaagctataccaacaccacccaagtcaaaaccaaaacaacaggaaaagaaaattatgtggatgtagaatttctgataacatcattcccaaggtgccttatccaagaggaactgctacaataatattttaagtggaaataaatacatgctggaagcattatatattagtagagtatttttttttccccaaagtactttctcaagcacatcaacataagccccctaagagacatttcacattaaaaataaaacgtctgcccactgctggtttctcaatttgcctccaccttctgtcccctttaatgaactgggccacgaggtgagtcagagaggataaagggagtggtaagaatttgaggagagaagagagtgaggctaaaataggaaatcaggaaaagcgattcggtccccctgtccctcacatggggccaccctcttgttgcccagtgtggtttcttcttgagggttctgcatggttcctcaatcccagggaattccgcaggacgttccacccaagaccattgggctcccacctctactcttttgccagttaatgaataggcaggaatttcactgcctggaaagaggaacaatgctttctggtccttatttcacatctaaaatagagaggtcaattgatttattcctaaatatctttgaacactaaaatagaagttttacagcatatatactacctggttgctctagacttaagccagggaaaagtacagattcaacatttaaaattgagatagacgctttccacttaatgctaccagtcttgctttatttcatgagaatgagaatataataatatggcatacgttcatttgggggaaagattgatgtcttataacataatttataattacagaaaacatgtgagttcactgggaataaataaattttgaagataataagatactttcacttatgtcgtaatttctatgtcatttggtgtaggatgtagagatattaacgtttacacctaacttaagtttgtcatctaagacctgaaggggttttgtctatcagctgcacccctgggtagagacacaaccttggggaaggcctcagccccatccctcgtacagcaggaatgagaacagccctgcctgttgggaagcttgagggaggctatggacgtgcagcgcttggcagagggtctcgtcatggaaggttccagcaaatgtgagatacttttatgatttcattttctccaaaagaaagggaataagagaagaggggaggaaataagactaattgcgagagataaagtacaagggtgagggaaggaataaggagacatgacggcagcgtggagcagccgaggggggagattgctttcaccacttcccagcatctattgcagattccaccctcaaacattttgtaaggaccctttattcaaggtaatgtttgaaccctgctgagccagtggcatgggtgtctgagagaatcattaacttaatttgactatctggtttgtggatgcgtttactctcatgtaagtcaacaacatcctgggattgggacccactttctgggcactgctggccagtcccaaaatggaacataaggaagtggttcttctacttcttttatttctgaaatcaggtaagacatagtttttttaaattataataattattttttctcccacaatgtagtaaaaatacatatgccatggctttatgtgcaattcatttaatttttgattcatgaaactcccagttgaaaatcttgtataagattgaggaattcttcaagaaataagtttaagttttcctgtgaagattgtcagggtgctggaatgaatgcgcagagaaaataatgggtgatttttcaaatctaaatgagtgcacccacataatggccagtctaattgaaaaagagccaatgtagctaactatgcaaaggacggctaagctcttcgcctggttctcagtttgactaatttatataatctctgttacggtgtcatgctcccctcacttgcaagttaaaacagtgaaatatctctttgaatatattccgttctctcaccagttcatggtggcggcagggtcggggactcagcatttctccctttgttatggcctgaggaaggctttccatcagtatacgtttgcctcttatccccggaaaaatcacacgcatccatttgccagatgctgtgtgcagatagtgatcaacaaatactcagttgcttgggttaggtccctacatttttacacatacatacatacctgtgtgtgaatgtgagtgtgagtgtgtatcctttacaaatactagcttatttagctcgtggtataggtagggtagcatattcatcctcattttataaacaaagaaatcagacttaggaatatcatgttatttgctcagtgaccaaattctcagatctgggaaataaagaaaactggatttaagccaggtttcccagaaggaatctagggctcttctcacttttcagctttgtttaagcctttgaaagaatattctaaacatgtcctagtacttctttttctttaaaaaaaaaaaagctttattgagatataattaacatatagaattcacccatttaggcatacaatccaatggatttcaagatattgagagttgtgcagccaccatcagaataaattttaaaactattcatacccccaaaaacgcactccactctccttagctgttacccccaatctgcagcttctggcaaccactaatctactttctgtatttatatctttgccattttgaacatttcatacaaacggaatcatacgatttgctagtagttcttcatgtaaataatgtacacttgaaattcaatctataaattaccagataaaattttacaagttgcactttagagtcaaatacatttgaatttagtggaagccattcaaggagctatcaaacaaaatacagagcaggagaaaattaaagaaatttttgtaagaaattggtgtatgttggggggtatgaatattatatttcaatgcatggaaactaggacatagatcactatgaacttattcagtgggctacacccaaaggctagatcaaacttctctgccacaggattaacatatgttttaacccacctggggggaacattctctcataagctcttttggaaagccaggctttctgtggatgtatcatctttccagtgtgctgcaatgcccggggagagggaaaagtttcttttacagccatgcttagtgggaagtggagaaacatcttccatttcacaaattaagtcttttacacatgcaaatatgcatacacattcacacaccacagtgaggaagaaattctcacaccattaataaaatacatttgcatcagtagcaatatacatctgcattttgcctataatataaatgtatttttccactaaaagagtttgatgtttccttgccagcaaataagccctatcaaatcctattgccatatgagtcctagaggtgaataagagaaaaaaaaatgggggaaaattatttcaaattgaaaagaaaaaagtttgattctgttttgggatatttcctagggacaggagctggggaggggatctcagcagcgatgcgctatgaagcataataacatgacacagagaacttaattgaagggggaaataaatggaagttttctttttttgaatatcagttgtagcctgctctgctatacttcaaaaaaactcttcagaaagtttaactgaactcactgtaggacacactttgtggatttattgtgtgttttgaagtcacactgtgagctatatagaattaaccaaaacacaactcttcttgaaaatgagagttcaagttggcagaaagtgcggggtaaagacatggatatgggcctaaagcatctatttctttgtgatcttttgatatatctctcaagtgctttttagtggattagctttagaatgcatcagccaactcctgctcaataatccatttttccagcccggaatgtcttaaattgaggaaggacaaagtcccagaggtggggagcagggggactttggccgaggactttgcatgaatcgatgagcatgcatccacctccctgtcctgccccttgtgctctgtgtaccctcaggaggtcaggacaggcctttctgagaatgaaaatctgttcatttgctttcctactggatacttgtcatcagcatacaaaccaatgcgctctgcagtgtgtcatctttcagaacctcccctgaccgcatgttccctggagggctcgctgtcttcagagccaggcttgtctcctgctgcagcctccactgttctcctagtcactctgtaacccaccccctctgcctgcggcccccaccacgcccctcaaagtggtcaaggttgtcctgttgtctaattccatggagcttgcctgtcttcattttattagcctcttttggcctctcacccttgtgcaaatcactagcattctgtgccaaggacggagctggcatctccaggcttggaatagagctaccaaagctcagccagatgtctggaagagcctcaggacaaggggacaccctgtagccttgtggtgggagcacagctgaggcccccttggccaccctctgccacgaccaggcagaaagcagctttcggacagattcgttgtctcagatttgatctcaaagaaaaaccaagaccagtatttgtcccaggtcctgcttttttacaatttcctccgaaatccagatacctgtcaacaccttggaaaaactgacttctccccaattagtagtgttgtgtgactgtcataagcccagtacaaaaatggccttctttgttggggagcttcttaccctccagtgttttgcccaatttttgtccaaggtggcaacataatttagttcagttcttgtttatttccaccatcatctatgcaccaaaatttatgtttctcaaggagggaccattcagaggatgcttcccaccggttcaagtgacagtgccagaaccaaagcgcatattgtaggaaatcaaacaatggcctccaagttccatttctacccagggatgaacaaatcaacatcaatcttggtaacacaactgccactgatggtgccttactcttctctcatgacatggcacaatcaatagcaaacataaaatttgttcttgtttaaggatttatatccactaatatggtaacatagtagtggttccatagttctaacctgtttgtcaatccagttaatcttttactatcttgcaatctgctaatgaaactgtttttctttgttttataatttcaacttttagagtcaggggtacatgtgcaggtgtgttacataactaaattgcgtgacactgagctttggggtacaaatgatcccatcacccaggtagtgagctaaatacctactaaataggtagtttttcagcccttgccttgctccctctctcccttctctggtagtccccagtgtctttagttgccatctttatttatgtccaaatgcccgactgtgtgttcttaactaaacattttgattcatagctacccattctacttccagtaaacagaaagttttatttggttaatgctaaccaaatagattaaaaggaagtcatgacaattagacattgacattgatttactgaccatttattccacttggatctcccacctctaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcaggtatttccattgtcgttgcacctacgcaggaatctgtaattcagatggcaagtaatttactcacaaatttattaatgatttaagaggaaagagaaatttatggagccagagtttggaactatatttgctcacagtatgtgaagccatactaacagcttcttgttaaggtttattggagtctttgttagaaaaataccctcaaaggaagttatttgtttttacaccggacacaaacattagcagttattgttctgagctccagttttcaacatcatcatcagtaaatgtttgttgaggatcaggtgaatgaaagtgtcctagatagatctgagcaatgacttatagctacaagatccagtgcctgccctttagtatttaaggtgtagtcaaagaaactggatataatgttaaaaaaaaaaaaaagacagcccaagtgaggtacaggcataatcaatgcatgctctacccagatccagaagaaagaacagtgcctaaggttgaggcagctagagaaggctcagggaggaggtgggaactgagctgggtttggagttgagagagctcttgacaagcaccaggaaggcaggggaagatgcggccctgcaccttctgagggggaccattaagagatgaagttgactaaagcagagactttgtgtaggtgacgggcctgggaaggtagctatggatgccagactgagcacccatagcaggaccacgggatggagatgggaggggtcaggggccagggtggggtggaatgtggagcagaggttcaggggaactgatcagagttgggaggtcatggagacggactatcttggggaatgggttcaaagcaaccagagttgcttctttccaacccaaaaacaaaaattaagaagatgagtgaagaagaagtaaagcagttgaaacagaaagaaagagaaaattatgagggagggaaggtaagggcagataagatttgctgccacgttggtgtattttgttcagtacttcatcaatgccatgcccaaataactgaaagaggcagcaattctgagctctctggtccctcaagatattcaatgatctttagcatgtctcacttattaataaacatttgttttctttaaataaagaaaaatacttattggatttcctgcttcgttctgcagggcattccaatatcacagtaaagagcaacaatgtgtgataatggctgaaaacaggaagtcctccataatcattaggatgagagatgtagttttatttgaaaagtaaagtgagtacattttcttcctcctcctcctactgtcctccccatcctcccactcttcctctttctctattctatctttaatttatgagaccagaggaggaaggcgctatggtgttgtaaaattgaattctgagttaggacaggatttgattactaactaaccatgtcagcttgagtatattacttcacctcctagatttaatttttttttgttcaaaaaatgaaaggattagatttacaaaatcacttctacctctatgaccctgaaaataagatttttaaaatattattttatatttaacaaggagatgggaagtctaagcattccttttggtcttggcttcttattctgcagggtgaccatggtccttgggccctaacatctggatgaagccttgtaaaacagaaatactgaggtgttttaatcctcagaaacatttagattgggacacaaatcttatttttactcttaaatttttcacattttgggggacatggtctatatttttctcagatttctgaaatgttgtcttttaaaaatgtgtaaaagttacagttccttttctatagtttattttaaaatgtgggtcaatagtcccactgcttagaataagaggcagacaggatttcaatagaaattgcatgcctttttagatgtgcaaatgtttcattaagcatttcccatcaagtatatcccatcaagtatgctcccattaagcatatcccatcaagtataaatatttgaagggatgcatgacactttaaaaactgtttcctctactgtgttggtagccaggtattaagactgttaatagtaacaatttagctctccaaacattctgcatcccaggtgttaaagaggactggaaacaccttagttcttgtattcttgaggatgatttgccatattgtgtctagtattacggcaaaactctaagtagcattttaaatagtatttatttgggttggaattatttctatgcattgactcatcttcctgggtttcattagctgtacgcattgtacttccttccttaccactatttatctcgaattcttgagattaaagtgcagattaaatctaaactttatctggtgaagttattagttcttacaagtagcaagcaaacggtaaactaaataggatcacctaattgtaccagattttaaaaaaaaaaaaccctgattctcctgattctctctacaaaatgctaacatttaaatatgtcatttgtaaattgttaaccagaaggaacatgggaatgactgtaggttgagtttgaagtctgaagtttgaaggcttagtttgcttgttttcaaagtgacagaagggagcaaaaggttatataaactctgatgggtacatacaaaaaaaaaagaagtgaaaagtcaaaagtcagtcattttttggtccttgtttctttgctgtgggatattgacctgctactaacttacctgccagggttttgccaggaacagtcagtgttagatcacatttacttctgccacttgccaccagccacactgccttcaccaagtccaagaccctatcaccactggttggggctacttgtagctgtacacatgatctctaagaaatgtaacttccctgtttaaagcccttcctagtgcccttaaaataagacccaaagacttcccaaatgtgctagggcccagcattatttaagtaacccccagctgctgtttgcttggcttgctaaacttttctacactggccttacttctgttccttcaccaccccaagcacacaccctcctgcctgggaccctcttcacctttgtcctgctgtgccagctccttcttatctcctaggtgtcagctcaatcatcatgtcctttgcaaatcttccttgacccctagacctccctttcacaaagtaccttgagtttacacttttgatgagtgtcttatgtctactgtaatactatgtcccaatgaagatgtacttgcaatcataatacgcagtattgggttaaaagcattagtttgctgtaggtatgttaggagcactttccccatgtgattgatcaattaattaaaaaatggctaaagtgggtaaccttaaatgatggtgcaaatataccttaaacattttatattttcattgaaaacacaagtgtacttgacaccttttgacgtagagcagaggcttttcttcttcgaatatggggtcaccagtagaaggtctctggtgtatttcctgcataaactatgctccagtgcaacatctacaataattactttccttatttttgaagtggaccatatctcgacatttattaatcaatctgaatgtgtaaaacctttagatttttatgaattcctcctcaagctttatagtcaactatatgagtggattgccctctgtggatttgatagcaattttttaaatgattcatgtttcaacttgttaaaaacatttaatttagttaaaaaccaaacaaaaaagagctttgtttcttttcacattcatttctcagtttagatcatctttaattaaatataaatgtaagaaagttggaaaatgcaaagaaatgactcgttgtaagcacataactcacgtggggggaacagacatgggtgggcacactagcaaacacctgccagctgcatgtggacccaggtgggcaccggactgttttaaacacaggagagggcccgttgtctaactggtgagttggttgagtggaagctggttgagaacttttactgcaaaccatttacagtagaccacaattttatagccctgtttggcactttttcatatcactgggagcctgaagaaatagaagtgggttggatctctttcagcctctgaaaagcctgccattcccccatctaaaaagccctttccccattctctcactctgtctcatcatgtatgtaatatgtatcatcattaagtgatctcattttatattgtttccttgaatatttcctgtaacccccctgcctgattccactagaatgtaagctccatgacggccaagcctctggctgcactgtgccccgtgtgtccccagcatcctggtggggctcgatacacagagagctcataagtagcatttgaatacatgaatcaaagaatggctcagtttactgcagcctttttgcagatgcaaaagatgatcttttagaaagcagaaacagggggtctggtgcatgagatctttttctcaacgtgactatgctgtgcagaccttcacgtggtgtcttgtgaaagactttgaccactgtgtggactttcccttcagtgtatctctcagagtgcaagactgggaatggaaagaactacagagggacgatgtccaaaacaaaaaatggcatcacctgtcaaaaatggagttccacttctccccacagacctaggtaagacattccctttcatctttgtgttcatctactgtaaagttgtccctctgtgtctgtgagggattggttccaggacccctgtggctaccaaaatccatgcttctcaagtcccttatataaaatggtgcagtatttgcatataacctacataccttctcttgtataatccctaatataatgtaaatgctatttaatcgttgttatactgtattgtttttatttgtattatgttttattgtcatattgttattttctgtcatctttttcaagtcttttccatccacagttggttgaatttgtggatctggaacccatggatacagagggccaactgtatttaggataatttcatcacttttaattcaaaccacaatatgtgaataagcagatagaaagaatctttttgatgtcgatgttcaactatttttggcaccatagtagaacatggttgctttctattttttcttggatatggaggtttcttgaagacctagaacatagaagaatgcctagtttaaaaaaaatcaatgaaactatgagttttaggccaaatctgagaaaagatcaaagatgactatgtttgggactgaagtaagcatatcaagttagaactctcatcacatgttcgactcaaattgtggagcaaaagagtaaataagatataaaaatgaaaatgaagatacgtgaaattcaaatgttgcaacttgcctattatttattttagtgcatttttttgtacttttcccagtttggtgttaggtggcattaagttctcagtaatgacgcttatcaaataggaacttagtgcttgttactcacctttatccattcccccaacactcaacaaattgcctttgctatatccctatgagatgagcagatcaaatattccccgtgagttaatgaaaactgattcaaccaaatggcaaagtcagagactatcgggggccatggagacactctgggccatttttatgaggtagtctaggctcatctttatgagggaactgaggtctcggggggtgggggttatcccaaataggttcacagaagaaccagaaataaaacctgcctttctagactgtaagtcttgtgattttcatctaaatggttgtctctatacagcaactcatctctagaactgaaaataagcttaaatccctcctccatccccaataattcaagctgcatttcagagaaaaccaggactttggaatcagacagatcaactttgaattcttgatctgcttcttcatagctatttacacttaggcaagttttgttttgttttgttttacgttgccactcagttttctcatctgtaaaatagggataataacaccttcctcaaatggttttattaggactaaaagagagaatgtgtggaaagatgttagtggaattcctggcagatagttcacatggacaaaatggtattaactacaaaaatttttacagagaaaacggtaactgacaaaagcaggtgtttggaatgaattaagaccatggcagccttttgaggcctttatatttctcctgactgtgcaataaaaatattttggctctctaagacttggctgtcacagtagcaatggtaatattagctactgtgccagaagcagcctatcaatagagaaattgaaaatctgaccacacaaatgctgcagcacccagctgaaatgcatttggatgacaatctcagatgggaatcgagagcatctccttctgccttgctaatagcaagctgatttttagaatatagtctaagtgcttcttttccatcctccccagattctcacctgctacacacccctcagagggactggaggagaactactgcaggaatccagacaacgatccgcaggggccctggtgctatactactgatccagaaaagagatatgactactgcgacattcttgagtgtgaaggtcaggagtggttctagaaaatgttttcatttctgcccttcacctgtaaaataatttgttgtaaagccccttcccacagggatgttattaataattgagtaacgtattcacctctcgg

SEQ ID NO: 14911 - DNA, 43133 bp, Human
atagtgtagcttgtacttggaagtagtaaaaccagatttctttataagtatttatggtacagaccttttcctaaatcagactgcagacctttcctgagtatttctaataaagtctgcttacattttttttttggcctgcatagtagtttgtgctatatatactctctagaaaatgtaattctggatatttgtgccataactttcaattaatcaaaatcttgtcaactgccatataggccctcatgttacaaaatgtggaaagttcagttacttaaagagtttggctgggcattgtggctcacacctaatcccagcactttgggaggctgaggcagtcagatcacttgaggtcaggagttcaagacgagcctggccaacatggcaaaacctatctctactaaaaatacaaaaattagctgggcgtgatggcacatgactgtaatcccagctacttgggaggctgaggcaggagaattacttgaaccaggaggcggaggttgcagtgagctgagatcacgccactgcactccagcctgggcaatagaatgagactccgtctcaaagaaaaaaagtttaagccagatgcagtggctcatgcctgtaatcctagcactttgggagaccaaggcaggaggattgctcgagcacaggagtttgaaaccagcttgggcaacaaagtgagaccctgtctctacccacccgccccccaaaaaaaagcaaaaaattgaccagctgtggtgctgcgtgtctgtggtcccaactacacaggaggcagagagaatcccttgagcccaggaggtcaaggttggagtgtgttatgattatacaactgcactccagcctggatgacagagcaagacctaaaaaaaaaaaaaagattttaaaaaagattgactaagtgaatgagtcctcttcttgaatatcagtcattccaggagagtattttcattaacatatttatgtctcttgttgaaagtatccattaagagcaggtagcaaaagctagacagaatatgcttttgaagattctctatgctctttattaatacctttcttaagtttctcaagatctccttttgcctccctcttgatcttaaacgagactgaagtttaagagtctttagccactctgtccccatagggatgcaaatttatgatttcagaagttccagcccccaataagaagcactgtccaatcgtttgcagatgtatcttgtaagccagatttcatgacagataagtccattccactgtcatgtgccatgtttaaagtactaaattaggttactctgtagtcaaaacaagtaagccctggtccagactactctagggcaaaatcccgttgcactgtcccttttgttctgcccatgcattcagttgtagctttcccttttgccagttgacagatagtgacttctttgcaaaacataaccagattaggttatttttagtaaaccaactaaaataaaaaattcttgacattgggaagaagtattttaacagaataatagtaatgtttttattgtgccattgtgattttctataaagaaacacccaatattcattatttatatttttttaaatttacaactctttaactgtatccaacatttcactgccaggaatatagtcaggctcgaagcttttttagaaacccatgatccaatccataccaacacttcctttagtttatggcttctgttcatttgcactgtccagaaaggtactgctaccatttgtagtcactccaaaaaaaagtgtgaactacctaggtataactctcataagacgtatacagcagcatctgtatgctgaaagttaccaaaaaagtattacttgcagatgattttgcaccttagttcccaagtgcccctgtacagaatatggagcttatgtcctgtctctctttgaatgatgagtgatgaaggagcttcagatgttactgggtgagcttgtattgagtgttacaaagagaagtcattctgcctttctttggctctaattgcagaaagtgaagtcactgcttttgctgtcttggatcaagaccagaaagaaattattgataccaatggagctggagatgcatttgttggaggtacagactaatttatttcattcttacttacaagtaaaacattttaacccttgtttctaccatataaccaagatttattcatttagtaacttctaatttcttcttttaaataattaacttctgaagttctttccatatacttctatcattgtcagtattagagggttttaccagaggaaaaatatgtgtttggaaaagataatttgctactatgctgtaccccagtcattttcacaagattaattgtatctgtcagaaaattgcataaacaaactgcatcaagtacagtatatagtatattcatagcccttcaggcttaaatgttaacacatttttgttctttaaaacaagttgtgatgaatattaaacagtatgctaataactaaggatgatgtcttttgatgataatcctttggttaaaacatctgtttcaaacacaatagtggttgtttgttatactaaaaagggttaaatttttgcctatttttggctcaataagaactggcaaattttatgtgaactaatgattttggtaatgaatactcaaaaataaaatcaaaacaatagaagacttggcttgatgacttagattgatctaaaatctgattcaaaaattcttttgataagtctaaattccttctagttaagtgtagttaattaagctagtttatagtctctagaaagctttcgcttcctcacagataccccaaaggggtctttcctggtctctgtttctttctcttaacatcaagccagaccaggttaatttaaaaaaaaaaaaaaaaaagcaagcaagtggagctgatgattgtccctttttctctggaggataatttgaatcatgggaaacttatttaagtttgtgtgatggttttaacttaatattttattttaatagtcttttgccaacataaatttttatttttctttctctaaaactattcatgcccagtcttttttttttttctcccaggctggtgtgcagtggtgcaatctcagctcactgcaacctccacctcccgggttcaaatgattctcctgcctcagcctcccaagcagctgggaccacaggtgcatgcctccacacctggctgatttttgtacttttagtggcgacggggtttcgccatgttgggcaggctggtcatgcccagtcttaaatgaactattaaccattaggatgccccatgcccttgttctttggaaagagtctgtaccacagacaacattctacttcactgttatgattgtgttttttatttccttgctcggaaagtcttcattattgataatattagagtacttagcagccaattttcctattttttactttttagagctatagatgtatgtaggctaaaatattttattctgaatttaaccatattctgtaatacattaagaaaaccctagtgatttcttggttagaaattggtcaaaccaggaatcttagtctagaaacttttaaacttatacactgtatgtacattacttaagtactttaaaatctttaaaacatgaagtattctatttctttgacattcagtgggacacataatgaggccatcatagatttgatggtgacctaaatagccactacctctggccttgggttacttggcttcctggcccggcaacaacagattctgttacagacacctaactatctgtaatgctaccgatactaggtgagaacatgtagactttttgagggagggagaggccattcttaggatactgaggtaggaacagctagctaccatttgtattgtggttacaacgataaataaactacttcatcaaagcaattgggatttttttgttagaggatttttcagcctctttttatcctacttcattatatttattgttggggtatagttaggtaagcaaaaaagaaaaagagtatagaacagggatccacagtcgtcttttttaaaggccaaatagtgactattttaggctttgcaagtcatatacaggctgtattgcatatcttcttgttttgtttgcttccttgtgttttgtttttttacagcacttttaatacgtaaaaacctttcctagctctccagctgtacaaaaacataccataggccagagttggcctacagactatagtttgccaaaccctctttaaatcatgggcagcttcctcactttattcatttctagcatttcaaagctccagacactggatttcactatacattgttgaaatcagaatagagaaagtagaaagcaggtagaaactaggcaggactttactggtaatacaattagatagccatttttctcactttgaacctactcagttcccagggtaatcagatcccaaaacactgggtcatgcaatgagatgaacatcctaatgtcagtttattaatagaatacttatgttgccatctttagcacattctgtcaaatgtgaatcaagctacaaagtaatagcaatagataacttttatacagtacctactaaccaaccaatatcttaaacactttatatatatattaactaatttagtgttcacaaaaacttcttggggtagattatttttacccctattttactgatgaaaaaaacagagacaaagaaaggtgagataatgtgcccatagtctcatggctagagagtagcagagccaggattcaaacccagaaagtctggctccaaagtcagtgcttttactcaccacactaatactgcttctctaaacatttatgtaaatctcaccattagaactgagaaccacagaccagccttcctgacaaaagctggttttgccagagaatcttcctgttatctgagtagatgacttactttattgaaaaggatctgttgtaatctgacagggttctggggactctaaggtaagattgttgaggaaaagaaagaaaaactgaaagggaagagaatccaagaactgtagtccctggtgagtttcaaccaagagctttttgctaagcagtagaatcgattgcactacagagatacagaaagccagatgataaacttgcttggttagcatgggctccaaataagagagttatatgaatcagctgtttaatagtgaagcaggatatttccctaagcccttctcaggcagaaattgcagtgtgtgggcgcaggaactagccagccactttggtgccagcaggagcgaacttcactcactcgcttctccactgctcacaggagggtgagcacacgtgagcaggtgcaggagctgggctgagcgcttttgggcactggtaagagcgaactccataccagaccagtggcagcatctaagggaagctgcccgtgacccctggatccccagaggaagcgttacagtgcccttttagctttgctgtctgtagacagcttaagcattaacagctcagttgagtgaccctccattgtcaccaatgtgacagccctttgcacccacactcatggcacccgagttcttgtccggcatccaggataaatgaggtcacacaaacgagttggagatggtaaatgcaggggattttattgccgatgaaagtggctctcaacaggaaggggagctgaaagggggatgaagcaggaagataatcccctggagtccggtcatccccagccagactcctctccaaagctatgccatcaagctgtccctctgaagtcaagccgcttctctccgatgtccaaccgtggtctacaacatccagctgcttctcctcttctttctctgttggctgagcctggggtttttatgggcacaggattgtgggtggggtgggccatgggtgattttggaaaaggcaacatttgagcaggaaaacaaggatgtaagttctcactttgggccatggtattaggctttttggctttaggatggggcgctcaccagagacctaccctcttctgcccagaaatttgcctgcctcctgtccctatcaatagcacccatctaacaactgatgcatctatcttacaacagaaatggtcttgttagttggaaatactaaaagatccattggttaaaaccccctgctccctctccacaccagcaggagcctttctactgggattggaaataacagctgttggcttgacacagtggctcacacctgaaatcctagcactttgagaggccaaggcaggcggatcacttgaggccaggaatttgagaccagcctgaccaacatggcgaaactctgtctctactaaaaatacagaaaattagctggtcatggtaacatgcacttgtagtcccagctactcaggaggctgaggccctgcccgtatggaaaaattaacaaaatggatcaaagacttaaatgtaagtactaaatcagccaggtgtggtggctcatgcctgtaatcccagcactttgggaggccgaagcatgtggatcacttgaggccaggagtttgagaccagcctggccaacatggtgaaaccccatctctactaaaaatagaaaaattagccgggcatggcgttgcatgcctgaagtcccagcaacttgggtggctgaggcaggagattcacttgaacccaggaggcagaggttgcagtgagtcaagatcttgctactgcactccagcctgggtgacagagtgagaccctgtctcaaaaaaattaattaattaattaattaataaaataattgtcgttgactccttccaccttgggaatgaatctcaggcagtggcaacttttacatttactatgtagtttatttttcttcgcttcattgcccaattaacatatcttctttctgattgacacattctatatttggatggttaatatattcatcctgtaactttcaagttttgctggcctaagagtatttctgtcttttgtgactttgcatatctatattttagtccactttgtggtaatttaactctctgaaggacaataattttctttgcataaatttcaagttttggataaagtatcactccagctaccatgtgctaattatctatatcagtaccagagtgccatgtgttcctttagccagctaaaaagatatatgactacatcatggattttcatgtataatttaaaaatgagtaacccaaatgtacataaattaaattaaattaaattcgtagttccatctcacgggtttagtgacagtaacaaatccctccagcctctacaagcatcgctccttgttctatttggaggtcttaagcactttgtgatatttgttctttatttgtcactgcccagccctgatagaactaatcttttcacattcttcctcaaaagcccaagtgctaggattgtactcttggaaatggatacaattctataatctctaagtatgatttcctaatttcctaggtcaggaaaaaatttcttcctgttgtcctgctgtgctttgtcacagcaggtctaccttttcatttggaaccctctttgtcactgccatagtaacaaatggaaacattgagaacattttgtgacaggcactgtcattgttcccagtgaaatctcttcccctgtgtcttcccagtaaatgaaactgagaagaaaaatcataacaaataacatgaaagaggacctaatcaatatgttcccactgggctgtcaataccagcctgtgttaatctaatatgatttagtcatatgttttatggcagctgtgggaatatggacaggacctacaaatcatctttagactgaaagtgagtacacctttgacagattatgtgtaggcacttatatacaactctcagataaaagactagagacttcacccaagaaccaacattcttagaattaaaaaaaaaaaaaaacaccttcattaagtatggttaaaagccacgtatagattagaagattttactttgttggttttttttgttttgttttcgtttttgttttgagatggagtcttgctctgtcgcccaggctggagtgcagtgacagaatctcggctcactacaacctctgcctttcaggttcaagtgattctcctgcctcagcctcccaaatagctagaattacaggcatccgccatcacgcctggctaatttttgtatttttagtagagatggagttttgccatgttggccaggctggtctcgaactcctgacctcaggtgatccacctgcctcagcctcccaaagtgctggatttacaggtatgagccactgcacctggccagaatattttatttggaatgataataaagtaactgtgctgactcataatactttttttggagggggagatggggtctcactctgtcacctaggctggagtgcaacagcacaatcatagctcactgcagcctcaaactcctgggctcaagccatcctcccacctcagtctcccgagtagctgggactacagggtttttaaaaaatgtttttgtagagacagagtctcactctgttacccagtctggtcttaaactcttggcctcaagcagtcctcctgcctaggactcccaaagtgctggattacaattgattaaaatgacaattcatttgggattacagacatgagccaccacccccagccagaatactctttattttaaaaatcctcacaacagcttcagcagagaaaatgtattacccttaaaaatattacctataatatgcaaatgactctgaaaaccactcagcaatcacaatgcaaataattctcctatttcccatctaataaaaaggaacactaattacattctctaggctgggagcagtggctcacacctgtaatcccagcactttgggaggccaaggcaggtggacagcttgagctcggcagttcaagaccagcctggacaacgtggcaaaaccccatttctaccaaaaataaaaaaattagctgggcatggtggcataagcctgtggttccagctactccggaggctgaggtgggaggattgctggagcctgggaggtcgaagctgcagtgagctgtgattgcacccctgcactccaggctgggtgacagagcaagaccctgtctcaaaaacaaacaaaaaacaatttcattctctaattcatgtttagaaaagaacattggtttacaaaaaatttttaaagagttttttcagaacaaggatgccacttcctcttcacgtggcacctatctatacttctgagaaccatgaagactctctaattatcttcatattttatatcctcaccttgtttctttggtcccaaacatttatagcttccttccccattcttcttaattgctgcttcattgtgctatgcatagaagtggtgcagaattcttgggatttgttttttctacactacccccttcctttgctctccatctcagaagactagaagacaacttggtaagtgttgaatatattgtttctcagacttcttcactcaaaaaccaaaaccttcatatgacccacatctgctgaggatttacttgatggtgaccaagatgacagctgcccactgctaaacaacccaatgtcaacaactctttttcttgtctttctgctctaatgggacatcttctctgttttatttcttgaacagaaatttttcttaaaaccatcaaatgaacagtgaaattggcttggtcattaggaatatgaaacagaccaggcatggtggctcacacctgtaatcccaacactttgggaggcagaggcaggaggatcacatgaggccgggatttcaagaccagcctgcacagcacagtgagaccccagtctctacaaaaaaaaaaaaaaaaaaaaaaaaaaatagccaggcagggtggcatgtgcctgtagtcccaactactcaagaagctgaggtgggaggatagcttgagcccaaaaggttgaggctgcagtgagctgaggtcacgccactgcactacagtctgggcaacagggggagaccctgtctctacaaaaaaaaaaaaaaaaaggatatgaaacattcaccacagatagtagttcaggttcatgcaacagaaagcaagagagagctatacccttgcacagtgataggatgctttattacatgccacactagtgttatacatccagagtcttagtcaagctgaagctagaccagcaccaaatttcataaacactgtctatgattatttgagccttcgttagttaaaaaaatgtaaagattatcctctccagccatgatttaaaaaaagagagagagaaatcactttgttcatgtgaaatacaggatgattttagagtgaagcctgtaatttctcatcaacgcaaatgttccctcaaagacctaatatcctgaatggccttcatctagaagcaattgtaaatagataatggaattgaaaggagtttatcttctgggaatgtggataagacacagacagtctgaaccatgtaggctatcagactccaaagctcagatgtgaaacttaggtttcttatatttgatgattattgagaaatatttattctaagaaaatgatgttgatatggaaatttttatttagttgcagaggtccacaggaaatgtagtaagtaaaatttctgaagttcattttcttaaacagaattgtgacataacaaaatatatgtgtgttagttccctgacctagaatattggtgagccaattggaagtaatttgaatcctaaaattctctcagctgctattaaatgaatctggtcaattttacctgtctgatacatccaacatgtatcagttagcttttactgcataactaaccactttcaaaacctagttacctaaaataacaactcatttatttagctccacaaatctgtgggttgacagctgggcctgtgcttacctggacagttcctctggccttagagtgttgagagattaagtaatttgcccaaggtcatattgaaagctaagattcaaactcaaaatttggcctcaaagttcttagccctagccattttgctatactcccttttattactacaacatcttagcttcctctctaaaggaggagaaatagccaaagtggttttataaacactggtctgtcgactggtaccagtctatgacataagagttttcatcagtcagtatcaaaatgtaaaaaggcaggggcaagaaagtaaatttccataaaactaaatgtattcagttttaaatcttgcccttcctactttgagggagttcagttttctttctttatgaataatgttggtaatagtggattttttaaaaatgttcttatctagcagaattaaagtttgccagctctgtgtttatccctaaaatcttttgggcaagtttcaatgttctgtgaaatcccaaagtctgggattcactgatcaaccatattttttcataaattctacaaaattatttggccttttttttttaatgccagtaaaaaattactgatgacgtgaatgccattcatgttgggcttttctaatatctggcccacttcttcatataaagaagatgagtataggccaggcgcaggggctcacacctgtaatcccagcactttgggaggctgagacaggtggatcacttgaggtcaggagttcgagaccagcctgaccaacatgatgaaaccctatctctactaaaatacaaaaattagcaaggtgtggtggtgggtgcctataatcccagctactcaggctgaggctggagaatcgcttgaacccaggaggcggaggttgcagtgagctgggatggcaccaccacactctagcctgggcgacacagcaagactccatcccaaaaaacaaaataaaaagtaaagaagacaagtatagaactgtaagttctatacttactgtaaacagatgagtacaggccgggcacggtggctcacgcctgtaatcccagcactttgggaggccaagacgggcagatcacgaggtcaggagatcgagaccatcctggctaacaaggtgaaaccccgtctctactaaaaatacaaaaaaattagctgagtgtggtggcagacgcctgtagtcccagctactcgggaggctgaggcaggagaatggcgtgaacctgggaggcagagcttgcagtgagccgagatcgcaccactgcactccagcctgggcgacagagcaagactccatctcaagaaaaaaaaaaaaaaaatgatgagtacagagcaataagtataatatgatgtgatttgtattttgttaaaaatggtcttatgtgtgtatgttgtaggtatacttataaaagcatataaaagttccaggaagaaacactccaaacagctaacagtggatgtactgggaggtggctgaatgaaataatcactttctactctgtatgtctgaatttttttttttttacaatgtgcccttattggctttgtaattagtgtaatctttaaataaataaaatcacatgtgtgtagcactgatgcagagcctagccaaccttagtacctagcagaaatcttcactgtggtaaataagtcatcagacacagcatttcaaactatacgataatttacataaaacataacctctgatgttttaaggctacttatcagcaaaggtctgaataaaacaaaattagcagcatgattgtcaaattaacagctactctctcttcagatatataagttctgaaaccaggggtataaacacaggcttttaatttatttttcatttaattatccaattaacgttgacattttatagaatttagatatatttctagcccacaaagtaaatggcaaattaaaaactgatttctgtcatcaaatgctcttaaaattttagaaccatcatgctatgagaaattttcagttgatcaaatgtaggtttttgaattgagttaaataataacaaaatgatccttcttatgaattagggcataagcacagcttcacataaacaatgttaccatcatcttatcccagcagctattactttgccccattgaatcttttgtttttaactatatcatttagagtgtttgtgctgaaaggaaaattttaaaaaatcatattttctggttttcagtttccagtagtgaaactcttttcaaatgagatcttatctgaatcagaatgaaatgaacccacaaaaattaaaaattaaaaatgtttttaagaaagaatgaaatgagattaaacaaactcccatttgtccctatccacattttatttggtggctcatgatgtcacgtaggaaaaccatgacctattcaaaagcccctatttgatgaatgaagaaagtaaggcccaaagaaaggtaagatgagttgtccaagggagttaattgcaaatacgagacaagaagccagattactgaattcatgaagcagcagttacttgtgttcataatccaaatgaaagttgtcagttaaggctgagcgcagcagctcatgcctgtaatctcagcactttaagaggccgaggtggacaaatcacttgaggtcaggagttcgagaccaccggccaacacaacatggtgaaaccccgcctctactaaaaacacaaaaaattagccaagcctgatggcgggcacctgtaatcccagctacttgagaggctgaggcaggacaattgcttgaacctgggaggcagaggttgcagtaacccaagatcacgccactgcactccagcctgggcgacagagtgagactccatctcaaaaaaaaaaaaaaaaaaaagttgtcagttaagctgtctgttatttagtcctcttggaaacatataggtcaagagtcaatatcccaaatgcacagaaggaggggttttttgttttgttttgtttttgtcttgatgtttgactttaacaataaacagaagcatacgctaaacttttattttgggaaccacatcaaaagatcacacattagctttaaaatcaaatactgactcagtgttgtacatctatgctccatgaagaagaatgacttttaaagcagtgttttgaaagggattagggtgaaagggcatcttatctatatgagtgcaaaatactgcttagcagtactcttcaagagctttcttccgaaattaagatcatttttaaattgatgggcttttggttttgtttttaattcaaatacaatgtcccataccatgttaacagaacttagtaagcttccatttttagccaccacaaagaaggaataagaagttattctcaaagctgtagctataggacaataaagttattctttcttatagctacagtactgaccacttgcctgtatattacacattgcttctcagttgctcactttatgtgggagggtgtgttgtgctgaactatcttaaagcaacctttgctctaaattgacttcctgtacatgtcaacaattaacaccatctgacaccaattaagctttagttttcttttcttttcttttctttttttttttttttgagacggagtctagctgtgtcgcccagaatggagtgcagtggtgtgatctcagctcactgcaacctctgcctcccaggtttgagtgattctccagcctcagcctcccaagtagctgggactacaggtgtgcaccaccactcctggccaacttttgtatttttagtagagacagggtttcatcatattggccagaatggtctctaactcctgacctcagatgatccacccgccttggcctcccaaagtgctgggattacaggcatgagccactgctcccagcctggttttcattatgcaaatacctgctaggtcagaccttaccctggcaggcacagtagctttttcagttatttcaaaatttaatatttattattttccctgaaaaatcagttttctaaaatttgggtcacaagttgttatttgagttcatgactaattggtagtcaatatgaagtcaaaacaaaattttactaactagactacatagaaaatacaaaaagtttacatctgagcacttttcagcagggggaaaccattactttgtcacatctggatattctaagctagccaaattgaagtgggaatttcctgccagatgttagttctttgagcaacctgtgaacatctaagtaagtgaggggttatgagtccttgtttggtagagctatacccactctggaggcttgctcctaacaggcagcagacattttatatgtactaccaccagtcaggaggttgtgcaacctatttgaagtcaatatgatgtgctcttgttaaatgtcaaaacatccaaggcctcattttgaatgtacaacatcagtcttacagatattatatccagggtgaacattgcattgaaatgtcctcccaaatgtagatgacaaaaattttgtttcattaatagaaagaaggtaagactgaaacaccacaggtattccagataacttggatagggccattttgtaaagtcagtgtagaccaaaatatgtctctaaatatgagggaaataaagaatctgaaatgacatgaaaaataccaagtatttatatcaacctcctgttctagacgcacatgggaattaggaagtgaaaatttcattcagaagagctgtgcacaaaaagtggaaatgcattattcaattgaaacaagtaacatttttaagggggataaaatactttctacatgatctcactggttttgtcgtcctccgtaagggaaaatattgacatttaccagactgtttgctccagctttctgatctcctgcagtttatttttataacaaccttatcgatgggcctcttacccagctctctaggtttaactgagttgagtcgatttgttaccacagcttcaagtagctgttacagaacaagcaagacatcctaataaagctgtaaacgtgtttactcaaacagagtattgattttacttggaggggaagaagccggttcttagcacagtgtcagggtggatgaatttcactgcagtttttcattgtcatctgtcagggttgtgaaacactaagtaaagccatcagaggataattagaagtaccagaagtttagcccctaaaatcagttaaccacttgggagttttgtagcttaattagcttttattaaaactttccctagtattaatagccaagcacttttaatggtatttccaagtagatcaagatatcaagattgtgacttgttaaatatatgaatttaatggctaagggtttttcagaccttttctcactctaaattaggctaccactagaacataattagaaccaaaaccaatgtaaagatacagtgatctgtacttatactagcagaataaatgcatgatttttttttctgaaaaatcaacttaaaagaagtagtaaaacaattataaaataatttaagccaggcgcagtggctcatacctgtaatctcagcactttgggaggccaaggcaggaagattacttgagcctaggagttcaaaatgagcctgggcaacatagtgagactcccatgtctacaaaaaattaataaattagccgggcatggtggtgcacacctatagttccagctactcaggaggccaaagtgggaggatcgcttgagctcaggaggtcaaggctgcagtgagccgtgatcacaccactgcattccagtctgtgtgacaaaacaaagccctgtttcaaaaaacaaaaataaaacatgtctttgtagaaaaatccagtttgcgtctttattacacttaaatgtttttgtaacacaatgtgatctaaacacataaaactgtcaatgccacccttatttttaaataccttgattaaagcagattctaaaatattctagcttactttaagttagtcattgtcttaacaataaaagctgatgcacgttgtgcaaaaggtaagcatcagagtaaggagttgcttaccttctgtagaaactgcattagctactgagcttcatgaaaagcattcatgtgaacactacctgacctcttccaaatgtctagaaaaacaaatcacagttgaaaaaaatcacccacctagaaaatgaacaaaaaaactggaaatttattaaaaataagtttgaccttctctcatgatgctgcagtcaagcaaaaatgaaaaataagtttgaccattatatttaaagtacatcttcccatatctaaataattcatttagtgctttatggtaaactttttatgtcttcttgcactactgcctcggcctgtctaaatgactaataaaaattatgatatctctgggatgaccagttctaaagcctaagggtaacagactctgtcagaaagaacagcaaaagatgttgggttttctttgtctttgaaatgctttgtcacatgtttatctgtgcatatagttctaagccaaattctaccctgaattgctttaagccacaaagtagcaggttgtaaaatattgttgcataagagggcacctctagagcttgctcttctaatttttctaaaggtagaagaaattgacttttcacaattgtatttagatcattcttccatattaaggtattcaaaaacagaaaacataaaggatatggatttatgattatatcatttttatgtgcatttcaaaaggcccacaatacagtaatttattttattctatgcaattttcttgagaatgacagcatgtgagagagctcgttggatggggaggggcagtatatagtagggtagccatatttgagcttcaaggcactgtttactctgactccttcagtcaaaaggagcataaacccatttcacctagttcaggttaaggaattttttttttgtaaggaagatattataacagtggttaagacactgggtcaaaatatgtggggttttttgtttgtttgttttggttttttttgaggtggtgtctcgctctgttgcttaggctggagtgcagtggcgcaatcccgactcgctgcaagctccgcctcccgggttcacgctattctccttcctcagcctcccgagtagctgggactgcaggtgcccaccaccacgcctggctaattttttgtattttttagtagagacgaggtttcaccatgttagccaggatggtctcaatctcctgcctcctgatctgcccgcctaggcctcccaaagtgctgggattacaggtgtgaaccactgcacctggccccaaaagatgtggttttaagtcctggtaccacattaactagttgtgggactgctgtggtttgaatgtgtcccctctaaaattctagcattgtcaatgtgatagtattaagaggtggggactttaagaggtgattaggccttgatggctcctctctcattaatgggattaaggcccttataaaagaggcttcatgcagcatttggctagcttgctcttccactctggcttacccttccaccctcacaagacaccaaatgccaacagcttgatcttgaacttcaaagctgccataattgtgagacaataaatttctgttctttatgtattacccagtctcaagtattctgttgtagcagcacagactatgagagagactatggaaaagttaattctcttttttgtttgtttgttttttgttttttgtgtttcttttttagatggagtcttgctctgtcaccaggctggagtgcagtggcatgatctcggctcactgcaacctctgcctctcgggttcaagcgattaccctgcctcagcctcccaagtagctggcgactacaggtgtgcgccaccacgcccggctaattttttgtattttagtagagacagggtttcaccatgttggccaggatggtctctatatcctcacctcgtgatccacccgcctcaacctcccaaagtgctgggattacaggagtcagccacagtgcctggccgttacttaacatctctaagcctccgtttcctcatttataaaaatgaagataatgagtacctatctcatttgggttattatgaaagttaaatgaagtaatgtttataaagcacaacacctgatacatagtaaggattcattaagtgttacatattataagaggggtctcaaagaagtctcagacaagagccagaatgacaagttttcactgaaagtatagccagatggtgattgtaggttcaagtcagttctggagacctcagcagcagatactggatcttcactccagttcttcactaattaatcctactcagctgcattacgtgtctgcgtcttactgtctcacagtcagcttcccagcctgtctttgttttccattctggctcctaaaagagaacactgggttattagctcaattcactttttatacaatgtcatcagtaggacactaggagaaccataagttgtttgcccttgaacgagatgcctaccctttgttccatttaatagtaaaggttgaatttacgtgcacaaaacattctgcagtgctggaagtgatttttcttaaaagggtaatacgtggatgggctctataaacattgtgtttgcatgccttgtccactaccttcttcccatatttatagttctgaaaatgttccctacaacgtgatccatctatcatacaatacatggaacatcaaacagcttgtatctcaagctagaaacctagacgcccttcctgagtccttccattccctctctccaaaccgtcagtgagttcttttgattccgctttaaggatgtatctcaaatttgtccacttctatttctctgtcatgactttagcttaggcctgttttccacttactgtagtagtttcctaactgatgtctatgccttcactctttctggaactttattccattttctgtataatagccaaaataatcactttaggaagaagttgaattatttcattcccctgcttacaacctttccgttgcttctcactgcacttagcctaaaaatccaagctcctgtggtgatttaaaaaaatctatatgatctgctatgtttgtatctttatttcattccattttcacctttgcctgcatgatgtagctatactgtcagtcttctttcaggccttagacactttgtacagtggagtttactttgcctagaatgttcctcccctactctttaaaagtcaactcttctgtaatcatcctatctaaaatgggtcccttgactaatattctctcctgttactcagttctttttcatagtagcacttaacactctggaattgtcttatttacttatttgtttacttgtttttgtctatttcccccattacaatgtaagtttcagaagaacaggaactgtaagtgtcttatttaccagcgtatccccgggacccagcacagtgcctagcatagaagactcagtaaatattagttaaataaatgaatatatcaatcatatgcacagctgcaaaccgatttgcccctaccatcaagtaaagaccatttagtcggtatttctaggaatttggttattgaggtatatcataagaaggggttagaataagtcaggaaacagagtaggccatactttaggatcaggtcaacttggtttaagagtaacccacgctaggccaggtgcagtggcttacgcgtgtaatcccagcactttaagaggctgaggtgagacaataaactgagcccaggagttcaagaccaaccagagcaatatcgtgagacccccattggtatcaaaaattaaaaaattagccagacctggtggcaaacacctgtagtcccagttactcaggatggtgagataggaggatctgttgagcccaggaggtcaaggaaacaatgagccataatcatgccactgcactccagcctgagtgtgtatgtgactaatccagaaacagagagactgatcatactacctttagtatcacttaaaataaaggatgctgggctggggggcatggtggctcacgcctgtaatcccagcactttgggaggccgagaccggatcatgaggtcaggagatcgagaccatcctggctaacatggtgaaaccccatctctactaaaaatacaaaaaattagctgggcgtggtggcgggcgcctgtagtcccagctactcgggaggctgaggcaggagaatggcatgaacctgggaggtggagcttgcagtgagccaagatcatgccactgcactccagcctgggtggcagagcaagactctatctcaaaataaataaataaataaataaataataaaataaataataaaggatgctatggagagaatacatgtgttaggaaagaaggtagtatttaataataattgtactaagtagttatagtacagatacaaaaaatttattctcaagatcataatcctgaacatcagttcctgctgtaataggcagtaacatacaggtcagagactccagtcaagatttcataaaatatattaaagttatccagtagatctccaagttgattcctgacatcactctcaagtcccctaatacacacatcacactctcaaacttacaaatttggtttgccaaaatgtccagtgggaagggtttaattcagcagataatagaaccttgccctgtcctacctaggatctttgctgccattccttcgtttataggtgtgagtggggtaaaaagtagctcatccataaaggaggcagtgaaaatctctagtgaagagcactgagcctgggacataacctgtttcattttccacagcttctttacctcaagccacagaattgttcttagctctttaacttttgtcagcacccacatcaaatcaacaaacttgtttatttttcttctttccttactatctatcacccagaatagtggttctcaaacttgagcgtgcatcagaatcatctgaacacttgttaaaagatctgttgctggaccctctcccagggcttctgatttagtaggtccgtgatggggcttaagtgatactgaagcagctggttcagggaacacgctttgtgaaccatttctggaaagaattttacagtagattcccatttgatctctctgcaagcagtctctttcctagtaagttcatattccacacttctgccagagttagctgcccaaaagcaatgtaatatgcctcccctgtatcagagtttggttggctctctatttattatagtataaaatccaaatcaggctgggtgtggtggctcacacctgtaatcccagcaatttgggaagctgagatgggtggatcgcttgaactcaggagtttgttaccagcctgggaaacatggggaaaccccatctctaccaagaatacaaaaaattagtcaggcatggtggcacacacctgtggtccgagctactcaggaggctgaggtgggaggattgcttgagcctggaaggcagaggttgcagtgagctgagatcacaccactgttctccaacctgggtgatagaatgagaccccgtctcaaaaaaagtccatatcacatcatacaagatccttgacgatatgtccccattttgtctttcccgctgtgtccccaactcagctgacctttgactatattgcaaaataagctttgtcctgtcaacagcatggctttttttcctgcttataatgtctatctctgcaaaatgttattcattcaacacccagctcatgtcaccttctccaagatgcatttctaaatgtcccccaattgaggtgttatgttatttttaaagtgcatacgtggctttctctcctaaagctataaaaccctcaaggacaaacactgtgttttatccatctttgactcctttggtgcacccaaagcccagtacctagacattcaatagctgttggttgatggaatgaatccaggtacttctgacagattccagattttcactttcttttgtttcttataataaaaatgtagtatagaagcagtcatggcatgagtctagtaaactgaggattcagatcagtcaaagttataatttatcttattccctttcctaaagcagctagagataatgaaaataaaacctttaaaaagaatgtaacacctttaagttgactgcctcgtgtacactgtggcagcatatatctggtaatcattggtataggaggtaagtttaacaggccagtttaagacagcatataaatcatcactaaaggacagatagctaagaaagatggaaaataaacaaataattgaaaaaccagattgacccagaaatgactaagaacaaagtttgtgcagggagacagggagaattgagtttagtactgttagttgctgtaaaatatatcaggtttgctttaattacatggtaatgcttctaagaacaaaggtaattacatgataacttatgttactactcccatattatctctaaataactatgtaattagcttgtcactactatacagtgtgaagtttgatattactcatggataaagaacattggtaacttaagtgagtgagcaagggtggggtgagggatggaggcagcagggaaatcatagaattattacaatcaggaatgcaaatggttaattagatcattgcacccagtccttaaggatctgagccagagccatggagaataccaaacgagtctgaggtaaattctccatggcttgtcacagtgtcttctgaagaccataaacatacaacaaagtaagttgacaaagcacgcaacagatcaatgagtttgggatataatgcatgtaattttaaacagttccttttatttggggaggtttttcttttaagtaaatactaagaattttttttaattgaaaaatatttcactcatctcattttccaacatcctgaggttatatgtgtggcctatggggtgaggatgtgtagcactgggaactctcatttattgctggtaaaaaatgcaaaatggtaaacaaccactttggaagacaatttggcaatctcttacaaaactaaacatacttttaccatatgatctagcgatcaggctccttcgttgcccaaatgatttaaaaacttacgtcttcacaaaaacctgcatgcatatgtttatagcagttttattcataattgacaaaacttggaagtagctacatatctttcactaggtgaatggataaacattatcgatacaataaaatatgattcagccaacaaaaagtaatgagctatcagctgggcatggtggctcacacccgtaatcccagcattttgagaggcaaaggcgggcagatcacttgaggccaggagttcaagaccagcctggccaacatggtgaaaccctgtctctactaaaaatacaaaaattagctgggcatggtggcaggcgcctataatcccagctacttgggagactgaggcaggagaattgcttaaacccaggaggcgaaggttgcagtgagctgagatcgtgccattgctctccagcctgggcaacaagagcaaaactctgtctcaaaaataaaaaaaagaaagaaggaaagaaatgagctattaagccaagaaaagacatgagggaaccttaaatgcatgttgctaaatgaaagaaggcagtcttaaaggctacatactgtgtgattctaactacagtcatgcaccacataacattttggtcattgacagaccacatatatggcagtggtctcataagattataaaaccttatttttactgtaccttttctatgtttagatatgtatagatacataggtacttaacattttgttacaattacctaaaattcaatagaataacaggctatacaggattgtagcctgggaacaataggctataccatctaggtttctgtaagtacactctgatgttttcacaatgacacaatcacctagtgatccatttctcagaatatatccccgttgttaagcaactcaagactgtatatcacattctagaaaaggcaaaactatggagactgtaaaaaagtcagtagctaccatgggctggagctgtggcgcaaggagagagggatgaataggtagagagcactgaggatttttagagcagcaaaactgttttgtgtgatactttaatggtgtatattattatatttgtcaaatcccacagaatatacaacacaaagtgtaagccctaatgtaaactatagatattatttaatgataatatgtcaataatggctcatcgattgtaacaaatacacccactaactaatgtaacaggttaatcataggtggaactggggagtaaggggatgagggaagatttgggaactctctgtattttctgcttcattgttttgtaaacctaaaactgcccaaaaatataaagtctaatttttttaaacccaagtgggaaaacctttcttcgatccatcttattctactgacatcttgggtgtgtatgatggtctgtgtttcccagtgtcatcaatttcactgccttaaggtgctatggcttagacttgtgtcctgtggccagtgacctcacagtttttaccaaaatacttgttttcattgctatcacgtgatagctactctaagtatgattatccttcttaattctgttaggaatccccccggcattccctgtgagggaagtatattagtccttgaatttccgtttcaaaagatgcgtactgatttacttggtatatagcttctgtaagaggaagtttcatttgggaaagaaaggttgtgctaaggttccctcagaaactttctaaattgccttctctaaaattgcctgtgtttccctaagcctaagagtaaaatacaggaaatagtgatgatttttatgtgcttgaggaatcttctaagaagagtgaccaattttattctacttatactgatacttgtactgatttaccttgtggaaaattcatccagtggctacaattactaactcactccaaaggcatgagtgggaaactattaaaataacacatcacttagctgaaactcttgaatggttgctcttaataaccatttttctgaataatttaaagttcccatgttttttaaaaaggtttattgacttagatctgatttgaaaagtgtaatgtagcttattatagaatatttaaaacataagaaaaacaaacaggaaaaaagtcatcccaactctagaaacttaacttttttcaaacacattttttttttttttttttttttttactattttgactaaacatgtttctaaatgtacttcttggatctgactaaagactaaaaatggaaggaaacacaagtagaaattataaagtcaggatcaggccagtgtggtagctcatgcctgtaatctgaaaaccttgggaggctgaggtgggaggatcacttgaggccagaagttggagaccagcctgggcaacctagtgaggccccatctctaccccaaaaaaaaaagaaaaagaaacttatttatttaatttcctctctttaaaggtatcatatgcaaaacagaaggtttgggggttttggggttttttgtttgtttgttttttgagacagggtctccctctgtagtccaggctagagtacagtggcacaatcatagctcactgcagcctcaaactcctgggctcaagcagtccccactaccttagcctcccgagtagctaggactaaaggtttacaccaccatgcccagctaatttttctattttttgtagatacagggtcttgctgtgttgccagggttggtctcaaactcctgggctcaagcaattctcctgcctcaacctcacaaagtgctgggattacaggcatgagctgctgtgcccagccagaagttttcattttagcacagtttaatctttcactttctggtttctgctttttgtgtgtcttatttaagaaatattttctacctctaggacataaagatattttttattttcttctaaaagtcttactatttttccatttacatttaactcattgatagacctggaattctttttttttttaatatagagtgaggtaatgttatttttccaaattgaaaactagttgcctaaacactacttttctaagaagccatcttttccccatgaatttgcaatggcaactctgttgtagctcaagtttccaccttttctctatttatttatagctatgccaacaaacactgcatttattattatagatttttagaagtatttaatctggtaagactagtctctcctatcatttttacttcagtaagtgtatatgcctgttcttgatcctttgctttttcatataaattttagaatcaacttatcaggttcccaaaaacattgttgagactgtgattgaatttgtattgaatgttatcttcttctccaataacccagcatatctctccatttaggtcctttgtaatatctttccataaagttctatagttttctttattagaggctggcataacttgcatcgcttttgtatttttaccaaattacatttttaaaactgttgctcttgtatatatatatgtgtgtgtgtgtgtgtgtgtgtgtatgtgtgtatgtgtgtatatatgtatatgtatatatgtatgtatattctatatacaaagctgctctcaatgaaaatattgacaaatttatttcttcttttacaattcctgtgtgtgtgggggtgtgtgtgtgtgtgtgtgtgtgtgtgtgtgtgtgtgtgaagatctcgcactgttgcccaggatagaatgagtacagtggcatgttcacagctcactacagcctcatccttctgggctcaagcaatcctcccacctcagcctcccaagtagctgggactacagtcatgtgccaccatgcccagataatttctgtattttttgtagagccgaggtttcaatttcttacccaggctggtcttgaactcttgggcttaagcgacctgcccaccttagcctcccaaagtgctggaattacaggcacaaactactgcacccagcctccctttacaattcttaaattttttttagtcttgttactcttgttagggcttccccactatgttaaatagtattgattttttattttattttattttttgatacagagtcttactctgttacccaggctggaatacagtggcacaatctcagctcaacacaacctccacctcccggattcaagcaattctcatcccttagccaaccgaatagctaggattgcaggcacacaccaccacacctggctaatttttgtatttttagtagagatggggtttcaccatgttggccaggctggtctcgaactcctgacctcaagtgatccaccagcctcggcctcccaaagtgctgggattacaggtgcaagccattacgcctggcctgattattattattttatttttattttttatttatttatttttgtttttgtttttgtttttttttgaaacgaactcgttctgtcacccaggctggagttcagtggcccgatctcggctcactgcaagctccacctcccgagttcatgccattctcctgcctcagcctcccgagtagctgggactacaggcacccgccaccacccccagctaatttttttttttgtatttttagtagagacaggttttcaccatgttagccaggatggtctcgatctcctgaccttgtgatctgcccgcctcggcctcccaaagcactgggattacaggcatgagtcaccatgcccagccctcattattatttttaatgggactgtgtatgttttctatttatttgtaattttactgtttccctttttccacattttctgcagttattgggtatgacttttataatcagaaaaacaatattttcacttgctttcttaaaaataaataatctcttagtgaaggcctgaggggtccttataggtgtaatatggatggccatggagctgctatggcttcaggctttatatatatgaggtattgctgtctattcacagtattctctgacctttaaatttatgtggcttaaaatctattttcaatgcataaacatttgtatatttttccaggtgaacaatgtactacctagatgtataataatttaaatttagtgtaaaatgagattttttacaacaaattatatatttccaaaaactttaaaatgtttaaactctacataggcatatggtggtctactatatataaaaggtttctgggaactatttaagaagataaaaatagagccactgacatgtatttgtactgtatctttgggaaaacaatttcagcgtaatatatacttgtaaaaagtgaattagtaaaactattctggccgggcacagtggctcacacctgtaatcccagcactttgggaggctgaagtagaaggattgcttgagcccaggggttcagaccagctgggccacatggtgagactccatttctacaaaaaatagaaaagttagtcaggcatagtggcacacacctgtagttctagctactcaggaggctgaagtgggaggattgcttgagcccaggagtacaaacaaaaacaaaaaaaactttattcctccaagtttaaaaagtgcagcttgcttacttgttgacaagctgctgaatatagaatgaacagtaatagagtctactgggttttaggttccagctaccatgaaaaactattaaggaactataaatagaaaagaaaaaatggactcataaagactttgttcatttccttctaaaatatccctagcttattaagtgtctccattaaggcttccgtacccactgacaatatttcttgattctctgtaaatgacactaagaaaattctagatgctatagctcttctatagtaactacatggaatagacagcttaagttaggaaattacattgccttttgagcacaccagcaatcctacctctgtgtgctttgaggaaactagtgtagcacctcctctttttgtacaactttaacatatgtttcaggtctcatgtcaaataccagatacaatttgtcaatttattgatcacattttgtaacatcagtaaaagtctaaataaaatcaaccagaagataataggctacaccaattgttaatgaacagaggtttatttggaaagattgttccaggattcagagccagctaacaatagctctaggaacccaatttattgtcgatgagagattctcaccttatgcctcgtcagctagaggacctaaagtctataacgtctcctaaagctgggaaaagcctgagaggcccaggttgatacgcctatgtgtaacaggatagagagaaggaaccaaagtaaaaaggcaacaacaactgcctcagcatatgagttcttgatttggaaaaacctgcactgatggttcttgttctctggtgtaatgcctcctatgcctgctctcttggctgtgttgaaaagcatacatacagagctgtgctcttcattttcaagatgatgtactgataaggaccacaagccagtggcactgggaaaaagggatcctaagagactttttcttattaaacatacattcaaagtcagttatttaatattttgctttttggactcttggtaagcccaaatcttgttctaaaaagagcagacttttttgttttgttttgttttgtttgagatagtgtctcactctctctcccattctggagtgcagtggagcgatatggctcactgcagccacaacctcccaggcttgggtgatcctcccacctcagcctcctgagtaagtagctgagactacatgtatgtaccaccacgcctggctaaatttttgaatttttttgtagggacggaattttgccatgttgcccaggctggtctcaaacttctgggctcaaatgatctgggtgcctcagcctccctaagtactgggattacaggcatgagccaccaggcctgacttgtttttgtttttttgttgttgttgttgcccaaactagagtacagtaggctcaatcacagctcactgcagcctcaacctcccacctcaagcagtccttccacctcagcctcccaagtagctgggattgcaggtgcatgccaccacgcccagctaattttttttttttttttatgtagagacgagtctccctgtgttgcccaggctggtttcctgggctcaaatgattctcccatctcagcctcccaaagtgctcagattagaggtgaggcatgagccacccaacctagccttttttttttttttttttttaatacctgcaagccacatttatctgctatagtgtttaccaaccacactctggggcctgaggctgtgtttcagtgaatgaaatattaaaaagtactttgtttacttgctgacacagtacagtatttgtatctattaatagcatattgttattgttggttttttttttcgaaaaacactttattggaataatatacttaaaatgcagggaacttttaaaaatagagtgaggccaggcatggtggctcacacctataatcccagcactttgggaggccgaggcaggcggatcacctgcagtcaggagttcaagaccagcctggccaacatggtgaaacccgtctctactgaaaatacaaaaactagctgggtatagtggtgcatacctgtaatctcagctactcaggaggctgaagcaggagaatcacttgaacgctggaggcggaggttgcagtgagccaagatcacaccagtactccagcctggatgacagaggagactctcaaaaacgataataataattataaaatagagggtgaaagaccaaacatcctatagaaaaataagcaaaagataaaaattaattcacagagagatttgttctttaaagatatataaaaagatgttcagcttcacttaataagagaaatccagattaaaattatactgaaatatttctaacccatcggactggcaaaaattcaaaagctggacagtgtactatattggtgaagttgtggggaaatgggcactcttacattactagtagaaatagaaaatccttaaacctctatgaaggagaatcactaataaaactatgtatgcatatagttactcattaacctagcagttctacttctagaatttatcctgaagatacgcccctaataacacaaaaatacatatgtaaaattttattcattgtagcattgtttatatttccaaaacattggaaactatgtaaatgcccacacataggagatagattaaactacagtgtatttatacatggagatactatgtagctgtaaaaaagaatgaagaaaatctctaccaattgatgtataatgattaccaggagattttggtctctgactacaggagtctcgctctgtcacccaggttggagtgcagtggcgtgatctcggctcactgcaacctctgcctcctgggttcaagcgattcttctgcctcagcctcccaagtggctgggattacaggcacccgccaccacacccggctaatttttgtatttttagtagagacaggatttcaccacgttggccaggcaggtctcaaactcccgacctcaggtgatccacccgcctcagcctcccaaagtgctgggattacaggcgtgagccatggcacccagcctccaagagatacttttaagtggaaaaaaagcaaagtgtaagagagcatatatagtgtattacctccttttgtgttaaaacaaaaaaaaaaagaaaagaaaaagaaagaaaaggaagaaaatgtacatacatctgcttacctttactaaaagaatacaggaagataaaccagaaaacagtgaaagtggttgcttaaagggatggtgaggaggacatggtaaagagagtcactcttctttgagcatatcttttatagaatttttacttttagaaacatgttaatgttctacatattttttaaatattaaatcaataaggatagaatgtaagaaatgggactaaaactgaaagcaaactgaaaaacatgaacccaactatttccaatcttttcttaagtaaaatgagctccccaaagggggtaaaaaagagaaccaatctaagttacatgctgaacacagtatttgactacaccagagaacagaaaattaaccctaaactctttttagtagatttggatttttttcttttaaagttagggatgaagtgacttggaaactattttagatgtattacaaaagtgagtaaacaaataaatttgttgatatttttgggagctaggttctcactataaaagaaggaacatacaaataatgggatgaggaaaggcaagaaagaaccctgtggagatggactagaattggaagtactggtgtcagctcaatttctaaaataggtctctgtacacatgtatacgtatacagttatggatgtaagtgtgtgtgtgtgcatgactatgtatacatgcatacttcccagctctgttcattaacatggtctagaagcaaagagcacagctgccacccagatcttggtctctaataccattctgtgctaaaaagaaccagttatcctcagataaatggctgattccagggcatagtagagcccagaacattatgccagaacataaagaagggatcaaaaataatgtgatggcatatccaatgacacgggagccaccagcctgaacggctcccactggcaaaaactggaatattttaaggaccaaattaattaagggctgtaagggattataaaccattgatttaaaaagaattgtgggccaagcatggtgtctcacacctgtaatcccagcactttgggaggctgaggtgggcggatcaccttaggttgggagtctgagaccagcccgtccaacatggtgaaaccctatctctactcaaaatacaaaaattagccaggcatggtggctcatgtagtcccagctgctacttgggagactgaggcaggagagtcacttgaactggggaggtggaggttgcagtgagctgagatcgtaccactgcactccagcctcggtgacagagcaagactccaccacacaaataaaataaaaataattgtgcattcttattgataataaatagattttaaaataataaatgggagaagaggtaggctcttgtttatggtagaatggtgagggctgactggtaaatgtgaaaatcatttcacagctgcagttggaaaatcatcacagtatgagttgcttcagttaaaaattatgagtggatactcaatctgggagggggttgggacttttgataaagaacagaatatttatgtgatttttttttttttttgagatggagtctctgtcgcctcggctggagtgcagtggcgtgatctcagctcactgcaacctctgcatcccggattcaagcgattctcctgcctcagtttcccaagtagctgggactacaggcacccgccaccatgcccagctaatttttgtatttttagtagagacagggtttcatcatattgaccaggctggtcttgaactcctgaccttgtgatccgcccccctcggcctcccaaagtgctgagattacaggcaggagccaccatggccagcctaatttgatttgaggatttgctcagtctgtcttccttccttctttccttccttccttccttccttccttccttccttccttccttccttcctctctctctctctggtctctttctttcttttttctttttttttgagatggagttttactcttgttgcccaggctggagtgcagtgacatgatctcggctcactgtgacctctgcctcctgagttcaagcagttctcctgcctcagcctcccaagtagctgggattacaagcaagtgccataacacctggcaaatttttgtatttttagtagagacgaggtttcaccatgttggccaggctggtctcaaactcctgacctcatgatctgcctgcctcggactcccaaagtgttgggattacacgtgtgagccaccgtgcctggcctatgtgatcttaaattgtctattcacaaactgcttgttagatgcaagggaaaaaataggtactatacaatggagaagtaggacaacaccttgatcaggtggtcagaattcctatcaccagtgcacagcagatggacatgatgtgcctctaaatgtgacactttgagaaggatccatcataatgtgtgtagtagtctgcctgggtgtgcatagtctgaacttaatcatgagaaaatattagacaaatccaaaattagaatcagtctattaaaaatgggaaaataaataagtaatgggataagcgcgtcagacacagtggctcacacctgtaatcccagcactttaggaggctgaggcgggtggattgcttgagtccaggagttcgagaccagcctgggcaacatgacaaaaccgcatctactaaaagtacaaaaaaattagccaggcgttgtggtgtgcacctgtggtcccagctacccgggaggcagaggtaggagaatcacctgagcctagggagttgaggctgcagtgagccaaaaaaaattatgccactgcactccagcctgggcaatcagagtaagaccctgtctcaaataaataacaaataaattaaaaatgaggtgaggtaagttatgactatattcttcaaaaatgtccgtatctcaaaagtcaaaatctgaggaaatgttccagatttttaaaaactataaagataccacagttaaatcctgaactagactctgttccagaggagaaaatttccataaaggatattattgggtaattgactaaattgaaatatggacagtagattagataacagtgttactgaagttgatgttgatgtccacactgtagctatgtaagagaatatccttattctcagaaaagatacactgaagttttcagaagtaaaaagacattgtaaatgtaacttcctctcaaatagttcagggaaataaaattgtatgcagagaaagagtacatgcaaatggtgcaaaatgttaacaatattgtgcacctgggtagatgatatgcagatgctttttgtactatttttattcctgcaacttttttctgaatttggaatccttttcaaataaaatacattttaagcaggctaataattaaaaatctaaactaagattatattgggaaacattatgctaagtgaaataagctagacacaaaaagacaaatattgtatgatctcacttatatgaggtacctagaataggcaaatttatagagacaaaagtagagtagcagttaccaggggctagaagtaaagaggagtggggagttattgtttaatgggtacagagtttcttttggggtgatgaaaaacttctaaaaatgcatagaggtagtagttgcacattgtgaatgtacttaatgtcactgaattgtgcatttaaaatttgttaaaatagtaaattttatgttacgtatatttttcaaaataaaaaagtatcttggggatgtttacttccattataaaaggattccctacaattatttaaatataagctccctttgtttatttaaacaattttatacagctttcaagattcacatcagatactttttgaagattccacttataactgattatgtagtatctgtatttcattttagttggtttttaaaaatagattattgaaaaactgacattcaccttgggcaaaggtcttagcttttttcagcatccaggttctccacttgtcaaagcaaaagattcttcagaatacttcattcatcatctagttctcttagaaaaaggatgctggtggttttgcttcacaaaaatatttcataaacatgagctttttctttttctcacaatgatcataccaggcggaatgaagaaaacagatgttgcttataaggcgtctaatagacatgtttgcattgtaagctgatctgactctgaatttggcatctgctccattcactgtgtggactgagcattttcgcctcacagtttggcagaaaagttaatattgacttttgactgttacctgaaaacttggtgataaaatactcttactaaacctcttgagagagtgattttacagtctcagcaaatgtctttaaaatacatcattctattaaccattttaattttattctttggttgggaatacttatttgtttcatctaatacagagcattccccaaatctgactgggaaaagtctgtgtggtcagaatggtagaagaaggaggacataaatcacttataatgttctctacaggtcattataccacagcttctcaattaaccttcatccccctcaggctgcccagggcctcagggaaggcccagaagcctagctgcagcacagtttctcattattatctgctcttctgagtatttgagtgttaactgcagcagctcagcagctcaggtttcccctaaggggaaggtagcccagattcttctgctcttgacctgtcttatttgcaattatcctttttttcttttttcacagttttattgtggcataatagacatacaataaacggtatgaatctaaagtttacaattgtataactttggacatatgtgtacacccatgaaaccatcactatggacatatccactgctcccatggccttttctaatcatgccttcctgctccttctcatccccttttggattgtttccagtttggggctattacaaataaagctgctgtgaacattcatttacaagtctttgtgtggatatgtgctttcacctaccttgggtaaatacctagaaatagaacggatcatatgatatgcacatgtttagctttttaagactgacagatggtttgggaaagtggtcttagcattttacattcccacaattagtgtgtgagagttccagttgatcacacccttgccaacacttgttatagtcagtcttttcagttttagccattctgcgagtgtgcagtggtatctaattgtgattttaatttgcatttctttaatgaataatgatattgaacattttttcatttgcttatttggcatctatcttctttgctaaaatgttaaatacttttgcctactttgtgttgagttgtttcttgttattgaggtaccaagtatttaattgtgacaaagttcagattattttttcttctataaaagttgtattcttagccaagtgtggtaacttatacatgtaatcccagtgctttgggaggccaaggcgggcagattacttgagcccaagagttcaagaccaacctgagcatctctacaaaaaaatgcaagaattagaggaaagctgaggtgggagaagagcttcagcccagaaggtcgaggctgcagtgagccatgagtgtgccactgcactccagcctgggtgatagtgagacactgtctcaaaaataaataaatttttaaaaaagaaaagttcatactttttacctcttactaagtgatctttagcaaacccaagatcactaagattttcttctatgttttctcctcaagagttttaggattttattccttacatttatgtctgtgattcatttcaagtgaatttttgtagatagtgtaaggtaaaggttgaaatgcttttttttcacacaatttgttaaagtgtcctttcttgatgggattgtttgggcacctgtgtcaaaaatcagttggctatacagaagtaggtttatttctggactctgttcagttccattgatctatttgtctatatgctaataccatagtgtcttggttattatcattctataataaattttgaaatcaggtagtataaatcctctggctttgttcttctttttcaaagttgagtttttgctaacctaggtcctttgaatttccatataaattttagaagcagcttgtcagtttctataagaaaaatctgctagaatttttattagtattccaatgaattaatagaaaaattcctgcagaactgataatattgaatcttctgacctttgaacactttatgtctatttatttaggcttcttttatatttctcagcattgttttgtcattttcaatgtgcaggccctacacaacttctgtcagatttattctaaggtacttcaaatatttgaagtatgtgaagtaccttagaataaatatggataaatattcttaactttttaatcaatttttgtttttgagacagggtcctactctgttacccaggttggggtgcagtgatatgatcatagctaaccacagccgcaaccttccaggcttaagcaatcctctcacctcagcctcctgagtagctaggtctacaggcatgcaccaacatgcatggctaatttttgtattttttgtagagacaggatttcgccatgttgctcatgctggtctcaaactcctgagctcaagcaattcacccatcttggcctctcagagtgctgggattataggcatgagccacgatgcctggcttattcttagtaacttctaattgttcattgctcgtatgtataattatatatacacattaccagtatagataatttacttttgtatttttagtagagacggtgtttcaccatgttgattttgagaccctatcaacatatgcttccctggctgggtgtggtggctcacgcctgtaatcccagcactttgggaggccaaggcaggcggatcacctgaggtcaggagtttgagaacagcctggccaacatggtgaaaccccatctctactaaaaatacaaaaattagctgggcgtgatggaaggcacctgtaatcccagctactcgggagcctgaggcagaagaatcgcttgaacctgggaggcagagattgcagtgggccaggatcatgccattgcactccagcctgggcaacaagagtggaactccacctcaaaaaaaaaaaaaaaaaggaagaccagattgacttgatggcaagttgttgtgtctcaacttgagctctttagaataaatattaggggaagctcatgatgtttgggaaaagatctcccgaccgggcacagtggctcaacacctgtaatcccaggccaaggcaggcagatcacgaggtcaggagtttaagaccagcctggccagcatggtgaaaccccatctctactgaaactacaagaattagctaggcatggtggtgcatgcctgtagtcccagctattcaggaggctgaggcaggagaattgcttgaacctgggaggcggaggttgcagtggccaagatgatgccactgtactccagcctgcgtgacagggcaagactccatctcggggaaaaaaaaaaaaaaaaagacctccctaacggtaacgcacaagactttctcttactgtcaaggctgaagaatgagacaggtgcttagatcatatattggtctgacccaatatgacatttctgctgctgttatacaatactcatgtgtttttttttgcctgtgttctaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggatacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataattggacttctggagtcagactttatatgaccttaggtaaatcttcgaacctcagtttcctttttgtaaaatgagataataacccttacatagaaggtcattgagatgatttgagagagattaccaagtataagatatttgttataatgccttgtaaatgctttataagtagctgctgttattatcattatgattattttctttttgaagaaaaaaagataatgtttgtaaaactgaattcaaatcataggaaaggatttggccaggcgctgcagctcatgcttgtaatcccaacactttgggaggccaaggtgggaggatcacttgagcccaggagttcaagaccagcctgggtaacaaagtgaggccccacctctacaaaaaaatttttaaattatccagccacaggctgggcacagtggcttacacctgtaattccaccactttgggatgaggcaggtatcactagaggtcaagagttcaagaccagcctggccgccatgttggtgaaactccatctctattaaaaatacaaaaattagccaggcatggtggtggatacctgtaattccagctacttgggaggctgacacaggagaattgcttgaacccaggaggcggaggttgcagtgaggcaagatcacaccactgcactccaccctgagcaatagagtgagactccatctcaaaaaaaaaaaaaaattacctgtggtggtttgcacttatagctactcgggaggctgagttgggaggatcacttgagcccaggagtctgaggctacagtgagccatgatcacacccatgtactccagcctgggcaacagagcaagaccttgtctcaaataaataaatatataaagtcaaaaacttgtatgttgaactatagaaagttgagtactatctgtagtgcaattaatttaaatataaagtaatttgatattttacagtggtgccaaagtgatccaatggggaaaggaaaatcttttcaacagatgatgctataaaaacttgatattcataaggaaaaaaatgaatctttgaccctgatctcataccatacaaaaaattagagataaaacatggtcacaacataacagctaaaactattagacttaaagaagaaaacaggggaatattttcacaagttggggtaagcaaaagtccttggaaagaaccatgagagcatgagagcactaaccatataacaaaaatattgataaattagatttcaaaaaattagaactttatgttcatcaaaagataccattaagataccccataggccaggatacaataatcacaacacatatatctgaacttatattcagaatgtatcttaatactcttacaactcaaaaatacagatactttacaaaagaagatatatgaatcactaagaagtacatgataaagtattcaacattgttatcatgggagaaatgaatgttaagacctcattgagaatactactacactagaatgactaaaattaaaatgacaacaccaaatgttggagaggacatggagcaacattgccgatggactgaacaaccactgaacattgctgatgtaaactgaacaaccactttgggaaaaggccctcaagtttttcataaaaaagtaaacatacacctattcgttcatccagttgtttcacttctgtgtatttacccaacggaagtgaaagtatatgtccgccaaaggacttgcagcagttttattcatcattgccaaaaactggaaagggatagttgtccatcaacaggagagcagataaactgatatattcaaacagtggaataatacttagcaaaagatgaccgagtgtgatggcccatgcctgtaatcccagcaatttgggagcctgatgtgggaggatcacttgagcccaggagttaagaccagcctggacaatatagtgaggaccccatctctacagagaaaaagcaaaattatctgggcatggtgatgcacacctgtattagctacccaggaggctg

SEQ ID NO: 14912 - DNA, 60137 bp, Human; identical to SEQ ID NO: 14735

SEQ ID NO: 14913 - DNA, 110266 bp, Human
  misc_feature (1)...(110266): n = A,T,C or G
tgtgaggaactgtgcagacctgtcgccttaggtctccgccttccagagttttggggagggggctgccgtggggtttggacctggaaatggctgaaatgcaaatttctagtgccagctagcgggatgatggaacggcttgagattcagcggagcgccctgtccacctttctctgcctggagccaaggaggctcctctgggcagggacaggtgggcgagcaggccggggaaggagcctggggtgaaacctctgcgaggacttaggattgttcctgaagtcgtgttagaggtagaaaattcccctgcattctgcaaatgcttagtaaatcaatgagaatgtttgtgtactttcctcccacatgtatgtagaaatagatccgaaattatcttctgaggctcttgactaagaggaaagaaaagttaagaggaaaaatctttcaagctatctgaaagcacatgcacacaccgtgcacgcacacaccatgtacacacacacaccgtgcatacacacacaccatgcacgcacacacaccgtgtacacacacacacactgcacacatacttttcttgcttttgctgtgaatcacaccgtttcacctgtgctatctttgaagcagaggttttctttattcctcctttggaaatgatgtggcatattcttttccctcctccatttttgtcctcagtcaaagctaaaaggagcagtttttatgatgagatttggggaggctccagcagtgttgaaatcctatgacataacttgaaacatcgagtgggtacataaaaaatgtagagtttagagatttttgtattaaaggcctccctgccacccccagtcttagaaaatgtggttcattcctgtggttcacagaatctgaagcctgagattgatgagccccttcttgtgattgttttaatcattctctaaagtttgtgcattttactgtacccttagtcacagagagtactgagtgaatttaaagttgcttggaatatattaagctttcttggaaaattctctttcccttggatcaaatgggtgaacagaatattaagttgagtgtcctcttctaacttatactctgaaaatttagccagtaggtttgcatatggaaagttattggtccaatcacataccatgactataatttacataatttacatcatcattattaataaattcctgcattattcatcagaatttgcatctgctcagtttcctcacccttctacagaggttgaagacatttagcagccctggactgccatttagtcacaggggaagggaattcaggcttcgaagtcctttttggatcagctgcgttgaatgcgctgcagttgtgttcactcttcgtaagtggctgcttggcggaagactgaaagacacttctccatttgaaaatgaatcctgacaagtgtaaactggtgggaattttctgtagccttcctgggattcttttgattttgctggtctcctttcttcccaagagcgacagtgagggtgggagactgctcacctccagcccagcagaaatacggagctgtgagcagactcctccaacagtttagctttctaaagcccagttggactaagagaagggaacgaggttggttatgccaacccaagcatttttaacttgcttttgtagttgcccttgaaactaaggtcacgttgcttctgctcattgagggcggtggaggcgatagtggatagtagaagagagcacacattgcctcactgaagtggctgcacgtatctgagtcctgtagctactgttttatctctgtttcttaaaagtatgcttttaaaaagattagcctcacacatttctgtggaccggtctggtggtatcacctgggactctgaggtgaggatggaaggatttagcagataatgaaaaagaactctgtttgcgcacatttgagaggctgaaaaatggttttatcccacttgggctggagtgatttggcattggggaagattccctgactcgccaatctctttcctttagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaaggtaagtcatttaatttcacttttcaggtttgttttgggatttgtctgggggcagattgttaaggcctgttttagaatcagctacccttgcattgtaaatggggcttctaagagcaccagatcgtggtctcttggctcccggcaaggcagagctgatgagagaaggtcctttgccgcagcactgcaggcaggatggtatagtttggtggtttcttgctgtgtgtgtttctctgtgctgggtgagggagacagctgggagttggcctttatccagtgcccgagagagctgtggaagggatgaaccttgggaggatgaatgtcatctctagtctcccccagcatcattcctactgcttacaatgtaaagaattgctattttcggacaagatgaaccactaaaagaaattgccaacatctgaaatgctgacatcttattttcattgtttaaggagaaaagaagtttctgaagtttagcacagagagagaggcttgacatctcagaatttttttttagccattgtaattcataatacttaagcaatgcatcatcacagagtggcagattctagtttaggtaaacttgaaagtgaatgtgccaggggatctcctccagctccgagaacctccaagtatcacagggcatgcgccggtgtcacagctttggaaatttaattttcaaggtgtaagtccaattacgaggactacatgaggctgaattattcagcttagcagatttggaacctctctcccagccctttggagacaacgtgagccaagcctctacttggtgctgcactgaaatctgtcatcagtagggaatattggtagctgagttatttttcgagtggtaatccgagaataaaacggcagatcccagcactcatcgccacttaatgaacctgtttgcggagagtccacctggtgcctgcctggctttaggaacccgcagcagtccgagtggtgtctggggtaagctgagctgctctgggaacacatctcgtgcgtggggtgaatgaacagcacacttacccagtggggtaggctgggagaggacagagagcccagcctccttagctggatcaggacagtttaggaaggagggttgcgtccatctgagatgagagttctgagagacatgggctccccaggaagaccccaggcacttgtcattgaaggatgaggaccgaagcacttatcacctgaagcaatcgtgtgagactggggaacttttcgttacacagagggatggcagctctataattaacaggtgtggtgacatctccctacgtctctgggaagggaatctggtaggagtttgtgtctgaggcttgtatagctacagctacaggccgattatggaactgcctcttggtgatttgtgctgggacaccaggatgagtgtaatttgcagtggtgatgcatttttacagggctttcatgtaagagggaaaaagttcctggtttctgaaagtcatgcctgtacgtctttaattttgctaataattaaaatggatgtttccgtgattgctggttttcccttgagtgcgtggctcggcaaaaactgaggaagctgagctgggatttcctacggtgtgggctttaggagcaacccaggttagggaaaaactgtcatttttcattttggcttttcagggcagcgttattgtgagtttatttcaacataaagtgtaaaatggtcccagaggatttgttttactgtatttaattcttgaaggaagtttaaaattgtgtatacatgcagggagggacaggtgaggcagagggaagaaatcgtggaaagggacgaagttccccgagtgagtctttgtgtaagaatttacatccaacaatgtgggtattgttggaagcaggcctgctcaacctgggatctgtggatgcgcttatggatcaggaaggaggttgatgaagttctggaaattttaggtaatattttgttaatgtccttttgtgcatttttatgggtttatagtttccatgagctatgagttcatttgcatccagaattatgagatggaaaagaaaagatgtcttagaggaaggtgcaaaacctggcaaagaagaggctttggaaaagtatacaagtcccaggcctcagtttccctttctgtcgtctgagggcttaagaagatgatctttagggtctcttcattaatagtcattgaatattaatgtcctcagaagtcttctgactcttccaccaaaaggttgttaggagatttccatttgacctggacataaagagcaattagcacaggggctggcatccagtaagcaccgggtgcatggccttgtcgccgttgtcgccagggagctgggaacatgggtcttcccagtcccgtgggctggctgtgccaggtgccacaatgtcaaaaaacatctaggcttttggagacagttgagaagaaagttgtttttggatggaggaggcccttggtgtttccaggaagctgtgtttgctttctgtagggtccccacttcccctcatctgttagtctaatactggccactgatttgagccctaagaccagttcttctgttgcaggagttcgctttggtgtcagaggtgattaggaaggtcattgaattatagatgagaaaggagtttttaacagctgaaaatgggctcaggtttaggctctgtgctggtgaattggaagagagagagagagagagagagtgtgcgtgtgtgtgtgtgtgtgcgcgagtgcgcgtgcgtgcgtgcgtgcctgtgcccctgtccatcagttctccatgattagaactactatagctttggttagcagtaagttccaccttgaccttctgtgcaccaaggtcttatcttgtaagactttttggtttgctaatttatttggaagctcagtttagataatgtctattggataggagaaaaatgtgactgagaagttccaggaagaagcctgggccctaacactagagggtccttttcttttggcccctcagggaaaggttatgtttagtcatcgtggctttgtgcaatatcgtatcatatcatatgtcatatcatatatcatatatatcatttgtcttctggacacgttctgaaatagtagcagtggggttgggcccactcaattgacttaagaaaataatctctagaagattttagtttttaatatttcagattaaatatgagttttccagttggtcattcattgttaatttccttttggtcattcattgttatagggcaccagcagaggagtgaaaacatggttattgactcgaaggggggcagtcctcaatgccaagtactattctgttgattaacattataaatatttgaagtctagtcaagcttgattaccctgagagggggcaactcttactttcaagttcttcctgacattgtcacctactctggttaattaagtcattgttgacattaatggcatctttgtttacaccaacccagtaggagctaaaatgaaagggcttttcaaccctacacccttaattactttcccaccctccacagagtgtgactctgaaaagtaacaacctgaaaaaaaatgtagtttgtgtagcaattttttgtcaatcttctgagaggtgatgctctcctggaccaacgtgagttggtccagagttcagtagcagaaacgtcgaggacaggatctacacagagacctccctaagtcagatttttccagtatggtttaagtcctttgttagaagtattgtaaatgccataatattaaccatacgcatttaattgcaagttaaaagaaaggaagaaagaatatatccgcataccaagagtgaatgatttaaaataatcttctgtttcgtattatctgcatctttgtttttcaatatgagtgttaatatttaagagttgactgtaacttgatagttagctttggaacaaggacttattcttggtcaattaaaccaaatacaggcttacgcagttaaatacacaatgaagtacacattctttattagtatataaagtgtttcacaattcatagaccaagagccatgtttaatattacttatagagcagaaatctggcaagcccagagaactggtacttgtatcattttatactggctctctctgattcaaatttggggtatatgtgtgtgtttctgttttgtctgtttatttcaaccagttaaaagacagagcacttactatgccaatggccccgcatcaagccataagtaaagactttattcctttcaagtctttctgacccagttgagggtgagaattcacaaaaccacagcaatccaatatgagatgtttttaatatcagacttaacaaataattgcatggctatgaaataactggggtcgtgtttaaactggaagtgttttgtttaatgttcgtagtttcaataaaatgtatccactagtcttccagtttgcagactgttgtttaggtgtttgtttagccagggtaattgttaaaaactccctctaatctagcttacccttacatttccatggaagcgaattttagtcattaaaggaaaacatgggaaattgatttttgggtgcctggctgttacgctaggtaggaaatatagctggtgtgctactctccactgtactggtccgattctcgccagggggacatctctgtaggcagttcagaaattattttttggaagttttttaggctattccacagataattctgatccagtaggttttatgcaactgtgcaaaatgcttatggtctctatttttttttccttgagagatgattttagcctttggttttttgtttgtttttgttttttgagacagagtcttgatctgccacccaggctggagtacaatggtgcaattgtaccctcactgcattgtcaaacgtggctcactgtaccctcggactcctgggctgaaggggtcctccaacctcctgagtagctgggactacaggcctggataatttttaaaaatatttcgtagatatggggtttcgccatgttgctcaggctggtctccaactcctggcagccttggcctcccaaagtgctgggattacaagtgtgagccaccacacctgtcctagccttaagttttgcatttttttccatctttttgctgtatcccatatgatttagagatttttgctgtatcccatgagatttagagatggctctactttttttagctttcctagcattgaaatgcttggtgttgctaatcataccccatctttaccacaccatcttcctccctgacttgccttcttagtgtagtttggtcaagaacttgaggccaagttcttttttttttaaatttagcttttattttaggtttgggggtacatgtgaaggtttgttatgtaggtaaactcgtgtcatgggggttcattgtacagattgtttcatcacccaggtattaagcccagtacccaatagctattttttctgctcctctctctcctcccacccaccctccaccctcaagtagacctcagtgtctgttgttcttttctttgtgttcatgagttttcatcatttagctcccacttataaatgagaatatgcagtatttggttttccgtatttggtttattgctaaggataatggcctctagctccatccatgttcttgcaaaagacatgatcttgctcttttttatggctgcatagtattctatgttgtatatgtactacattttctttatccaatctgttactgatgagcatttaggtagattccatgtctttgctattgtgaatagtgctgcaatgaacatttgtgtgcatgtgtctttatggtagaatgatttatattcctctgggtatatacccagtaatgggattgctgggtcgaatggtagttctgcttttacctctttgagtaatcgccacacggctttccacaattattgggctaatttgcactcctactaacagtatataagtgtttccttttctctgcaatctcaccagcatctattattttttgacgttttattaatagccattctgacttgtgtgagatggtatctcatcgtggttttgatttgcatttctctagtgatgagctttttttttcatatgctggtgggacgtatatatgtcttcttttgaaaagtgtctatgtcctttgtctactttttatgtggttatttgtttttctcttgtaaatttaagttccttatagatgctggacattagatctttgttagatgcatagtttacaaatattttatcccattacgtaggttgtctatttactctgttgatagtttcttttgctgtgcagaagctcttaagtttaattagatcccatttgtcaatttttgcttttgttgcaattgcttttgatgtctttgtcatgaaatctttgcccattcctatgtccaggatggtatattgcctaagttgtcttccggggttttatagttttggatttgacatttaagtctttcttccatcttgaggtgattttttgtatatggtataaggaaggggtcagcttcaatcttctgcatgtggctagccagttatcccagcaccatttattgaatagggagtcttttccccattgcttgttttcatcagttttgtcgaagatcagatggtcgtaggtgtgcggtaggtgtgtggccttatttctgggctctctattctgttccattggtctacgtgcctgtttttataccagtaccatgctgttttggttaccgtagccccacagtatagtttgaagtcaggtaatgtgatgcccccagctttgttatttttgcttaggattgccttggctattcagaggctaagttcttttaaggagaggtctgattgaacaagatgctggacaggtcattgtggtgatccttcacgtcttgaagatgtctccttctgtaatagacaaaagtcacactttttacaagtttctctttcctcactgtgatttgtatgtggtagctgacttctatttatataacttcaagctcttaccatttaaatatttatacacaagtatgaatcattgggacaagccatggccatccttgaagagtgtgtgtcaagtaaaataggcgtgctttagattttcagtaattttggttttgggaaaccggtaccatggaagagttttcagatgctgaatgtgtaatttactccactttggaatactgtaagtaattctgcgccattgtggactttggccacatcatgccactctcaaaaacttctgattctttttgacagtaccaagtcagggggctaagctgttgtatattctttcctttaaccccttgtctaactaaagaatggtaaattccaattcatttcagaatggaatgcacacatatagagtttcaggttatgctgaatgtgttttatgaggaggctaaaaatagcttataaggaaaatgctgatagattcaagaacgagaacaagggatgtatttatttgtatgatttatgtagcgcctttcttggagaggactcaattctgagctctaacgttaataaactctatatcaattatcgtgattattttcgaacccttgagctcctatattactatatgtgacccatttgtatacctgacagtttactgttaaattttccatagtgaccagttgtaatattttaaaagtatccagacattgaaaaggccaactgtgtgtatctatggtgtgtgtatgtgctcaggggggtgtactataaaatgaatgtcaagatcattgcaatggttaagtttaggttttaaactctttgaacacccttaaagttcagattttcagttgacagtgggattgcccccaaagatgtgtggctgccttaaggagccttcttgtcctgctaagcctcctggatttccaccaatgcatgttgcatttctacctggctgcaatagacgcacaactgaatatatatcgtggacatttataaatgtttcaaatttaaaaccactcaaatttttaaaagaacaagaatcttctgtgcatttaatctaaattctgtatcagccattcttaaaaatagaattgaataaaatcattttggatggcatgtggtatgctttctggagacataaactaacagagggaacttgaccttgggaggtaggtttgaatctctctactatctactgatgctgtgatttcagaaaagttagataacctctctgagcctcagagatagtatctatcttgaagggtgaatgtgcagattaaatgcaaatgaaatgtaaagcccctactgaatttcctggcccagagtaggtgttcattaaatgctgatttcttccctgtcccacttcctgtcaacatttcctggaccaacaagatgtttactctacaatattaccaatatttcctggaccaataagatgtttactctacagtgtatagtgataattgtctgatgagaagcatttacattaattaaaatgtaaaactggctctaggccctggatttgtccaaccctttttattatcttgggcttttgcaagtcccatggattttagaaatgggatcatcctgctgcttgcagtccaaatggttcaaggttgaaattttttttcccctctgttgaaaaaagtcagttgcagctctgtaataataacagcagacacatacttcatgaggaacaatgtattttggcaaaagagttttctgtttgaagcttcaaaatacaaaatactctgccacattgccattaggcccggtgaagaacattggagaggggttatggaatcggttggggtggggtgcgggatggagaggggttatgggatcggttggggtggtgcgggatggagaggggttatgggatcgtttggggtggggtgcgggatggagagggttatgggatcggttggggtggggtgcgggatggagaggggttatgggatcggttggggtggtgcgggatggagagggttatgggatcgtttggggtggggtgcgggatggagaggggttatgggatcagttggggtggggtgtgggatggagaggggttatgggattggttggggtggggtgcgggatggagaggggttatgggatcggttggggtggggtgtgggatggagaggggttatgggatcggttggggtggggtgcgggatggagaggggttatgggatcggttggggtggtgcgggatggagaggggttatgggatcgtttggggtggggtgtgggatggagaggggttatgggatctcttcgggtggggtgcgggatggagaggggttatggcatcggttggggtggggtgcgggatggagaggggttatgggatcggttggggtggggtgtgggatggagaggggttatgggataggttggggtggggtgcgggatggagaggggttatgggattggttggggtggggtgcggtgtggtgtgttctgcttttggccaggctggagaggtgagctccataacatggtatggtcatccttgccatgtttgcctgtagtgacctcccctgaacactcctagatgagatttttgtctgcatggaagggagctcaaggaaattgtgatgggacccacagtactgaagtggacaggagctgaacaagcatttgcacatgatacccctatggaggttacttggtaggacaggctatgaagtaggggcagtatggatgaggtcacgtttctttagcccattccttgagatgatgatgatgatgatggtgatgatgataactggctaccatttattgagtgcctgtcatggttggactctgtgctaggtactttaacatatattatctctcatcttaataacccagaacatcttgggttttcctgttcttattttatggacaaggtaactgaaattcttggggatcaagtgactcctccaggacctcatcattagtgagtgtgggcccaggtctttgggtgaatgtgttggtgtaagaaaaatttcccttcttcctgagcaggaggattttttttttttgctggagaatgtggtgacccctcattctttcctaaatctgtcgtttgactattaaacctgttagggacactgctggttgattctgtttctttctcacacatccataccgaattctcctaaagacatttgaagaaaaattccagacaataaaaatgtttaatgattatactttgtgattcttctagaatggcttctggtggcatgtgacttattggaaagaggctaaccctgactgctgccaaggagaccaatgggagactgggtcccagttggtggtccaggctgcgccacaccgtaggagtccataacaagaagggctggcctctgttgcccgttgatgcatgagccatctcagcagagcaggccgtccccagttattccttgtcccagatgcctctgctggtttgtcctagtgcctgctaaccctcagctgttgccacttggatattatgtcaagcttttcttcccagaatttctgatttacgactgggtatgaagtcaaggcctacctgcatagacagacccctgtacttgggactcccacgaactgtggtcatggaaacaagcaccaaggactacctgacccttctaatgtcacttttctgcagagattaggaggagagactaagaaagccaaaaaagaaaaaattccaagaatgaaaaggccaaaagcagaaacacctactcttcttccagtcttggccagaaagggtgtccttaggggaaaaaaagaggccagggaatggagcccatttttaaagcaagcaaagatcagtttggtatttaaaaataaaaagtgaactccagtaccagctaatgtgtaggtgaatcgaggctggtttaggcagctgaactttgttcttggctacctgtacagcagttgcagaacactcaggggttccaggcatttccaagtgggagttgagttttggaggaaagttgtagaattcctttttcttttttttctttttttgtgagacagagtctcttgctctgtcacccaggctggagtgcagtggtgcgatcttggatcactgcaacctctgcctcgcgggttcaagcgattctcctgcctcagcgtctagagtagctgggattacagatgtgcaccaccacgcccggctaattgtatttttagtagagctggggtttcaccatgttggtctcgaactcttgacctcgggtgatccacccacctcagcctcccaaagtgctgggattacaggtgtgaaccaccgcacctggccgtagagttcttgactaggagatgctgcaaatttccctcttaaatttgcagctccccgtgcgatgacaactttcagagcttggcagaggcaagatggtataaacatgatttttagattgcagggtaattgctgtggtttctttgagttttttcatccatttgctccccaaataatttttgagacctactatgtgccaggttctgtggggatggaatagcaagcaatgaacagttgagtgggggagacaggctcttgtcaaataattgcaaaaatgaagggctaggactgggtgcagtggctcacgcctgtaatcccagcactttgaggggccgaggtgggcggatcatgaggtgaggagtttgagactagcctggccaacatggtgaaacgtggtctctactaaaaatacaaaaattagccgggggtggtggcaggcacctgtagtcccaggtacttggggggcggaggcaggagaatctttgaacctgggaggcagaggtttcagtaagctgagatcacgccattgcattccagcctgggcgacagggtgagactctgtctcaaaaataaaaaaaaaaatcaaaataaataaacaaaaataaaaaatgaagggctaggtccagtcaaaggtgaagattctgtgaaggaaaagcatgggccggaggcatgtgccccatgtttaggagttcccagggactgggactatgaagctgctgctgctgctgcttttttttttttttttttttttttaaatgcagggtctctctctgttcactgtgtcacccaggctggagtgcagtggtgcaatcacagctcattgcatcctggacctcctgggctcaagcggtcttcccaccttagccttctgagtagctgcgactataggcgcaggctgatttttcttttttctttctttttttctttttttttttttttggtagagatgggttctcacttgttgcccagcctggtctcaaactcctgggctcaagcgatcctcccaccttggcctcccagagtgctgggatcacaggtgttagccaccacacctgaggctggtcttccccttaaggaggtggcacccacctggattccccagcaaacccacctgcattgcaaggttgacccttatcagtaccagccaccttgcctgctaggttgacccttgtccagtgaggtgattttccagggcctagcctctctgctgtcccttgctggcttcacctgttgatgttgatggaggtggagcagaggccgttgagtgaatgcgtgcagctgggctcagaggcccctcttctcccctcctgtgaggtgcttgcccttgaaggtgtggcgagtgaggaggccggtcaagggcatcctggcggcctccaggccgtatttgagtgggtcgtttcagcctgcttcctatctcttttctgttactacctctaattggcagagtttcttgccaggtcaatgtggaggcagagagatggccggagggcggccaggggagtcaggccaggtgtgggcaggatgggattctgcctcctcccaggtgcctcgcctgggggatgccctgtcccagaaagcctacattcgtgggagccggcgcacagcccttctgagatctaaagcttccctctgaatgctgctttggaggattgtgagaggtagtgactcttcaaagtttgtttgttttcttgaagcttttacctctatgcaaatatgcggtttggagcagggaagaaaggttaactgtgatggcgccggctcttaacgtggaatgtcctgaattaatgtgggtttcagtcctctggctcaggatcccctgagggagagtttttctttcctctgcaaaacacaggagaaaagtgatccctgtggctccgacctgccttccttgggtcctgcggtgcaaaaccagctgggaccgtgtcccgcccacccgaaggcagtgtggggaacctttcctccaggtcattcccattcagctgattgctgccggctccccaggccacaactctgtgccttcaggcgtctgcacgggtttcgatgctggccaggcctgaacttggtgagcctcaagcagaccgttcaaacccattcaaatgaggaagaccatctgtttcccagtctccagctgctgctgcttcatttgcaaatggctgggatgctgctgaggggatcaggcggggacacatctgcagactctgaaggagtgttggaaccgagatcctgctgagagaagaaaggccgagccctttaaatcaacttgccaaacagtacccccagaaggtcctgagttgagaaagcaggaggcagccttgccctcctggaataactcttaaccttcccttttcttttgtagccttggccactttaaaagtatttctttattcagaaagtgcgcagtgtgggagggcctgctctatgggcttgggggaaaatgtcaaacgggatctggacatctatctgacctttcagggccatacagggcaaacgtatccgctggagtatgcaccatttattgaatgtttacatcaatatcagggaggtgagcttgtcccagcagcagcttctaggagccacaggtaacagtaagtgtggcaaggtgactgtccctgaaaacctgcttctggaatgagtcaggctttagggtatgctctctggaatgcaggccagccgccccaactcgcagtaacgcaggcccttagctctgtggactgcgtgaggcacagctgtggggactcttgcccatggtttggtgtttgcagggttattcccggcatgctgtggggctagggtaagttatccggctcctgagccctgctggggttctcatctcaagggaattctgtggtgtgttactgtgccccacatgcaaatatcagctactctcaaatgtgttggatggatgaatagtagaaggtattttaagaagccacaggcctctttgtaaattaaacaggcatcatacatgggtgttgataatgatgaatctcacaaaatcttcagatgtttagtctctgggaacattccaggaatcctcatttaggtaacttatatgtgatgagacctatttgttcacttgaaagaaaacctgttttgaagtcagaggaatgcgaatagaggctctcacatggttggaaaaagcaatctgcaggccagttacgccccgtaaacaggaacccaggactgccctcctggccagggctgagttgcaggatggggaccccccactacctccaaccgcccgccaggatgaggagtgcttgctctcagacgtgcccctcactttaaatatacagaggccttcctaggcagcctttgattgtgtccttgtggtgaccttgccctgcagcaggcagcactggagatgtttttttcttctctaaagcatgactctgaggctcagcggtgtgaggctgtccaagctgacacgttcactactggcagaggcgggtctcaaagtctcatccttggacactggagctgaacttcttgtagtgtgggtcttggaccagcagcatcaggcctcacctgtgggaaataaagaatgtcagcccgcacctgcaggcctactgacccagaatctttttttgttttttccttttgagacagacttttgctcttgttgtccaggctggagtgcaatggcacaatcttggctcactgcaacctctgcctccgaagttcaagtgattctcttgcctcagcctcccgagtagctgggattataggctcctgccaccagacctggctaatttttgcatttttagtagagacagggtttcactgtgttggccaggctgttctctacctcctggcctcaagtgacccacctgtcttggcctcccaaagtgctgggattacaggcgtaagccacagcgcccagctgacccagcatctttggaagtgggagcaaggaagctgtcttaaactgaccacgtggttttacgcacagtaaagtctgagaaacattgcattgatccctactccagtccctctccgtacaccttttgggtggagtgggctggggacgcagactgtctttggctgtgcatgtcctagaggctgaacaggacgagatgggagcagtgcagtgtcttaatgggaatcgggattttcacggaggagctgttggaactgggctgaataggagcctgccaggcagcagagctgggtgggcttgtaggtagagggaacagtgcccatgtggacaggtaagccagagtgtcagagagagggatgtggggcttggagcaaccaagcctcaatgcgcatgatgttctttgggttttattctctctgactttggagtggtctgtgcctttttaaaagagtagagatcatgtgcttttcagaagattcctctgggggtctgcggtggctacaagaggcgcaccatgggtgatgggttaggcgcattgcagaggtcttgtggaggactggaggagacctgtgggatgcagttttgcctgtactttctttcagagctaagctttctatcagggataggcctaataggtgaaggggtgtggggactgatcagaggaagggccagaggaaaagaggggcttcagggccgacttggagcttgggcggcagttcagtggtgtgactcccttcatcgtgtaagagaagaggctggtggaggaggaggaggttgaaggtcacttgcttgttttggatacgacctctgcagacatccaggttatgtatttcctccccccgggcaggtggaaatatgaacctacaagcagggacttgagtggcatctgcggggaggaggtgggaaaagccacacgtgcccaggagactggaatgcagggaaaggaccagaagagccagaggtggaattctgggtatatccatggatacaggaggggtggcagggaaggagaaatttcctagaaaggcaagaagtcctccttgacatgttcctgtccataagaacacatacgcacatgtacgcaccagcaggaagcagaatgctaaccgaagataattaacccccaattctgtgttagggattgagaaatagaccaggagccctgccccctcctctctcatttcctgaccttccacactgagaagacctggctaggcagccttgctttttttcctgtttagcggaggagtgaggatttcagccggaaggtctttctgatggcagatgtgtaagtgccagacattgtgctgggtgccttctgtgtcctatctcatttattattgttcctgctccgaggacttgcctcaaggtcatacgatttgtaagtggcatagtctcggtgtcagtgacaggtctgtttggtgtctctctctctctctctctctctctctctctctctctctctctctatatatatatatatatatatttttttttttttttttttttttttgagatggagtctcgctctgtcatccaggctggagcacagtggcgtgatcttggctcactgcaacttccgcctcccaggttcaagcgattctcctgcctcagcctcccgagtagctgggactataggcgcctgccaccatgcccagctaacttttatatttttaatagagatggggtctccccatgttggccaggctggtctcgaactcctgaccttgaatgatccacctgcctcagcttcccaaagttctgggattacaggcatgagccaccatgcccggccttggtctgtacctttaacacccccagccttttctgaagagtcaccagagaagggacaaaaatgaggccatagccttactgctaagggaccatgagaggcttggggtatagctgtctgttgagacaggtgctttactactttgtaagatgaagagagctgcctctggctgagcactgtcattaggactcagggaatggaagtgttttgagaccagagggttcagtttcaggactggagatcacaatgcattcattttacagagtgacaactctgtagggccactcttcaccctaagattgggtcattaaaggccaggcacatcctattcactccttcacctccttgtgagccccccacatgccttttgatgaaagggttttccccagaacagtgtgtcccaagaagccctgaagggctggagatgtaccagctttctctgctatgtccagcaagtgtattttcagaaggtaggaggctcgggctgggctggccaggcagccaggcacacagactcctcattgtacatccaagccggggcgtgcaggacttcaacatagcttgtaacgcaagtatctatttcctgggcgctacatgatctaatggcctgtcgctttgggaaatgctttctgaacaaaagactcgatttatttatttatttattttttgagacggagtttcgctcttgttgcccaggttggagggcagtggcgtgatctcggctcacggcaacctccaccgcccaggttcaagcgattctcctgcctcaccctccttagtagctgggattacaggcgtgtgccaccacgcccggctaattttgtatttttagtagagacggggtttctccatgttggtcaggctggtcttgaactctcctgacctcaggtgatccaccctccttggcctcccaaagtgctgggattacagatgtgagccactgcgcccggccttttatttttttaaattattattatttttatttatttatttatttttttgagatgaagtctcgctctgtcacccggctggagtgcagtggcacgatctcggctcactgcaacctctgcctccctggtttaagcgattctcctgcctcagcctcccgagtagctgggattacaggcgtgcaccaccatgcctggcttaatttttgtatttttagtagagatggggtttcaccatgttggccaggctgctcttgaactcctgacctcaggtgatccacccgcctcggcctgccaaagtgctgggattacaggcatgagccaccgcactcggccaggactcaattttgaagttcttatgcaagcaaagctgcccatatctaggagtttatgcacacagtactgattcaatacctgcgtcttagtggtccatcaggaatttttcactcatgaaatatgactttaatacacgtgttgggaccagagagaaaaccttccctctgtgcatctttttttggagaacactgtcatgaacagccgaaaacatcagatcaaaagcgagagggatactgacaaaacagggagtgcggatttccactgtgggtggggacattgggagacacggtgactcactcctcagtaagtgcattcttaggctctttactctgtgtgcatttttattttctcatgggcaacaatataatttctttcaaacatgaagagccatccagcatgtttctcaaaggcagacttaaatgatatgaggggtgtgcctaaatatataatttttaatggttaccatattggaaacattagccatgatcccatctgatgactaggaacatgagccagtctggagtttctggagaaatccagctaccgctgcagaggcggctgttagctgttgttaccggcatccttgttagcgaccagggaggtttcagtcccgacttgtgtctaccagataccctgacaactggttagaaagagaggactgcaccctttcatcctgcgtacttatctgttgtttgttgctttgacttctttttgttctccgtttttatgttggcagtatttctcgaggtagagaactttcacctttatattgtgcggagtatttgtcccttcctcgcccccttaaagaacacgtagtacctatgccttataaggtctctgtttgatgtgaggaatttggtcttcttgcaagtcggctcttgcagaggggaggctttgaggatgtctgggctgcagcaggctgtcttcgttgctgtgtacacagccctcatggcagggcatgcaaaggtggttggttctgacttcaatggcgggactccattgcctttattttttaatttaattattattattattattatttttgagatggagtttagttctgtcacccaggctggagtgcagtggcgcaatctgggctcactgcaacccccgcctcccggattcaagcaattctcctgcctcagcttcccgtgtagctgggactacaggcacacaccaccatgcccatctaatttttgtgtttttagtagagacggggtttcgtcttgttggccaggccggtctcgaactcctgacctcaagtgatccacctgcctgggcctcccaaagtgctggtattacagacatgagccaccgcacctggcctccattgcctttatttctttctgctgataagttctgatgccagtgatacccagattgtgccataggaaagagggggctgggctcttccagaaaccctatcttgcagaaatctctcttctgttcctacggacagagaattgggtattgaccagtgaggacttcttactgggactgggcgtggccactacaggacatcttccagactaagagggccagttgggggttactggaccagggaggacagtggcggccacttacttgccatgtgctttgtgtgcagtgactatgtagcgacatttgcagccggactgtgtttctcctgtagagacactggcagccctacagccctacagccgtgacatttactctgtacaaggtggcaggaggtgtgggagggcaccgggaaccgaaggccattttactacccttcccgcagcgctcctgttacagtgcttgtgggagtcccagctgtgcctccaggtacaaacgggtttcttcctgcaacccacaaccctgacaggacatgcctcccgggtgtgctcctaacctgcctcttctctctgcccctccctctttctcctctccccttcccctctctttcttcctcttgccttcctcttctttcctctccctccctctgtttctctcccttccttttccttgtctccgtctctcctctcctttttccccctctccctctctttcatccttctgtctcttccagaggagtctgttcagggatttctttctctctttcttcttcctggaggaatgtgtttagggattggacacctctgactttggaggagggagaaacctcagtgggatgggttccaggacgaccccaccgcatccttggaactaggatgatctagacgttggaaaagacaccatccctgggaaaccccagaaaaggcttaatttgtgaaaagtaatggagggagctgtgccgttggtagaaactgcttttttcttccttaacagtttaaatctgtcgtccattctccgtgaagtgattggacggggcaagactcaggtttcccatctgttctctgtttgcatttgggcgccatttcaaaaaccacacgggaaaagtttataggcaaacattataaaaagtgacagtctgaagtgctgctatcgctggtttggcaacgtaaagtgttacctgaaatagcttaccatttccaaacccttttgctgtttcaactgtctcaagacaaccctcccgctgagatgggtgagaagtccagctggatgtgtgcagtgaagtcacataagtcacagccttttttgacttttacaagatttccccctcctggggctatcttcacacacagcgaggatttttttctctctgtttacttatagagaggtaaattcatgcagcttgtggctagtggcactctgtgtgatgtcaaatggtctgctgaggggctcggagagtcaggcagcccctgcctcagtttctttctctccccagtcagaggtcctatgagctcccaaggaataacaggatggttttcttagggaaggaaggccaggtcaaggcaggaattactcacagctcatgtgcagatgcctgttgttattcatactatttatttatttgtgttttttttttgtttgagacagtttcactcatgtcgcccaggctggagtgcaatggcatggtctcggctcactgcaacctccaccttctgggttaaacgattctcctctgcctcagcctcccaaatagctgggattacaggcacatgccaccacgcccagctaattttttatatttaatagagatgggtttcaccatgttggtgaggctggtctcgaacttctgatctcaggtgatccactcgctttggtctcccaaagtgctgaaattacaggcatgagccactgtgcctgggctacttatttatttttggagacaggttctcgtctcgctgtgtcacccaggcaggaatgcagtggcgcgatcatagctcagtgcagcctctggggctcaagcgatcttcctacctcagccccctgtgtagctgggactacaggtgtttatcatcattcccggctttttttttttttttttttcattttttggggagagaggatcttactatgttccctaggctggtcttgaactcctgacctcaagtgattctcccacctcgacctcccaaagtgctgggattgtaggcatgacctgctgtgcctggcccatttattttttgattagctgtacaagtacctgtctctctcatttttaaagtatcaaaacagtcaatttttttttttattttttttttgagatggagttttgctcttgttgccccggctggagtgcaatggcgtgagctcaactcaccacaacctccagcttttgggttcaagcgattctcctgcctcagcctcccgagtagctgggactataggcatgccccaccatgcccagctaattttgcattctcagtagagacggggtttctccctgttggccaggctgggatcgaactcctgacctaaggtgatccgcccgctttggcctcccaaagtgctgggattacaagccctaaccaccgtgcccggccaaccactttgggtcgttggttggttgttaggtagatttaaaaaaagctttttgtggccaagttcggttgctacagctcttggttattaccacttttggattactgacgcaattcgccctaccccgaagttttatacaattttggattggctctgcaccaccctgaaatgcaacccccctgagttagcctggaacttgcggatcacaaaacccccatttgtttcccggggcctcctgtatcgcgaattttacctacttatgacaacaatattgtatatccacaaacccttctttaaggacttggttcaaacaagtgttttcgaacatccattggatagagccagagatacactttcgtcgttggttaaacttatggcaatgagatatgcgagtcagctcttccccataactattaggcctaaccacaaggggatatatggctcctcttaaacttttctagaaaacataaaacagattttgtaaaaattatctctcccccgtagagcctattgctcaatcttnnnnnnnnnnnnnnnnnnnngaagacaccctgtctctactaaaatacaacaacaacaagagaattcccaggcgtgatggcatgcacctgtaatcccattactccagaggctgaggcaggagaatcacttgaacccaggaggtggagcttgcagtgagccgagatcgcaccactgcactccagcctgggcgagagcgagactccgtctcaaaaaaaaaaaaaaaaaaaaaaaaggccaggcacggtggctcacgcctgtaatcccagcactttgggaggctgaggtgggcgtatcacgaggtgaggagatcaagatcatcctggccaacatggtgaaacccaccccgtctctactaaaaaaaataccaaaaattagccaggtgtggtggcaggctcctgtagtcccagctactcaggaggctgaggcaggtgaatagcgtgaacccgggaggtggagcttgcagtgagccaagatcgcgccactgcactccagcctgggcgacaaagccagactccgtctcaaaaaaaaaaagaaaaaaaaggctgcttgctaacacgctgctggtacttcccaagtatttgaaacttctgggagaaaattcacgtggatgcaactgagctttatgcagcagggctgcagtagtgtggccacggcagtagaaacgagtgttgagctgtgtcccaggaaggagacttggtgccttgtttgtttaccagttttaggaaacagtgacaaagattggccaatactactgtgaagcttgcttgcttcttttcgacttttaattcatattgtgaaaaatacatggaaacatattctctgtctgtggaagcctctgaaagagcatttgtgcatagcaaggcggcttctggaaccttctccccattgcgttttggcaggagatgagggagatgttgggctgtgcacccctggtggattcgcacaggaaaggtgaaaagtatgccacagcaatgggaaaaagtaaatccaggaagtgctcacatgactataaaaggagttatgtacatttcctggggaattctttgctctttcacagagcaggctgtgcagcctggtggagtcagggagaggttgtccatccatggggggtgaccagagttagggaggcccctttgcacatgcaggcacaggggattctctgattgtcctggctccgcgcagcctggggccaggtcagtacaactgtggggatgaacatggagggctcagggagtgcatgtttgcagggagtgggcagcgggtcaggtcacctgcagcattcaaacccagaagagaagctaagccctgtggacggcaaatggacccaaggacacgggcagggacagagctgcttccactgagccagctgttgtgcttgtgttcttggccccctggccggggttgtctttgatatgtgtcgtgtgtgctgggccctgcaggctgggcttggggggccactgggtggcctgggaggctaccagtgtggcatttggcccctccccagcgtatggccccaccccatccctgcctctcttcttacttacatcctcctctttttattctccccaacctctttctctcttgtgtgtttattcatgcattctccctaccatgtgcttgcagagtcttctgggatacccaggggtattactggcatgtttactaaaggcaccgctgatccccaaaatgggccctttgtgaaatgaccactgaaggggtggagggaggagtccttgctttctcagtttaccaagacagcagttactggtttgagactttgaagacaggatggcttgatttttatggataaacatcattatctcattggtgtattttagggggtgatattttactatccttgaagcttggatatctagatgacagttttgatctggttttactgggatcaaaagcagttttagtacgtcaagtcatcttaactgtccattgagatgggactcctgtaaaatcactttgtatctggagatagcaatccaagtgttctggctgggcgcagtggctcacgcctataatcccagcactttgggaggccgaggcgggcagatcacgaggtcaggagttcaagaccagcatggccaatatggtaaacgctgtctctcataaaaatacaaaaaagttagctgggtgtggtggtgcacgcctgtaatcccagctacttgggaggctgaggcaggagaatcacttgaacctgggaggcggaggttgcggtgagccgagatcgtgccactggattccagcctgggtgacagagcaagactctgtctcaaaaaaaaaaaaaagaaaagaaaagaaaagaaaagaaaaagaaacccagatgttctgtgattatcctctgaaaatcgtggtgcttaaaaaatcacggcaagcatcttccgccttgaagagtaacagtaatagtgacagtcattagcccgacatgttgtagttgatgatcaggttcatcttcgttggctcattggaatcttaccaataataaaccagtatttgggtactcttaccctgcaacagatggggaacaccaggccaaaaggttaagcaggaatggagaggcgtgggaactcagggcttcatcctcttctcgtccagggcagcacccttcaccaggcatctcccatgtccagctccaaataagacacaggtcctcgctgtcccctgtacttccttctagaacagcacgtggtagtccagcagctcagatacccccagtttcagcaagattttggggtttactgattttaggtgaaggaaaggattctcaatgaaaacactttcatttaaaaacaggaaatcatacatcataactcctcctttgccgggagagagatttttttctgcatcacaattgcaaatgccttgcttatcttttttttttctttttttccccctaatggagtcttagagcattcctctgcgtgacatagggacatggttgcaccttatctgagggtcaggatggagcagattggtgtgtgggtcccaggtgccttccctgtgagggagggaagctttgctgcttctgctcagcggctgccctggtgatcaattctggctaagaggaaagtacattccataacatttctggtgacttgctgatcatgtgatgttgtcataatagacattgatcattttatgacccagactgatccaatgtaaattcattctaacatggtgggtgctgtttcagcaatgagttgttggagacctgggactcaaaggacatctggtccttgccttagccagctgtcaaaggggttggaccaatagcgtttggggccccttcagctctcatgttgagtgaatctgtgactctaggatgttgggagtgggagatgggccaagatttgggaccagactgaatccctgccgtcttctcctccttctcatatttctcttcctttcttttttctgtttggtctccatagtttaaagtatttctattagtcactcaattcagccgcattttgacttaaccagccttgagagacctgctctaagagccttcaaactaagttcccaacatcttttaaacttcgctttgtccttcacttctcagctcaaatgcctgttctttggagaagtctctctgattgtcttatacaacagggattgaaacactttttgcaaaggcaagactgcaaatattgtagggcttgcaggccacagggtttctgttgcaatgactgaactctgcccttgtaacacacaaaagcagcgccagacaataaggaatgggcatggccgtgttctaataaagctttgtttacaaaaacaagctgcggctggcttggcccgcgggccatcatccgccacctcctgccaagggaccagccctcctctgccactgctgtgtgtgcccgtaccttgccatgtccttcttcctaatgcttaagcaagaacactgtattttttgtagattttgtatctatcgtctgtcacccccaccataatggacgctccacaagtgcagggtctttatcttgtctcctcttgctgcggagcttccagaataggcttgttgtatagtagacatgcagtaaataattactgagtgagaaaacaaatgttagaaacataacctgcccgtcagctgggctttccttgctttggggtgcatttgtccatgttacatttagcttctattttcctccttttgttgtgattctctctttgtgttcacgtgctagttggcatctggggcttggcatgcatgcctttggtgatgcccccttgagaagccccgggcctcctgtgtggctgttgatggtggtggtgagggggatttcttgtccccaatgcatgtggcccttgctcctttcacagtgggactgaaacacagattgacttgatttcagtctcctgtgggagatttgttcttctgaggggtgtctaggcaaaacagttgcctttgatcctgccctgatttggtgctgtctcagtgctgggaagctttgcattttctaggcctggaactctgggtcccattcacacttctcactggagggatgaaagcctccttcttgggccctcgtggccatcccagctggccgctccagctgttgttattaataaatgccagtggtgtcctctcaactccagtggagaggttgtgtgggttggatccttgtgggtccaatcccgtgctgcatatctgggaactgtgaccttgtttgacatggccatgtgtctgccaagcaggatggggtcggtggcgggaagcacagagaaccatgagacccacgccttttctctagggtcttggtgtctccgtggggagatgggatgcattcatgagaatatggtgcatcccatgagctggcaaagtgggcaggtgtatggtggagggggagggagccagtgctcttccgcccagggggactgatgcaaggtgactcccatcacggaggaccctgcttgatttgggtcttggagggtggatgacagggaagagagggaggaaggactgtccctacagaagaagcctgggacatgtgtggtgggtgttggtgagcagggtgggactcagctttgtcgtgtggagtcgggggcacacagcacccagcggcttcatttcaggacccctgtaagtgcaacggagactgccttgcagctgtctgggcattttgctctttttgtttttggtgttaaggcctctaggcttttatcattttgggaaaacagcaggtctcagctcacccagcacagaattaggtctctaaaccggcaaagtactgatctgaacatgagagctcatgaaaactctggatggcaaaaaatcttgtagagggatcccttagttttccttgagtttgagacatttcattttaagaagcttggccttggggcaacagaccaagtctagcacaaataataaagagtgtatgtgtgtgtggcgcacagtcacgtttcacgtacaaatgtgtaaaactcggcattcttacaaataaaacataccacaataacagatttttgcaggtattacagtgcaagcacgctttggcaatcaatttaaacattttcttgtggaatattcttccatgctatggtttggtttgtttctaaagccccataggatgtggaaactaagtcaggacagattttctgggggtatcctctggttgctcttccagatacttcctgacttcctggggcttggggagaggtggatgcctgctggggccatttgcagagcaagaacagcttctcctgggaataagcaggcctccactgacctttgttggacgttctctcctctccctccttcccatctgtctccgtcttctctctcccacctttctgcagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacaggtgagttggcccgccagcactatgctctctcttctctgtagccattacatttttttggccaagtgaaaaggtagtgagatctctaattgtaattggatgccaggcatacagcttcatagtttttgaaattcttctttgggacctggtgcaccagaaaggccgatcattaagaatgatagaattcttgtgcacaaagtaacatttttcttaagatagtacgcttttatttaagtaaatacatgcttttttttttttttttttgtaccactgacatctctggcatttagaatatagggttgaaatttggatactcaagatttctgattcatttattagagtttgagtttctctccatgatttccttctatgcagtgagcgggacagaacaggccccctttgtggccgagtttaaagttctgctttcagaatgttagttgacgatgagaagggccacacagggactgagttttgttagggatcaatttctttcttcaaggagaccccgcatactgaaaggttaatgttggaaaaagagtctttgggtgctacacaattggtaaatttgtcaggggcttgaatactgtttgaagcttgaaatccagttctcatatatccaattttatagcctgtttaaatagcgtgaaagcagaaaacattgagaatcataacatagaccaactgtcatcatggagggaaaatttaagccattaaaactatcttaactgaaaacaatcccaggctctttgcgagggttcctgggttgttgactttgctatggagaaggtctcagttgtagataattgcaacctttttgctttgcaaaaaacacatccatggaatatgttcttttgcatacagatgccatctcatccggagatgatgaggatgacaccgatggtgcggaagattttgtcagtgagaacagtaacaacaagagtaagtaactgcccggctccgatggtccccgagagaggagcatggagggaagttctgcctgtcacctgtcttcttgtcgactcttctgcgccatgctgtgtcccgcggcccttgcctttccccgctgtgtctactttcctgactttcaaacctgagaataaaccagtgttgctgcacagccttctctatcgtttgtcctttcttctcgtgtcactggtcattcgtttttcaaagcagttactacttttctttccttgattttcccttttccctttgacttctccctattcagagacataagaatagtagaaccatgtaacatcttggttttccttgtaatcagtgattgtgcttggtttaatccagtggtgtgtgactggggcaattgcctattcttgctctcccggcacattgggcaatatttggttgtcacaacagagggagggggtgctggtggcctttagctggggaggggccagggatgcagagcacagccccataacaaagaattatctggtccaagatgtcaatcatccctagggtgagaaacccggcctcctacaacacacacctcatgctgagtgaaaatgaaggacgtgtgccttactttgtagaccacgattgaaaagggagccaagggtggcttgcttaatgagggccatgaacactgagcgctaacatgggagaggccatttacttgcgaggaagaacatggcgtagcctcttggagctgggcaacctgggtttgaatcttgctccacaacttctgagttgctcatttcacttctgtgccttagtttctttataaaatgggagtaataataataatactattttctggggttgttatgaggattacatgagttcctagttgtatagtgctcagaagagtggttgcttgcaaatgtttattcaatacacaaaatacaatatagcattacttgcattttccaatgacttggctagaatgttcctaaagtgtttgtacatagggtattgggattctctgcttacatggtatattctacatttttcttaaaaggattttagtcaatttggtacatttaaacaaggcctaagtaatataccacacccggctaatttatgtatatatatatattttttcccgagatgcagtcttgttctgtcacccaggctggagtgcagtggcgccatcttggctcactgcaacctgcacctcccaggttcaagcaattctcctgcctcagcctcccgagtaactaggactacaggggcctgccactacacctggctaatttttgtatttttagtagagatggggtttcaccatgttggctaggctggtctcgaactcttgaccttgtgattcacctgcctcggcctcccaaagtgctgagactacaggcgtcagccaccgtgcccagcctaatttatgtatttttagtagagacagggttttaccatgttggccaggctggtcttgaactcctgacctcaagtgatccacccgcctcagcctcctgaagtgctgggattacaggtgtgagccactgcgcctggcaatactttattttttcgagcagtttcaggtccacagcaaaataaagaggaaggaacaaagatttcccatataatcttccccaacacatgcatagcctgtcctgttatcaacatccccaccagaatggtacatctgttccagttgatgaacctgcactgccatcattatcacccaaagtgtgtggttgactttagggtatgtaatcatacagtgtgtagcctttacagattggcttctttgacttagtaagatgcatgtaagtttctctcatgtcttttcatggcttgatgggtcatttgtttgtagcactgagtattccattgtttgtatgtatcaaagtttatttacccgtttacctactaaaagatatctcggctgggcaccgttgctcacgcctgtaatcctagcactttgtgaggccgaggcgggtggatcacttgggaacaaaagttcgagaccagcttggccaacatggcaaaatccctgtctctgctaaaaatacataggttagccaagtgtagtggtgcatgcctgtaatcccagctactcgggaggctgaggcatgagaatcacttgaacccaggatgcggaggttgcagtgagtcgagatcacaccactgcactccctcctgcctgggtgacagagtgagactccatctcaaaaaaaaaaaaaacaaactctgttgcttccaagttttgacagttgcaaataaagctgctacagacatctttgtgcgggtttttgtggggacatagttttcaattactttgggtaaatgttaaggagtgtgattgctggattatgtgagaagagtatgtttagatttgtaggaaaccacctagctgccttgcaaagtggctgcaccattttgtattcccaccagcaatgaatgagagttcctgttgctccacatcattcgatgtgcttggtgttctggattttggccattctgataggtgtgtaatggtattttgttgttttaatttaaatttctctgatgacagatgatgtgaagcatcttttcatatgattaattgccatccatgtatcttctttggtgagatgtctgttaaggccgttggcccattttttaattaggttgtttgttttcttactgtcgagttataagagttctttgtatattttggataacagtcctttattacatctcttttgcaaatagtttctcccctcacctgtggcttgccttttcattctcttgacagtgtctcttgcagagcagaaatttttaagtttcatgtagtctggtttttcttttatggatggtgcctttggtgttatacctaaaatgtcatcacccaacccaaggtcatctagattttctcctatgttacctcctaggagtattattgttttgtattttgtatttatgtgtgtaatctattttaagttaatttttgtaaaggatgtaaggtgtgtgtgtggattcactttttagcctgtggatgtccagtggttctgggactatttgttgaaaagactgtcctttaggtttttttttttttttttttgagatgggagtttcgctcttgttgcccaggctggagcgcaatggtgcgatctcagctcaccgcagcccctgcctcccgggttcaagcaattctcctgcctcagcctcctgagtagctgggattacaggtacatgctaccacaccccgctaattttgtatttttagtagagacggggtttctccatgttggtcaggctggtctggaactcccgacctcaggtgatctgcctgcctcggcctcccaaagtgctgggattacaggtgtgagccactgcgcccggcctgtcttcttaaaggaaaaagataaaatagatattggtaggtgcctcggataaatgagttacttaagtgaagacttagatttgtccctgagtctcctagcagctggggcaaaagagaaatattttggttggtgcagtttttactttttgtcaagaggaagcttagggcagtggttctcaaagtaaagttcctggaccagcagcatcagcatcacctgagaactccctcgaaatgcagattctcaggttcctcctcagacccactgcctcagaaactctggggctgattctgattcacactgaaatgcgagaaccactggcttagaatttgcacgtggaggtctgccctgaatgggagcttactgttagtggtcttgttcgtaaaacagtggataataaggtgagtggaagtatcttctgtgatttgtaccagccttctaaagaggttatcattattgttatttaataaaaagcactgataagtggagcatgtcactcgcctctttttttttttttttttttttttttttggggacggagtcttgctctgttgcccaggctggagtgcagtggtgctatctcggctcactgcaagctccgcctcccgggttcacgccattctcctgcctcagcctcccgagtagctgggactacaggtgcccaccaccacacccggctaattttttgtattttttagtagagatggggttccaccatgttagccagaatggtctcgatctcctgacctcgtgatctgctcgcctcggcctcccaaagtgctgggattacaggcgtgagccacggcacctggcccactcacttcttttggccagtggctctggcatgaagctggaggcaaagatgctgagggcctgcactagacaggctctgtgctggctgctggttccgtccatgccaccaataacccgatcaggtggagagagtatttattcttgctttattgaatggaaaattgtggcttagcaagcaaaagaagggctgcgtttcagttgtaggcctgttgcctgagagcatcctagggtcacgatgggggtggagtgagaatgcttgtacaggtgtttacagctctccagttttactgtatgtgggtgccctcgctatggattgagacatcagattctgtcagcttggtttttggatgcctggggaactgcgttgtcctggttgtcggctacctgcctaatagcaggttaccgtgaaaccatgtgaagcaatagaatgcaacagcaaggtatggattacatgacaggcaggctgagtggttcagaaggattatatgctgtggaccttatgctttgcattgtgaacagtgttcctaactgcccagcgcccatgcagaagggccagggggtagagcacccatgtgatgaatgccaaccaacagtgtacttgccatgccttcaccttgcaagcagggttcttttgtaattagctctcgaatgacagcaactctgcccctgaaatgggtgctctgcagtgattaagggctagtgttagctgtaccagggagatactgctgtgaggaggtgcctctgtttggtgtctgtgaaacattagatgctatttaaagtgatagcggttcttagctggctacttggcctctgccatctgttagtgtgattaggctggtctgattcacaggtgcagcctggggcggctgagattaagcagctgtggcctgtgtggacagaggaatgccacggccggggtaattggcaaggcaggaaaggggacgttgccattaaaacaattttttgccacctcaagtgtcaaatgcctgacccgattaatagggaaaattgcagaagcaccaaattctttgtattttcagccacctggaaaacactcatgtgtccagattgatttctttggtgccttctgattgtctgaaaatgccactggggtgtgtttgtatgttcttctttaggaactttgacaaatgatgctccagtgaccctgtgttgatggtgacgtttttgggcttttttgagttttttttttttttttttttttctccttttggattgagacattgaaaatttagttctgtatcttccagttggaaaaatatattgcaggttattccctctgctgatttgctagattattgatctaattttgttggttaacataagaaggcaagctcagctgcctgctagagtgttttttagattctgtacagagtacgaaaagcttgggtgccaaatacaatggcaaaaataacaatgaagaattaaagatcgggcgcggtggctcatggatgtaatcccagtactttgggaggccgaggcaggcggatcacaaggtcaggagttcgagaccagcctggccaatatggtgaaactccatctctactaaaatataaaaattagccgggcttggtggcgggcgcctgaggctgaggcaggagaatcacttgaacccgggaagtggaggttgcagtgagccgaaattgtgccactgcaccccagcctgggcgacagagtgagactccgtctcaaaaaaaaaaaaaaacaaaaaactgtatctattaacatcatgttgtacatgcattgaaaaacccagccatgggctgatttgattgatctttttaagttggtttcttcatcacagatgtgcagggcattctctggtcatattttagcagctgactagctgatgacctcacatggtaccagcactagatgtttccaagtggaacagtcctgtgatgtcattacaagcctggttgccaggaaataatgctgttacatatgcccctcggtgcaacacattttctccagaaagaaagttgcagtttcatatgctaatttttgaaatgcatccaggttgagggttttgaagggttgagaatttatcctttcgcatagaaaagtataagttaactagttcttgccttccctaggtgctaggtatgttaatgggttatctggcagcaactaggtagatgcatatacccatttgttcgagggatttttattgtttccagcttgtttcggtgattaatgtttctgaagagcttgagacttagtttttgagaagatcatgatggacgaaaagttcaggtccattgcttaactcgagggaagtgatggagagacagttgcatcaagactcttgctgctaaagtggttctttctctcgagtgatgagagaaaaagtaattttctattttggtttcattcctgttgagacctgcagatgcccacactccatgtcagggagaaaggctattttttttggaagtacctagggaaaatgaaggtagttagcctgagattccaaactcatttcattgattaacctgccgataacagttcaaagtcacctttgttctaattgggatttttacttggtagagatcctaagttggtaacagcaggcttcttagttgtgttgaagtttctaggaattgaaaagaacaatatcagtaataaaaacaacaaaaaacccacacaggctttgcaaatttttagaaattccctttgtaatgaaaacatcatcaataagttggtttgggccagcatagcagctcgcacctgtaattccagctagttgggaggccgaagcaggaggatcgtgtatacccaggagtttgagactagcctcgggagcatagcaagaccgcatctctacaaaaaataaaagattagccaggtgtggtagctcatgcctgcagtcccagttacttgggaggctcaggtgggaggatcacctgagcccaggaggtcaaggctgcagtgagctgtggttgtaccactgcagtgcagcctgggcaacggagcaagaccctgtctcttaaaaagaagaaaaagctgcttttggtattttatcacaaatactgttgatggtgttccatccaatggttggactgaatatctttctcagtctcctccttggtcaaacagcatagccaatgattggagaagtttcctttgaaggcagatcttgggaattcccatgggctaactggtctgctagtgggctcagttctttcacttgtggttaacttgcttggttttgaaaacatatatttctgattgaatgcctggctggttagcaagtttttaatgagatttctcaaagccacagacataccccctcataatcatatcctcactcacatctccgtattttgttagatttgttttctcttagtttataccaaactgaaagcagaactgcagggtagtggggagctctgagacatttttcccctgtcaggagtcaaagcattcaaatgtcctgattagtgatatttttaaaagccctaattatagactcgagacagaggctttagtggggctttagagagtttgtgagacttaatctaggagctggaacaggctgtgtttttaaaattttttgcatccataaaaatacagttggcagtcattggtggccgcggctcacataaatcttgaacttttgacttaattaccatgggagagttcaaagggcaggctggagtggttgaaggaacactgctcagggagctggagatgggcctggcctcagcccggcctctggctgtgtgaccttgatcaaatcacttaacctttctggatgacattgatatcatcagtcgttgggccagatggtcaccgaggtctcttttggtacagcctggtaatatgattccatgtttctcctttaaatcattgggccgtgttctctgttttttggttccagagagagagagagagagagagagagagagagagagtagattataaaccttaggtgtcagcattgagatgtgcaagggttttggtgggggcaggcccagcagcctatggtttctcactaagtttaaattgcagggtcaaaagaaatcacataatcctaccatttgttgacagaatcaatacctgtctagcacatagatacctggaaagtatgttcgaactggcggggaccttaatcagtgcaactacttcattttatagctaaagcttttaatagtcatccatccgtccatccatccgtccgtccatccatccatccatccatccatccaataacgcttgagtgcctactccataggctaaagacaactccagctgtaccctccaggtgccctactgttgttggtcagcatcagaaggagtatttttcagtacagagacactaatgttggaagcacacatctatcacaaagaaggggccctgagaaagaataacttggctctagggtgggaataataaaggctgtgttggagtcctttgaaggaagtttctgtgggtttataaatctctctttaactcattgcatcttaaaagacttctgttgtcttaaagtaaaattctacttaatattattactaatgtgcaatgactgttacagtgtagaaaatgataatgagtaggtatgctatatgctggtgatgggatttaattgatgggatgggattgattgattgtggctaggtctgactgttctttaaccagctcattcttagtatttgatgattaggagaacatcattcttgtggtacctattacatcagaaggtctaagaatgtcagagccaaaggaaccatacctctcatcgaggttaatttgtttcctttacaggtggattagtgtcattcattttgaatgccattggaagtttataccacacgtctctattagctgactttaagcccgctcttcatacacctctaaggtatataaagttcagggaaactcatgtgtccttagcttgcagattcatattgattgattgattgattgattgattgagacagagttttgctcttgtcgcccaggctggagtgcaatggcatgatctcggctcactgcaacctctgcctcctgggttcaagcaattctcctgcctcaccctccctagtagctgggactacagccatgcgtcaccatgtccagctaatttttgcatttttagtggagacggggtttcaccatgttggtcaggctggtctcggactcctgacctcaggtgatccgcccacctcggcctcccaaaggctgggattacaggcgtgagccaccgcgcctggcctgcagattcattttagataagattgttgagtaaacatccctgttaagcatctactatggacaaggctgatctctgcttcagtagatctttaatttggtacatgagttccttctccaaatgagagttgttaaagctgttcacgagccttggtataaaaggggcttccttaggtagaggagcccgttctaagtgcctggatggtgtttgtctccagctgttttgcagttcttgggaggccctggcatttccatgtgtgtcctttccaactgcaaaaacatacagaggacacaaggctgctgatgaaggaaacacagtagggctatcttatagtattattatttttctagatcttacagattcaaggttcacataaagctagtgtattttaggaagagctattgtaaaattataaaagagttccagccgggcgcggtagctcacgcctgtaatcccagcactttgggaggctgaggcaggtggatcatgaggtcaggagatccagaccatcctggctaaaacggtgaaaccctggctaaaacggtgaaaccctgtctctactaaaaatacaaaaaaaaaaaaaaaaaaattagccgggcatggtggcgggcacctgtagtcccagctactcgggaggctgaggcaggagaatggcgtgaacccgggaggcagagcttgcagtgagccaagatcgcgccactgcactccagcctgggcaacagagcaagacgctgtctcaaaaaaaggaaaaaaaaaaaaaagacttcctcccctcccgtatcaagttcattaaacatatttgtgagcttgatatttaaagagaggctgtgtgctggtgtgatgttagcagtcaccagggtggggctggtcacacatgggagcctgggtggagggttgtgcctggattttttatggtggcccccaaccttggatctctgagacctagatgagcagcactgcacccgtaccctgctgtatggctgtgtctgtgttttgcagaagcagattttataggtgtagctttgatgattgaaatatcacccgagggaagtggctacctgccagaaattccagcaacattatttcaccttagtccttaaatcactcccgaggcaccaagacaaaggtgcgggttgcccatgggctgttgccacaggtcaggcctgcataggtgcgcgtggtctgggccggtccctgggctgttacagactcacccatggcttggcccagtgagggcagaaaagaacaacattcctagttccttcagctaaatcccactttttttttagggaacataaaaatcatgcctaatggtatgtaagcacatatctgttgatttcttttatgtaaaaaagaaaagacattccacaggatcagctcagcagtaattgatgttatctgaaagagttactgcattaatatttagctaattcatatgaataggctattgtgtttacttaaacaaatgacatgagtgcagacacctgacagcatgaggtatgcttttcatttaggttagatttgtaaacgtctttgtgtagtgacaaagctcattatttgttttgtgctctcaatggtttctttttagtggctgtggctgtggatggatttttctaagtagaagcttttaaaatgaaagtttattgaaattgtttcagtatatgccaggccctgagagtcttgggatgaatgggaatcaagtactccctggtgaaccctcaaaagaataggtgcgtttatgggcattcaacacccagagccaaatgtctacccaggttgcaaatgcaactggattcaaaggaaggaattcagcccctgttccttctttctcctccttcctcttcttctctcctggcttcgatagttttgcccctcttcccactgtttcagcatcatatgggtgcacctaaatcccatcactttgacacttagataagcacagggataaagatacagcatggccttgtaaagaaatctcagctctacctttgacaacaggtttcaagagcaagcgtgaaggctaattggggtaggtgtttggatgcagcgatttcaattcctgattgtaccctgagtctggctgctaagtgaaggggatccttatcccccagggacgtgctctacacccgtagaatagaggagacttctaaatatgcatcagagacaaagcccctgcctagggccattttgccttgggtttgtgaactgtgtgtgctgttgttcagtctagccttcatcagaaataagcatagttatgaattagccttctacaatgttcaagtccctgttggtggctgtttcagaggaatacagggattttggttactactttgctaagacagaaacatatatgtgaatagttaaattgctgtacagtagaggttctggacaggaaaaaaggaggacgtgtgccttgacccaggctggctttcccggacttcagccttaaacatcagattggtggaaggtacggattccaacctcgtggagaagctgcatcttcttagcagtggagagtagggttgaagatagtgggctctggcatcagactgatgtggttcaaatcttggctgcacctcttccaagctttgtggcttttggcaggttacttaactgctctgtgcctcagtttcctcacttggaagccaagattatgatagtgcctttcttgttgaagcattgtgaagattaatgtgttgacatgtaaaaactctttgagcagtgcttggcaaagtagaagctttcagtcggtagtagtcattcgccattattagcagacatgaagaatttacagtggtattctggcttgatgttgtggcttttatttagaaaaaatatactttactttgtgatttaaaacttttttcttgactttaaaaaatcacttgtatttatgactttcggggacatttggagggcataactttaacatatcatttaattggtagcctcctcttaagttatcattaggtggggtggtagggttatggcattcataaccaccattggaaagaaattttttttttaattaaaaaagttagtatgtatttagtgatacagttttttttttgtttgtttgtttgtatataagttctgagaaatgtacgaatgactctctgggttattttattatattagaatgacaatttatactattgattgcccttaaagtaaggctccaatggataagttgatagggcttttgagaacaacttgcttttactagtgtgtatatgtgatcatttaataggtgtggcaatccaaaatgatctatttttggaggactgagctgtcgcagttgtatatgttgttcatatgtttataaaatagcattttaaaacatgatttggcatgaaattattttctggcatcaagaacaagagagagaaggggcctcaaacacttttttttttttcttcctgttggtagacatgaaccatccctctctgggaccttctgctcagccagctggattagacttctgaaaatattttccaaatgtaaatattacccaaagatttaaaaaatagcctagcatttacatgcaaagcgaaatgatcttacctgtttggagtttactcatggaggggaagctgtccatcagtatacattctaatactgttttccaaaacaggagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtagaattaagctttcagaacatcacatttcttacatttttgtttatttatttatttacattttttttttgcgatggagtctcgctctgtcgcccaggctggagtgccgtggtgcgatctcggttcactgcaacctccatctcccaggttcaagcgattctcctgcctcagcctcccgagtagctgggactacaggtgtgtgccaccatgcctcgctaattttttgtatctgtagcagagacggggtttcaccgtgttgtccaggatggtcttgatctcctgacctcgtgatccgcctgcctcggcctcccaaagtgttgggattacaggtgtgagccacgatgcccagccctacatttttgtttattttttgaagtgctcaaaagttagcaggaattagaaggaatactttaacaagaatcaataattgtcacaattgcccatgtcagggtttgatattaaaaaaaaatattaccccggacttgcgtgtaattttaaagtacaattcccgtttgtgttgttcttcatatgaggagagtttaataacagaagggtcgaaagttgagagtctgttttctatatgctttatagtgtataaaactaaaacgggtgtggagtttgagaagcgtcagtatagtttccctgtcagagcaggattgcatgaatagtgaggggacttggattagagactggagtatgaaatatgatgcattaagggagagtgcgtggagatgacagtggcaatctgctgtcctccttgaaggattcttgagagcacgtcacacaatgccatgaaattttagtctcatcactccctagggagtttgaaattggcagctgtctccctgcagatgcccgcgcatgctcctctagcctttgttcatccacttagcagacattgattgagcaccctgtgtgccaggcacactcctgggctctggggagatgagagggtgaggcatggccccagctccaaggggctcttagtccagtccagcaggagaggcagaggagaactctggcaatgggagggacacaggtttggttgaagttgcaggaacatgttgcatcccatggatgtacatggaaaggtgatattggattggcgtttggaagaataaggagaaaggaggtcaggaaaggattcaggtctgagttggaaggaaagatgtctcagaaagagagagatggaatttccaaattatttagtatggaaggagagaactgtaataattgagcatatgaaaaggactgaaggaaaccttatgatgaaattctctgatgcatttggaacataagtgggcatattagttacctgttgctgcataataaattgccccaaggtatggtagctttaagcaacatttattacctcattgttgcctggatcaggaatgaaggtgtggcttagctgggtcttccatctccagctgtctcacaggactgtaagcaaggaagggttgaggctgaggtctcattggaagggttaattggggaaggaactgctcatgtggttgctgttaggattcacttccttgcagagggcctcagttcctcactgactgttggctgggggctgcccactgttccatgccacacgggcctcttcatagggcagctgctgtcatcaggttgagcaaaggaggagccagagagagagagagcaggatcgcagaagtcagagccttttgtaacctagtgttggaagggacagccaccacttttgcttttttccattattaagcaagacactagggaggaggttgcccaaggacctgaatgccaggagacaaggggatcaccggaacccatctgggaaaactgcatggtgggaggaatagaagacgctctttagctcagacctcaggtcctttacagccaggtagggaggattcctcagtagcagcagtggggtgtccaggactgtgtctcacgtgtctttaacacaccagcatcactttagctccatcattgctgtaggtaaatgagcctcctttccacctaaaaatgccctgcaacccttttctgaaatttcttagacagttattcatctttaaaggattattttcttctgcaaaagtttttgcctttttgttttaacacttagaaattaacatctagaggccaaaattcagaggaaaatggggacagcctatgagtaagtttctaagaacgcatggtgggcagtgaacatgtgaaacagttatgaggcagatctgctagcaggtgggtactgttgaagcttgaaagtagaaatactttggttgtttcccacaactcctacttggtggtggaagcaggaggcagggggtgatttgtccttctgttcttagttcagtccttagaccagatacgatgagattcaaaggttggcccttttaaaagaaatctttttgaaaaaaaaaagttaaggatttcatggggggatgctggttagaaaggaagagttaagccactaaaatcacggcccctgggattgtttttaaccaccaaatgctttctgaaactcacataattgatgcagttccaatgatttatttaaatacaatctgagtgtgagaatggtggtcaaaatcctggtggttaactaattttgtcaattaagacagccttgtaaataagtacaaagaggagctgatgaggctccagagacccctgggctcaaaataaatggaaccgacatcattattatggggaaggagctttttgcaaatctgaattagtgattacaaatatgctaagagactaagagggcctaatgagaaaatgctgcctgatttttaacaggtgcagttcagtgttaattattgattccaacatttcgctagatgaagagcacctatgttctaaaagcaaaatgaggactcccagcagaaagcctttagcctgcccctgtggagtgcagatgaccaaagtgattttgttgtatcacgctgagccgtttctggagggaaaaggaaatggaatttcagtgtgtgggacaaaaacctaaaatatattttgctttaccaaaaaaaaaaaaaaaaaaaaaaaaaaaaggccaaaagcggcagagggccacacatttggatgcagtgtgctggcgtggtcctctcctttctggttctctggtggagaaaggctatggctgtagggtggggcggcctgggaggttggcccgctagttgcagaggtggtcagcctaggttgatcaagggcttttcacaacagcagtggcattgaacgttcattttggagatgccagaaactcttagaaattccactgagtcccaagggcttccgggacttgaaaaggaaagacacatttctcatctcctgggaaggttccttcagttacctaaggcatcatcttcgctaatgatgtgttaagccaaccccaggtcctggagtcactggagctcaaagaggctcattcccacctgtgggcctcccccatggggagctccttggctggctatggcctgcgtttgcctcagagagtccttgttggggcctgaccaaggcagactttggggagaatggtccctggtgttgggttttctctctgatattttcttcgttacctacgtagacttaaagaaatgtgcctctgggttgggcacagtggcactgtaatcccactgctttgggaggctgaggcaggaggatcatatgaggccaggagcacaagaccaacttaggcaacatagtgagacccccatttctgcaaaaaatttaaaccattagctgggcgtagtagtgctcacctgtagtcccagctactcaagcagctgaggtgggaggatcgcttgagcccaggagtttggggctgcagggagctgtgattatgcctctgcagtccagcctggatgatagaggaagactctgtcaaaaaaaaaaaaaagaaaaaaaaggtacctttgcacatttgacttcagggaactatattgttattttcattcctcggcacttcctcaaaagcaaagagacctaattgaaactcagagggcctgacatctaactgattcattcctgactcctgtccatttgccactttgctttattttatttttattttttgagactgagttttgctcttgttgcccaggctggagtgcaatggcatgatctcagcacactgtaacctctgcctcccgggttcaagcgattttcctgtctcagcctcacaagtagctgggattacaggtgcccgccaccacacccagctaactttgtatttttagtggagatggggtttcaccatgttggtcatgctggtctcgaactcctgacctcaagtggtccaccctccttggcctctgcgagtgctgggattacaggcatgagctactgcacccgtcccatttgccagtttatttaatgaagaagcaaaatgtcaagttttccaagatacatttttccagaaagcaaatacctgaaaaacttcttcaaacaaatgtgtgttatttctgcaatttttctttttcctttataattctgttcattccataaactatgattgtgctttggtggcctgtccatctcattctttctacccgtttatggattgggcacctcggcagccatcccctgcattacagcttgttttgaaatggcatgcatgtgcggcctataaagggaggagggaagacaaaaaaagcaaaacaaagtcaaagagaattatgaaatgtgacagaaagctcattttcattcaaatgaccaatagaactatttggaattcggcagttcagtcttgtttatcaaagaacccatgctgagccatccttaggtgattaagaatcaaattattatttttaaagtgcatgagcaaagtcttgctggatgttattaatatgtgattgatataatagtaaaggacttgaatcataactctatctccctaatcatacttattcctgggcttttgcgtcagtcttgaccatgggcaagttttttcagctctctgtgccccagaatcccttgccttaaaatgggaagattggctgaataatcctgatcccttcaggctctgagaaccataatttaatagtatcaccatcgtgtagcatcagccatttctcttcttaaacaacagcacagattttttttttttttttttaataaagaggttaccttcatggctagatatttcacagggctcaggacagttattgcaatttaatgcagaaaagcaagaagctggctgagataattaatagaccacctcaattctcacctccttcgtaggtaattatttaggcatagggggttcttaaaaaccatcttttatgccacttcgaagtgcctgcatagaccaagagagatcgcaggacagagggctcattcaacgtgactgtgaaattggcacagaagccctcagcgttgggtattacaggggttcaggttcccctggagcccctcagcagagagtaaagcattattgagcatgaaccaagtatatttcagatctaagaaaagatgatttttaaaacttttgttataatcactactaaactggttgttttgaagcataggttaattagatttacattttctaggttagttacttagatgtcattttaaagactttttgatgaaatgttatgcttaatccacaagtatgtttagggggagaaatcatgactaatgtacttatcagcatgtttatactttatggagattttttttcagtgaagacatttcagctttaatcccacatcaagcagtctttgatgaggacacaggtatatgtttgtattagccaacgtttatggactgctcccctgcgtcgtgacttaccaggtgcctcccatggagcaagttgctcagtccttccacagcccaaagaggcagacactgttattttgcccttttacatttgagggcttgccctacccctacctcataggtggcacagctgccatttggacctacgtggttttgcaccagaatttatgctcttgctaaactgcttgcttcaaatgtagttccgtgttttgtaaaaacactgttgctgttgaatgagaaacataatgaaagtaatggctccccaaaagcatgcaaagatctagcccatggtatacagttgagagcaaagttggggatatgatgctgttctttcaacttccaagacctctgtgggttatttatttgtttgtttttgagacagagtccctctatattgcgcaggctggagtgcagtggtacgaacatggctcagtgcagtcttgacctcctgggttcaagtgatcctcctgcctcagcctcctgtgtagctaggaccacaggtgcatggcaccacatttggctaatttttaaattttttgtagagacggggtctcacttggttgcccagactggcttcgaacacgtaagctcaagtgatcctcccacctcaacctcccaaagtattggaattacaggcttgagacactgtgcccagctggttatgaggtttttacatttattgtggtaatatatgcataacataaaatctaccatttaagtcattatcaagtttagtaggcattaattacattcatggtgttgtgcaaccatcaccactattttcaaaactttttcatctctccaaacagaaactttgtacccattaagtagtaagtactcatttcccctcccccactgcacctggtaacctctaacctactttttgtgtctatgaatttgcctattctgtgtaccttatataagtgaaatcaggatatttttccttttgtgtctggcttatttcacttaacaaaagtccatccatattgtagcatgaatcaaaactttattcctttttatggctgaattatattccattgtatggatataccacttttttttttttttttttttaagacggagtttcactctgttgcccaggctggagtgcagtggtgcaaccttggctcactgcaacctccgcctcccaggttcgagcgattttcctgcctcagcctcctgagtatgggattacaggtgctcaccaccatgcccggctaatttttgtatttttagtagagacagggtttcaccatgttggtcaggctggtctcgatctcctgaacttgccatccacccacctcagcctcccaaagtgctgggattacaggcatgagccactgtgcccggccccacattttgtttatccattcatctgatgatgatcacttgggttgcttctaccttttggctattgtgaatagccattgtagcaattggtgtacaagtatctgtcccagtccttgctataagtttctctggtatatacctaggagtggaattgcaggaccatatggcatttgtctgttttgcaaaagcaaaaatggggaagatcgtgacatttttaaagagctaagttcaacaggcggtggatgtcctgccgcagccacctttgtgagcaccgacaagcaacgggcctctaagaaaacatggcttgttgtaattcacttcccacctcctctggagagatccagtggttgtttaccgagcagagggaagagtttctgccactggtcccgaggatcagattgcccggccctgttctctggacacctcctgaaaagcaaacttcttgtatcaatgttggagtttaagcattaacaggtgtttgcctccacatctgcatggtggtgagcaacagcaggtacctctgtccttgacatgcaaggttagttggcacaaatgctttcagaaaggatggcttcaagtcccccaggcacctgctgaaagtgggggactgggatgggagaataagattttatgcattttttgttttttgttttgttttgagacagagtctcactctgtcacccaggctggagtacagtggcatgatctcagctcactgcagtctctgtctcccgggttcaagcgattctcttgcctcagcctcctgagtagctgggattacaggcacctgctaccatgcctgactaatttttatatttttagtagagacagagtttcaccatgttggccaggctggcctcgaactcctgtcctcaaatgatctgcccgcctcggcctcccaaagtgctgggattacaggcgtgagccactgcacctggcagattttttgcattttaatggcaactcacctgttgaatgaactgatctgttcatggggtgggtgcctctgtgaaggccaggattacaagagattgctgtcttcctgggaaaattgggtgctgatactggcgggagaaaggcttgggaatatctttctgatatcacatggacacagcgttctacctggcacagaataaaactttgtatcaccttctgcatgtttattctgcttgttatcgaacacctgagtatttggaaatgtctggatttttttgcaatgtggaaggtaaatatccaggtgacagcctgggtctttaacctttcacccttcacctttcactgcggtgttttggtgtcaacaaactaaatctacattcccagttgtcacctgagggtagcctgggatttaataggcattttgggggaatgaaggtaacagaagaattccgaaaaacctgtctgggccaccttgtgtctttgtgtggatagggtgtggaatgttcatggaatccgcttcttgtattatacttgggagtttaggccattttgcttcagtctgctttgtttcaatattgaaatgttattttaaaaaagtctttagtgaacatagttttgaagtccatgctctcctgttctgttacttggcagatgaaaaataatgatgaattccacaaagatttggccatgagcaggaaagaaaaagagtcgtgcttgtgttggttggtgcagaatttcttctctcactggcttttgtgtttgttttgccagatccattggttctgcagggggtagctactattgaatgattatctaaggatctgttttattatacttttttgttgtgtgtgttgagatttctgtttgtttgaaaggtagaaataagaaaaaagtaggcaatacccataatcccactgcttaattatataaagtacattgctaacaatttggtatattttctttctgattttagctgtgtttatagtcaggcttatactttcagttttatatgcatctttagggtggtaaatgtgtctgcttttttcttttttttaaataaattggaatcatgaattaactgtttttcatttatcaataactgtttaatgataccttaccaggtctgaacataatacttcattctttttatgactatagactacgctgtttgaatgaactttccatcagttcatacaggatgaactatgcattcttaatgtctctctccttgacagttttttgctcttacaagcagtgcttgaagcagcagttttgttcatgtgccttgaagtaattgtgctattttctgtgggctagctttctagaagtagaattaactagatcaaaaaaaatgtgtgctgctaattttaataggtaccagcaagttattttacacaaaggtttttctcaatttatgttcccattctcaattggaatcttttatttccctacacattcaccaagtactgaataacattgatccttctaatttttgttaatcagctggtgaataacagtgtctcattattgttttaatttgcatttcccggatcgttaatgaggttaagcatcttttcatatgtttattgggtatttacattccctcttctctgaaagcaaagacggtgtatgtgcatttggcctaactggcaaaagaattgtagcactgaaaatctgaggaatttagaaacacgcgttgtatatattacgtcggaagagtggtttctttaggtttattctgaatctccatatggaaatagagtaatgaaaaaaaacccccaaactttgtgcttttgtttgccatctttataaagttaactattgtagtttcttagcttgctattaagcaaccactaatcaatggtaggatatcccctacaaaagtgtccagcagtcccactgttggtggatttaagagcatccatttggaaaatgctacagctcataaaatttgggtcaataaatcaaatactggagcaatggtgtaagaaaataaatattaacagcactgcatggggcaatattgatctagtaccaagatttctggatggacagaaacaccctgtttggtaattgtgcttctcattgtaaaaacatttttataaacgttaacttattaatatttgtagtgcatctccaggaagtaaatattcagagagcacgtgctcttgaagagggatcttgtatggaatgccatggccccagtgagagacttgagctgaccatatcccctggggttaaaaaaagggagcagtgagccaagctgcatatgccaagatttaatgtgtcagccgagtcaggcgatgtcccctccctgtgcagttcaggttcagctccatttggaatactccatgtgccaaatctggatccaggcacaagaaagacattgacagtttgaatggggtccagagacaggcactagccgtgattaagggcttatgggcatgacatttgagcgggggctcaaagaactgaatatttacagcagggataaatgctggattacatggcttggtgacgtggggacccgtggctacatccctaagttacctgccacatgactggttccccgtaggcaaagagagaatcatttctgttacccttgagagcttgaggtgaagggagggtctccttttgggtctgtggacctcaagtaaaatcaaggagcttatacctatgtgtcccatgctcttagcataacgatgccgttgtagcacccagggatccaggatttaggtagggaattctcattgcgctggaagatttagcatccatatctcctcctccttcagaagacacattctgcatggaaggtgcttatctctcttaaggggagacgcgctagcatgttgtctgggtcctgttacaagtctacggctcaaccaagagcagaaagcgagtctttgtcatacagtaaagactctccactgtcgatcagatgcccgtagattcatttttctgccagacattttacctgcgacagtgaggatcagtttcccatcaccagctccaggctgttagactctgaaactaccttcgtagttgtcgatgactgcagcagcccagcaaagtggctgaccagaactatcttaactcactgcttgtactctgttaaggaggaaggaggccaaccttcatccagtgatcctttctaagactgtcagtgatgagcagcgacctcgttttagaactcagcagcagtacctccaccctgcagtcatggcttgcatagaactgagtggctgacatgaaaaccgtggcactccagtgtgctcttcgcatctcttaactctgttggcaggctaatcactggcgctgctttgcaaagtggacagctgctctgccctcctgtttttatagtggagtggttacgagatgattttctttattctctagtttcttatatcactcatgtgcttgcagatgctctgcctgtatttgttttttatgtgattaacccaaaaacacttgcaatgcccagggcatggctcagaaggtcagttgaaattcctgaaatgatagctaaggttagtaggccttgactgtttattttttcatttcgtttcactggagtgccttgtccaaaacacctgtagagaatgacttggattcagatagaaatactaaagcctcaaaccctgaagatacaagatgttgcattttgtggtaaggaaaactctcgcaagtttgaaaatttgagtctatggaaatatttgaaaagcagggggagaacataagaatggcgtctctttgtgtattgatggtaccttgggtaggagtcacaacagctgattttcacatgtgctgcttatctttgaaaagtctcaagaagtttgtgaacggacggatatacaacttgagttttgtaaggattcattgccgccatatttggaattctgggtatttctctgaggaacatgtatatctattcagccacaaccagagatgggaagggcagactgatgttcccagctgaaacttcttgagacatccagacaacatctgagaactatgagccccttaggagaaatgaattagctacggcagcacagagggcttggagcagtgcctggcatatagtaaatgctcactataaatgttagttctacatggttctgtgatgccatagaggctgaggcttcctagtggatgggcaaactggtagctcgcctgcccgtggccattggtaccaggctggctggtgttcaggctccctggccagttggcctctcctagaggagccctcaaatccattatggtaacagacccacgctgtacactgccgaatactcctgcagatctgaatatgtcaatatttgcttcacaggtgttcaccatgatgatgatgatggttttcatttctcacgattcttaatgacagttatcaatttagaatttaggtgattcttccatacctttcttgcctccttcagcttctttttaaatcaagaaagcacagtacttggtattctgtgctaggattgttaaataaccgcctttgctttgatcttttcaggtacgaaaccagcactggagcctcattatggaaagtgtggtcccatctgacaagggaaattatacctgtgtggtggagaatgaatacgggtccatcaatcacacgtaccacctggatgttgtgggtgagtttgcctctcctcgtgtggcggctgcataccagcccattcttgcttgactcgtttgaaagcatgaacgttaagtcctgtttctcccataagtttcaggagaattggttcattcttattctttctactatcattttacaaggctgcttctgtcatctgacaatattctgttttccaggcagccagggtttatgagctttgcatgatcctcatggttcccaagcgtcatctgtgtaaagtggacgtggtatgaaatgtctgacattttggaagctgagattactctgaaaatgttaattgggcaggtgaaaagggtacagatgtgctgtagcagacctttggttttaaaagagaagcatcatttccccaacagggcaactgtagaaggccagctgaagagtaaaggaaaaggtctgaggactgagcctgtggctggctggaaaaaggtgaatgttgagggcccttcacttccatcacaagaaagtcattagacggtaccaattcagtgtctgttcctggcatctatttcctctgtgcaaagggaaccatgtatatgagcttataaatacatttttgtcagagtgcacagataagtaggccattttaattaaacattgaagaccacctcgcctgttgtcttggaaattcaagtttcttcccaggttttgcctgtgatgatggggctttgttgtaactaatgaagaaaggaggtttctgtgtcttggaggattgctaacatatggaactctacccaagacatacttcattgttgcaggatggcaggttaagatcccttccatgtaggggccatcttttctctttcctgtcatgtgccttgactttcaacctgccaccttgagccctttcttttggtttgtcctcccctaaatacaggttgctatcttctgctgtagactcaactcagttcacactcacgttttgccgtaatgtgactgttggtaattccacaagcccacaccacccactgtgcctctgtaaacgaagtgtctcctacatcatagcctgtgcgtgtgtgcctagtatcatctcatgtgtgggtctccttcaataaaacatctttgaagagggagaccccgttacatattggaattgcccaaaaagccactaaaaaaataatccaaaagcttgattaaccaaattgcaaagatttggttaattaaaattttaggttaactgaaaagtaaacaaaactattttgattttctgtcaagttaaatggaattggatctacgagacactctgccttagaaagcatgatataaccattacttccatttgcatataagcattcagggaaaatagtgtttattcgaagatttgagttttgttcttcagaagccttcatgtgaaatttgataggtccttgaataatgttgatcctatagatattcataaaagagtgagttttagagctctttccccatagagaaaacatgtggcatgtttcttagtgagaattaccatgttcagatattttacaaaacaaacaaaaagagaagtaacactcaaatttgagaagaaaatgattaacatttgtgttggcattgatacactgtaaatccattgatcaaagagcatatgacttggcctttacctgggttcctgtgtgtaccgaatgtgacgtaaaactatttctatttagggaaagagagattttgggctaaatgttctaaatacctaattttgaaattaagtaatttattgtgggaaaaaataattgagctatagcagtcttttgggattatagctttgcataggtctacaaatcattcattaggctgggctggggccattctaggcatcgtggagtcagatggcggccactccggtctgggctcttgcttaaagcaagttttaggttgagttgttatgtaaaacattcaaaagcccctcaccccacctcccctttgagctttctggcggctcatccctgtgaagccctgaaatctctcttagagtttagggttgggatttgaattgggctgctgaataatggaattgtgctgtctaatgttaatcccctggcaatcagtcttgttgaaaagagcgtatgattcagtggtgtaatgtagagagagcgtggagtgtatggagtaatgcagagagaggcctgattatgtcacaaatttgggagatcgcccagctaaacacgggccaataatgacacaatgctggttgggaatatccattaaagctcaactccaataattttccaagccttgaaccttctttataaatagaagccaaaagtcagtggagtaaaaggcattttcagtaaagatggaagtgtgaaatactctcatctctgctcaaaaccctagtaattgctttgcgaagcactaataaaataagaattgagtcagctaaagaggctcatatagacgtacagggttggcagtcattctgaacatctcagcaagtggaaacaaaaaggattcaagcttaagcagtgaatttctggtagcccacaggcccaaatgtgatacactgctgtgtgataacagcttttcagccacctctctgtttcacagaaaatcagaaaccctttcccagtgaaagcgaagtcccattcttgcccacattctttggggttttatttttgtttctatgatacatagattgtggttcagatattatgaagcatcaagatgggtgagatctttttattgaaattcttccttggaaaggcattcccataagcactttaatgtaaaagccgtgtaatttaagtgacattcttgtgttctagaattaaacggcaagccattgttgtgtgtaagggaaatgctttcatttatgggagcccttttaggagcctggcttgatcctcattaaaattgacaccattacttttcagctatttactgcaagggaaaattagtgtgatgctccacgttttggtaattgtggcgataataaaatgggctcccctaaagtagctgtggctccgggaggtggcgagccttcaccatcgttcatcattgagtggtaccagagccctggattctgactgaggtcctgtcactgtgaagctacaatgctgggatgactcattgcactttccttgtgtccaaaaatgaaggaactggaactcatgaatgttagaacaaaaaaagcggcttatgccgtggaatgaacagcaggtttgtccgtggccatacctggggcccctagtgaattgggacaaattatttagcttttctgaggctctgttttatcatcagtaaaatcggaatgatgatacttacctcattcctatgatggttgtattaggtttcctagggtacccctaacaaattactataaactaattggcttaaaacaaaagaaatctattctcttacagttctggagcctaaaaattcaaaattaaggtgttggcaagttccacgcccctctcccagcttctggtagctgtccttggcttgtagaggcaccgctccaatctctgcctccatcttcatgtagtcatgttctcactgtgtgtctcaaaatctccttctgtcttcctcttgtgaggacacctgtcactggatttagggcccaccgtaaatccaggatgagctaaccttgatatttttaacttaagtacttttgcaaagacctttttcttcaaataaggtcacattcctagtttccaaggcttaggacgtggacgtaccttctcaaaggtcacccttcagctcactacattagttacgaggcatcagttgggttagcagatgaaaacatcaggctggcaggtaggtggccagcaacaaatgctggtttcctcccttccaaaccaggattcttttgagggttagaatggatctttaatagcttttattagtctcaatcagaagtcttattaaacaaacagaatgccattttggggctgggcatggtggctcacacctgtaacctagcacttggggaggccgaggcgggcagatcacctaaggtcagcagttagagaccagcctggtcaacatggtgaaacctcgtttctactaaaaatacaaaaattagccgggtgtggtggtgggcgcctgcaatcccagctactcgggaagctgaggtaggagaattgctttaacctgggaggtggaggtggtagtgagccaagatcatgccattgcactccagcctgggcagcaagagtgaaactccatctcaaaaaagaaaaaagaaagccgggcgcggtggctcacacctgtaatcccagcagtttgggaggccgaggcaggcagatcatgaggtcaggagttcaagaccagcctgaccaacatggtgaaaccccgtctctaccaaaaatacaaaaattacccaggggtggtggcaggtacctgtaatcccagctactcaggaggctgaggcaggagaatcgcttgaacgcaggaggcagaggttgcagtgagctgagattgtgccattgcactccagcctgggcgacaaagtgagactccgtctcaaaaaaaaaaaaaaaaaaaaaaaaagccattttgggacctacagacgtggccagaggctgacattgacatttcctgctgaggtttccacctttgattaatgctgtcatcaaggccatcctgagactgatttggctgttggacttgcaggagaggggtgtggagtttgaggacttgaagttcatggagttggcttctttacgcccacccctcccctcccccactttgcagtggaggaagttcaggttcagctggggtaagtgatttgctaagtaagggcttggagcaggcattctggagctggggcctccatctgggtgttctccacgcctatctgtatgaatgctccttgctctccaagcggacttcttcatttgatgttcactgtggtgtgtttcagtagtgactgccacagcccgactctaaggaggtgctgctgtcaccccaccctgctttcagttctttgctgcagaagacagaatgtgcgggagaaagatgggaccttaaaagactagttgctcttcctcactcatgtagacgatttggctttgaatcgtgaattattgcttcttttgggcattccagttctgcatttccagagaccctcaggtatgtcaagctttttgcctggcatttgatattttgggggcaaagtacagtggaagtggaaatggtgcctctggttttgtcaaggccagatatgtcttctctccactccttgtgttttttgagacagagtcttgctttgttgcccaggctggagtacagtggcatgatcttggctcattgaaacctctgcctcccaggttcaagtgattctcctgcctctgtctcctgaatagttgggattataggcatgtgccaccatgcccagctagtttttgtagtttttagtagagatggggtttcaccatgttggccaggctggtctcgaacacctggcctggagtgatccgcccgcctcggcctcccaaagtgccaagattacaggcatgagccaccgtgcccggtcttttatcagtttaactttccagaaatttgttccccctgcctgtccgcatcccttcaaatgaaagctgtaagcagcaggcagttgttgtttgggggcccatcagaggccgcatgtcacttctggatgggtcaggcatcactaccagccctgacttgatggcggcagatcagcatggcactgtcaactagcccttgacataaatctgttgtaactcagccccagacatgataggacacagcctgaaagcgcacaggaatccgtaccagagcgaagtcccccctcaggtgtgtgttcaagaatgaagcgtcttttattccaagcactgactgataagctcgaatgtggagttgacacctggaagggagttttgggagcttttggcagcccatccccagtggaagaaggaggaatggctgaaattgttgactgcttggggcagcctctgtcccaggaagacaaaggctccagtgtgatagctgagctggggccaggggacggaggcacggcggagtccctcaaaccacagctggagtgtgaagtttggactgtctcctgggttgggaacaaagtagtggttaagtaaatgaagaagcggtggcctagttaattaattaacctgttaattcattactgaagctgtcaagattcagtcattcctgctcacttgctcgtgatggaaggctgcatctcagtctcggcttccatcacactgtggcttctggatggaatttttgtttctgtgtgtgataaggagtggctgtggtggcatcatttaaatgacatgattctgcacgtccagagacgttaggatattgaaagcctgaccattaccttttaggttgtcatgcttgtacctgttcctggcacaaggtctcggctccgtagagccctgtggggttctgaacttgaagcctcttgacttagaggcttcctggccagggctcatttgattttccatactcctgactttgctgccagtgaattcttttccatttcttgctctgagtgtaagacttggtgtcctaccctgacacgggctctgcatgccagctctagagttgcgaaatctcaccggaggggggcagaaagcccctctgttgagaagggattggggtggcgtgccaggtaatgggtcacagcgacagcctttctaagtgggcttatttagttgacagatcacggaaccggagcggagttgaggaggaagcaccttccttttgccgctttcgtgtccccagcagccatctcatcctgttcttataaaccatcgctgtcacagacaacccctaagggtctctactctgtgccagatgccctctctggaggttcaggtggaaattacgtggagaggggtgtcaagttctgtttccacccttgctaactctatggccttagaaaaggcatggaacctctgagcctcagtttccttgcctgtaaaatggggtgatgactgtttccttgtagcactatggggaggaggaggtggtaggagaggcagcgcttttaaataatagtaccatgcaactgttagtcgttattgtgcgttggtcccatacttcctcttgcatctccagacagagccgtgcaccctgagcccatcctgatgaaaggaggggtcagtcctgtcctttcctccaggatagagatttcaaaacttcctttggtagctactgtttaatgagcttttgattgctacaaagcagcttttcattcctgtttcacaacagggatcccggggggcaaaggctggttagtggcagctagatcactccaaacgtactgactggcaaatacagactctcccgcagaactgaccccagcaagaagcctttgggagcaggtggtattctgcgggtgccagctccctggggtgggagcaggcacacgccagcctggatggggcatggtagaactctgcgatgtcagcttttttgtcacattctctgcaggctacccgttgtcctttgccccaccattgaggaaggaagccttattgattgctttcgattcttgcagggggcctgggtgaggtggctggagagagggctaatatttggtctggcatttaatcttggcatttcatttatggtgtgggcaaagaggatgtagaagtgttaaaatcaagttaatatcttacagttttatgtaagaagaggttacctggagattcaggtgaggatggggcagagagaaagctgcttctgtcagagcttgggcaaataaacttgccatgaaatgtcaatttagtgatggcagtaagagtgtgcagtaatgtgctggaacttagcgaggtttctatcagcgtgtgctgaattgaaataatcaaaaaacagtttaataagttgcttatatttggagttttgtggttcttaacattgcaaattctgaagcaagaaattagagtttctctctaaactcatttactcatgtggctttatcaacggctgcctttgtaaaccgaaagacctcagttgggaagttttatgagacggagtcttgttctgttgcacaggctggagggcagtggcatgatcttggcccactgcaacctccgtctcctgggttcaagtgattctcctgcctcagcctcctggtagctgggattataggcggacatcatcatgcctggctaatttttgtatttttagtagagatggagtttcactatgttgcccaggctagccttgaactcctgacctcagatgatctgcccgcgcaggcctcccgaagtgctgggattacaggcatgagccaccgcacctggcctgccaactcttgttaagatgtgagtgtggaatgctgtgtgttcttccccttttaaaagatgtgtctgttggtttgctttcacggattccctctcccttaggagacccggctgttgtattcatggtcttcatgcttggtttgttttcacagtcagagaaggtaggatgctgtagggttctacctacaggtaggatgtgctccttacttagagatttggaagggtggcatcagagaaccactgtgcgtctttcatgatagctggtcaaatgtgggtgtctgtgggaaatagatggccaagggtgtcggtgttgctgtggggaggttgttctgtttcctcttctgagaagagacagatgaggcgatgaggcaatgggagcctcattgctttggcttggagggagaaaatagagcagagctctctagctgggattttgtgtatttgctgagttgcagtggttaattctctatccttgaagcacgtggcacgctcacgcagcctttatgtggtcgagagggtgacagtcacttgaatgaggtataaggctttgccctcatggagttcctcaggtcacattttgaggtcgaagaccataaattgggatggaaatttctagatcttgatggaactccaactttttctctctttctcaaagcctctggattacaggattctctcaaacaaggctggcaggaattctgtccatcccaaataagtatgcaaatctacaggtcaaatggtgccccagacatattccccactggatcagggagattgtggtcttttgagagacaaacattgaatattattctagtaggatcttttggaaattatgctctattagaaaaaggaacttttcattttactggttcagtgtacactctggactgaaactgaaaggtaaaggacttagccctttaaattttacattttggccgggtgtgctggctcacgcctgaaatcccagtactttgagaggctgaggcaggtggatcatttgagatcaggagtttgagaccagcctggccaacatggtaaaaacccatctctactaaaaaatacaaaaattagccaggcgtggtgttgtgtgcctgtaatcccagctactcgggaggctgaggcaggagaatcacttgaacgtgggaggcggaggttgcagtgagctgagattgtgccactgcactccagactgggtgacagagtgagactccttctcaaaaacaaacaaaaaaaattaaaatattaaaaattagccaggcgtcatggtgcacacctgtagtcccagttattctagaggctgaggcaggagaattgcttgtacccgggaggcagaggttccagtgagctgagattgtgccattgcactccagcctgggcaacagagcgagactccatctcaaaataaataaataaattttacattttggactgaaaaaacaaaaccattctgtatgtgagactctcaccgagtgttcatagggagggactggggctggggcctgacttgaggcttcccatctggcttggacagtgagaagagcagtggcgtttggattgaaggcttttgtgatctgggtgactattttgaagtttctctttaggtcatgctgtacttagaagtatctagaaccgtgattattttcagtttctgagtttcatctccaagaaaacaaatgggatttattgttcagcctctcatgttattcctatcaaagggaggcatttcttgtttgctcagatgggctgaaagcttttacttctgctcgaaccgccctaggagcaaaacaaggcatgtgagagagatgagcatgatagattttctagacttctctagaagaaaggctttttagatggtgaaggttgatgaaacctgccagcatttttacaatggacatccctctatgtctgcacatctcaatctccttcattcttactagtggccaatatgctcttctttcacggatgtagtacaattcgtttaatcatattaaacaatatgattgttgtgcagatcttttgttttccagtaaaaaaaaccctacagcgacaagctttgtccacacttatttattgggcatctgtgtgaatatttttctaggacagatttgtaaaggttggttaactggatcgtttttgatagatttcagtcaaacgttttaaagctaaggggccttacttacttggagtggttgctgtctttgacggagggctcccctgtggtttggtttttagcttctttgcaaatcatttgagagaagatactctaattgggagttcacccattgtaataagagggtatacctaattcctggacattaaaaaagaacaaacttttccagctcgaaggaaacattttcttcccctgaaggaaacccagctatgcagacaccagctgataatcttgcattcctgaaagatgttgcacccctatggcaagtggcggctgctgaggctctgacgtgactcccaggcatgaacgctctcagctgtgtttacctcagctcctcgggagggagcctgggagactgacgcctgagttttacatcagtgtcaaaacccaagcacaacctagggagggacctcctgcctagtgtgtgtgggtcaggagatagaaaagctctcactgagtaaactggacaaggtcaatatacatcgctgattgagaaggtaggttttccatgaccctagaaattgatcttgttcactctgagatattgtcacctttgttatgtctcctttttaaaaaaaaatgtggtaaaatatacataacataaaatatacctctgtaaccatttttgaatgtgtaattcatttacattaagtacattcaatttgttttgcaattatcattattgttcatctccaggacttttccatcatccccaaaccatgactccttttagcaaaagagaccaatttcgaacgtaaatttggcataataactctctggttaccaaagaatcttcagttctggtgaaactttttgaaggcagagagctcagagtgtcttaaacacttggggtgtaaataacacacagccctactcctgtaattcgcccaagaagacccaaattgatacccagctggtagaagccactcaaccccaagccaaataatacagcctgtaacattaattagggaaggtactaataatacagcctgtaacattaattagggaaggtactttgcctccacctgctttggtcttcccaggccctgagcccagccagcactttactctcttcttcacttcatcgagcaagcacaaaggcattagtggtgttttgcttctagcatttcacagggtgcagcctccataagtcactttgtgactttagtgctggagggaggacacttcatttttacccaaacaagtttgttccgcagacttcactctctctgcaaagagacgtgtgtgttttagaggaagtgggagccccagccgattctgcaagacttccgagagtcagatatccagacggaagatgcggacacctgggtgaccagacagcgaagaggaaagaacaaaacgagcatgtgccaagcctgtgagggagaaagggcaacaaaccagtgaccttccacagaaatgtgtttaaacaaaacaaaacaggtgattctgggtgcccagcatcccagcccactcatctattctaggaggtgacaagccaagatactggctgtgggcacctgggctctttctgaaggtggtcttcctggccgtcatagcgttccctttttctgctaatcatttttagttctgaccttcctttgtgctgatcttcagaagctggagaaagcttcgtatttctgggaaaacaaaacaaaactcagaacccaacgagatttagcctgtcaggcttgagtgcgttaggtggagtcttgacaaggcaatgaactcattctactaattgtaattagcgtggggcctttagcaagttctgggctcctcagacttcagagagctttgatcggcctcctcctcctcctaataaccatgcctcatgctaactggtttagtgcgtttttatgcaacaaaagcaaccaccgcctactctttagaaaaaagctaggcaggctttagaaaaagaattctcagttgttttcacttgtcctccaaatcgcagaatgttctttcccttttcagctctttggcgttgctaagagactgccattttggaggaaaggtaattaaattttgattttaatttaaagacagagcaagcgaggttatccacgctccttacatgaatgggggcctgagagcaggagactggctgtttccagatcaatactgggaactccgtgtgattcgagtctcttggtgtgtgactgccggagagaggtggctttgaaatggctctttgtggcaagtactgcctaacttttggggagaaatgctcaggagaccagtgtgagccgggaaaccagccactctgtgcttgattaatttataggtgtaatttaagagcctggttctccttctgatccccgggatgcatgtttactgagcctgtagacatgaggcctctcggctcggtggacattttttatggcctttgctatgtcagagcaaaagttgtagatctcttatgagcaaacatattactatgtccagaggaggactggcatgttataaaatttcaatggtcaattaacaaagatttattctttgtcactcaggtatttttttcctctctctctctctctctccctcaataatgacctcttggaaggaagcaggctgtgctttcctgctgcagtctttaggtgggttatggctcccagctacagagcagggcttgacagagcccatcctgatatttcaattcttagcagctgggctttctgctttagtagagtggacacttgaagaaagggggcgagaccgagagtgagagagagagaacgctgggagagaatgtattttttaaagcacttcagcctgtgtttactacgcgtttatttggtggaacctcattccagcagtgcagccaactgtcccggcagcagtggccgcaccctttggactgctttccattccgtcttaatttggaattcacacagccaccttccaatcactcttttgaaggttctcatcttgttccaggtccatgcactgtgcatttgcaacctgctgaacctcagaacgtctattcttatatgtgtatatatgtaattaaaattacagtaaacagaggagctactcatcagcctattttccatgtgtttatctcactccctttgtaaaaaggaaaatctgttttatataatatctgagagttaaacatgctagaagagaatcttgcctaaaactgtaaatccttcctgtccttcctggtggagaagatgtgatttttgttatcacatagaagaagagatgaactagcactgggctttagtctctcgcccagagataatacatcaggggattctttttatatcagtttgttgcaaaaaagttgcaaacttgaggggtttggtttgcccagggaccggggaggttcctggtggggagaacacatgagctctttgggtcatcgtcccctttgtctctgccgtagtgcccgctgggccaggccacgaagggggcccccactctgcccagcctgcatcctcgtccaccatctgcaccctgccatcacctcggtttttcagaagttaggaaaggagtccaggcgctgtcatccacttactgttcactgtttctgaggttcttagggattccgaggggtggtggatcgctgaagggttcgagaggaggagcgcagcgttcggcagatgctggcatcctgggcccttttccaagacgtccaggcctcctcctccgacttgtttaagggcagagaataaggttgcaaaggaaatcaaagcctgatgtggagaaatgaaacatgagacctactgactttttaaaaacattttaaataacattctctaaggtttcattttatactgaaggcagctgtaataagtttggaagacagtgtaaggtttctattacagaacaatcctgcttgcagtttttctaccagaagtgagaaagggcggagggggagtggaggtggttaagaggttattttgtataaggtgagaaaatttgaaaagatgaattcaagactgcaagcgtgtaacatttggtatgctttaatttgcaaatgcaataacattaaaccattgcaaacttggggtgtgtgtgtgtgtgtgtgtgtgtgtgtgtgtgtgtgtgtgtgtgtatacatagccgggatagcattggaataacttaataactggagctcagcagcactttgaccacaaggaaaacaagactgcagctctgtagtgggccctgccagtgttgcctcagtgactaaattccctgccgaagcctggcgcaggccagagatgtcaggcgggatgaaagcactcattgttcacggggcatcatggtttggtactgcatgcacaatgtttacttgtgaaacgatttattagaaacaaatatgtttaagaaagaggacttggtttgaaactcagttgatctggcttatgacatttaagattttatgacctttgtttctaagaatagatgtgtaggcccactgtaaatatttatcttaaaacgcacccacactacacacacacatgcatgtacaagtgcaaaactggaaaacggagccagggcatgaattgatactaaagttcacatttctgtgtgaaggaataaaccttcttactatttgctaggtgcataggagcatagtttgtgaccttgtctggcaggatctagcccagaggacagcttcccctcgtgctgtgaagtctcttggtaggaggcctggggaggagaggagcgtgtgtctgttcgtgcgcggacttaactctgcccttcccacatggatgaggccagctgggattaaatcagacctcggtcactgcccgctgtggacaggtccctggggtgtccagccagctgctaggcctgaccaggaggcttgctggggcccatccctgggtcattgtatgagccagagagcaagggtttcacctgacgtctgaaggggcccagctttgagattttctgcccaccaacaccagaagtcttaacttcaggttctttgctcagcctacatgggcaatataggggcagatgaatgatttctttgcggctccagtatccttatctttataatgtgaaaacatagatgtctgtaaagtgatgggagattctggaatgaaatgtgctaagagtaaccactagcactttttctttctttttaaagaccagcaacaggcttatgcagtaaaatcaatttgcacatggtctggctcttgtccaacaaattccactagatgatgttttaatctgaaaggtccaatgatgtagatatctattgttctaatttgctgtttccagcccagtgcatggggattctcaggtacagtgcagagacatccttggtgtgctgagctggctgagttctcctcatttccctcagttgttttttaacactggaggttagggtagtggtacccacacctaggggaggaagagagggaggaggctggtaagtgcaggcctgttgggatggagttgtattcatgaatggacacatgattgtgttttgtgtggcttttgacagatctgtgtaggaaggttccagtaagtttgtacgacaagatcaggtagcagtctggtggtctggtggttatttaattctttttattttatttcattttattgttgcaagaatgctaagcatgagaactaccatctcacctaagttttttttcttttctaagacggggtctcactctgttgcccaggctggagtgcaatggcatgattgtggctcactgcagcctcaacttcctgggctcaagccattctctcacctcagtcccaagtacctgggactacaggcatgcaccaccatgtctggctaacttttgtattatttgtagagatagggatcttgctatgttgcccaggctggtctcacactcctggcctcaagcaatcctcctgcgtcagccttcaaagttctgggattatgctcaaaggcatgaaccactgcgcctggtcttcaactaagttttcagtgtacaatacgttgttgttgactataggcacgatgctgtgcagcaggtctctagagtttgctcatcttgctttactgaaactttatgcctcttgattgcaactcaccatttccttccctgtcccagcccctggcaaccaccgttccgctctttgattttatgaatgcgatgaatttagatacctcatatcagtggagtcagtcagtgtctgtctttctgtgactatcctgtttcacttagcatcatggcttccacgttgtcacatattgcaccatgtcctccttcttcatggctgaatagtattccgttgtgtatatagccacattgtaaaaattaatcctttggcagacacttagattgattccatttcttggctattgttaatggtgctgcaattaatataggagtgcagatcctgattgcagttcttttagataaatagagaagtgggattgcaggatcttagggtagttctgtttttaattttttgaggaacctccatattgttttccatggtggctgcatcattttatattcccaccaacagtgtgcaggggttccagtgtctccacatccttgccgacacttgtcttttttttttttcctcccatcctgacaggtgtcatgtgatagctccttgtggttttgatttgcatttctctaatgattagtgacattgagaaacttttcatacacctagtggccatttgtgtcttggagaaatgcatagttaagtccttagcccatttttccatgggtattacttaacacttgaggagtctcatgtgtggttgctagcacaccttggcttgattgtctccacagaagttttgcagagaccgcctcttagctggagagaagcctttccaggcataagatgagagggtgtattctttgttgagaacgtgttctcgaaggagagagaggcaagacaagtgaagctaggaagtaattttgggataccatctctgcccttttatagggcagtctaaaacatagccaggagttggaaaccagcatctccttatgtttcattcagtgccatattggaataagctaagaaacatctacttgtgcatttagtaactggcatagagtaacacctgatattcatcaaagagctaaatgggtgaataaagaatgaatgaatggagtgaattccacaataaagaggtgaatcccattattaatcaaatctgttcataactttgggctttaggctttagtttaatttttaaaacaaaggttggaagtcttctcagagcatcttagaaatgtactggagccgagcgtggtggctcacgtctgtaatcccagcaatttgggaggccaaggcaggtggatcgcttgagcgtaggagtttgagaccagcccgggcaacatgatgaaatcctctttctataaaacatttgaaagtcagctgggcgtggtggcggttgcctgtagtcccagctactcaggaggctgaggttggagaatcacctgagcctgggaggctgaggctgcagtgagccgtgatcatgccactgcactccagcctgggcaatgaagtgagaccccgtctgagaaaagaaaaaaaaatgtattgggagacatgtgcctattgaaaccatttttggtattcagagtgtctttaaagttagtcttgtcatttgcctgtgatgttaagcttgtggttgaggtgagtttttgagattatctcaaataggataagtgaagaagcttccctcccctaccatttgtcacttagattgtcagagtagaatttcttcccgtattcatcaggtggcagtggacagccaataacctgggatgtaataagttcttttctcaattttctaagtaagtgttctttttacaagggtcgcgctccagcagtctcctttgaagtcgtttctgttattcatggggccacagtgttatttcaaaggtgtcagccagcaggcttgaggcttttctggcatgaggtcactgacagccctctggacaacacaacttatttattggtctctcattctcccatccccactcctcctttcttccctctctccaccagagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggtgaggactttctgaatctaaaggtacccacaactggggtctccttcatgggtttggccacaggttctttgatttcctgttggagttgagagaggatgattctcttttttgactagccagcagagagtgttctaaggaattaacagatcattacacttgctagtagaatttcagaagggaactatggagtaggggaagaactactaaacttggggaagaactactaaacttggagagagaatagttcagctatttatcagccctgagatcgcagacatttaggcttagctgcgcctctataaaagtagagatcatgatactctgtcccccatagggcggttgtgcagaataaatgggatggagtggatggaaagagctttgtaggctcaaggcattgtgccagtgttgattgttactctgatgttgttttctattaataggacattaggatccaattttagtagccacgttttagaaacaatttggattttttttttaacaaaaacaaaacaaaacaaaaccctgacctttgaaatccattcagaggtgatttagacaataaactctaggtcatatttatgcaccagtgaaatgttgaacaaggaaaatatctttccctccttatttcttatttgcaagcccccattttcatagcatctgcctcttttttagatctaggtttgctcttcaggagactgaggacaggggcagctaagtctgtacagctggctcttaactccttgcctaccacgcctcccatgtctagttgctcatggagaatgaatgtccttaagaagaacattcttccagtagaaccataggtgacccagctaagaactttcagccaatgaagtgttctcaccagctaataattccaaggatcaaaggcattgggaaaagatgaccaacctggggacccacccgacctatccagttagctatcgctcacaccctcctgcccttctctccaccaggtctttccgttgtccaccactggactgattttgttctttaaaatccgcagccctttaatgccgctgtttagacgtaatggagtttgttttcttgcggtgtgttggtggtgggaccatagacaatgctaagaccttcctggttggccgttatattgttctcctgtgtctgttctagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaaggtaacaatgctttcatttttgtctttttttaaaaagaaagctggatatagaagctgaaaagacttggtgctttgggagactgcaggcagcttataggataactcttgtggccttggtatatttataataatctttcttcggtgatgcagctggtatgatgccagtagccatggaaaaatgcccacaacgttcaaagtgcttgctccaatttcttctagagattagcctccacccccacccagtttttaagttgttccttctggttgatcttgtttaggctgcacatttcccatcattactgcacattaacaccatttaaaacacacgcttccatgcctgtttaatacggggcatttgagtatcagcagagtttgtctccttctacttcaagtttttagggaaatattggcaagatgcaatttgttcaacaaagcatcatttctttggttgcatagttgatccttatgagttgctgttcttgaccttgttgcaccaaatttgaggggagctcatcttaatgaatgtactactggacgctactaaaggcaaaaggttgactttttaggtttgtcatgactcacatccaaatgtttattaatgaaaagagaaaaagcccagtttttttggttaccaagatgatgcttgcttccatttctttttgtcaatgctatgtagggcaagatggtatcgcagaagtaaaaataaccagagcctggtaaccaagacaaccttccaccccaattggttcccacagggccaggaggatgggtgaggtgtccatctgggcttatgtgcagtgtgttgtcttaaaacacagcaatttagatagaactaccctttcctcttggtgggagtctgcagccaacaggaccagaaccagcttggccttctgggcaccatacttttggaaaaccacccctaaatgcaaaccaaagcacaggccaagagaacggacctctgtgggttgattttttccatgcgtttgattgcgtgcatgtgtaggaggtgaagccggtgtggtgacgggcctgtggaggtgagctggtcagtgttgctccgtgtctctcggttgtgggctttgtggatgggctgcagtcggaatctcccagtggccagcaccccctgaagcccccggtgcgacgccttgtggttccacagccccctccacaatcattcctgtgtcgtctagccttttcttttgcttcccttgttttctaggccgccggtgttaacaccacggacaaagagattgaggttctctatattcggaatgtaacttttgaggacgctggggaatatacgtgcttggcgggtaattctattgggatatcctttcactctgcatggttgacagttctgccaggtatatactgttctttctctctgggtttttttcccttttcttggttgactgctataaaattaacacagcttctgttatcagaaatggccccttttatccttgcataaagatataaaaaatgttaaaaatgatccctcagggataagaaaactgccttggaaattcacacacagtgagatcccacactcacatttatgatcaagggaaatttcacccttaaaacctgaagggatctcatatttttagtgagtcattgagccaatgtataaattagcccatccccctttctcttaaggaacaagttgccattactttggtaaaattcaaagtaatttattctcatttcaaattccattttgctaaaatcctgtatgtgtttttattgctttcatcccactttgtatttttaacgagatgtaaatagagggatgtgtatggaggagcctggggagcggcacctctgaatgtcagatgcacagaagcagtgtgttgcctaccttggggatcggtggcttgctgcatgttgcgatagaatggactttcggtttgctttcattgcaaagcatgctcctgccatcttgggcttgatgttatttctgcctcacagagaaataaacatcattgcagccctgttgcctaaacattgctgctgtctgaatctttaaccgacatctctattctagtgaaactttcttgaaattaaacactgtcctctctgatgcatctgcctctttgtcatttcctttgtgaaactgcagagactgtggtttgctagcttatgatgttccactccagttattaattccttgtttttagagtacagtgcttacctgcatgcttattttacatctagtaaaaataaaatagatcgtttcatttttgtgctgttgctgctgagagttttgactatcttgcaagtatttttctgattaaaatgtataagctttcaataataccattgcatccgtttttccttttgttgcgaatctgctctgtgaatatttgctttgaaacaaagagatgtctcttatgttgaagcttgcttttatttgcagtactgcattctgtggtgcctaactggcacttcttaaccagtttgcctgacagtgctagcacttaactaagaatgcagtttgagaaaaacactatttggaaatacactgcttgtaggtggatcatcgaggactaagaagaagtcagacattggaagttgatataaaaatgtgctaaattaagtaattatatgtatactcacacataatacctttatgttttttctttaagagaaaagctgtagtgacataacaatataaccggatatgtataaacttaaaaggttattaaagaatattataatctttatgtattatggatctaatggttctatattataagcaattcaatctgtgtatttaatgcattggtttgtttatggactagatggtattaaggaattcaccaaaactttttcagaccagcctactagatgaacatcagtttcatatggaattgtgttcatccgggttaaattatcctgtggagtcttcctttggaagagcctacccatgtaagactgaagcattgtcactgtctccttagaaacaaaagtgggcatcgttgatatttcagaattttttatttggtttgcattcacagacgatcatgaaagataatcctttcattgtgggtacagttggtcgtcctccactgaaatgtctaacaaaatgtggcctcatagcctgccctgtgcaactgggtgtcaaccactcactggattgcaggtgcccactgaggctagtgacagtgactacctgggtcctggtggtcaaatgatggacccctggttattcattttcatttgggagtttttgggaagcccaccttgccttgagaatggtcgtcgccttttggttcctttggttgtgctatgatgcgtcagtctggtgtgctaactctatggcctgcttatctgttcctcctcctgtgatctgcaatctagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagaaagtagataaagagtttaaagaaatttactcctcccccatgacccagccagcttgtggatcttgtcctctgctttgatgccatcgacttctgtgagcttccatgtgcgagtgattctggtgtgatgcttggcggtcacccagttagtgtttggagcttggagagtctagtcatggtgcgttgcttggatcaatggggtccagttccaagggcaagaaaggacaatactgtcagaatcagaaaactaatcagcaggactggaaataactggaggcaaatccccctgtgtgtgtttgatcagactcaagtacagcggtctcttcgaagctttagccacattcgtgtcctgtgatctaataccttttttaagataagcatgaacattcgcttgggacttatgccactagtacgaaagagactctaagttctctgacttattttttaaagtcaagatcagtatcttatgccctgggggtgcatctgaactgtttgatttaaactggtgcacaataactttctacacagaattttggcttaacctctttgcaatttacaatagaattgtatgcatctattatgtctcattgttagtagttcacaggtgtggctgtggatttattagtagaatatttgtatggaaccagcaacagattgtttttaaccaccaacttggtctttggtggttgctttttgcttgtgtgtgcctcctgattggtttaattttgctttgggggagatggggcaagatggagcctctggtgtaaaccaaagccctgcataggtaggtgggacaggaaatgcctcagctcttttctgcttattcacagagatggaagcggaaggcagatgtagatgcagaacgtttacaaaagcatttgaaacttggttctgataaaggtttcttttgaaatagcaagtaaaacagcaaactcattggctctatttcagtgtgtattttagtaaaatgtacggggtgcttgttaaaatttcagattcctttgtctcagccccagagattcttgttcagtcatcttggatagggccaggaatctgcattttacacaagccctatggtgattttagaatgcactttgagaaactccaggttaattccaggcatgcctctcccgggacttcaggtaggaatgacattttctggacaaggcattaggaaggattaggaaccagttggtcagcagtggttttggaatgggtctggttgttcacaacccagcttcaaactcctggctgaatgggtccttgttaacttctctaaagccatgtttcaagcaggtctttctttgtggagacggaggatagaatttaaagtgtgtgtcaagcgtaggcgaatgaccaaattgtgttaacagcatggaaaagaggggcctgttgggtcacgtctgccaccaagaatgctgttgtcattttgagtgacatgattatctttcttggggccaggaaagcaaagatgaggccagttggccaaccagtttctagaagagtccagtcctgagataactcttacatggtttctattattttttttctaacagggaaaaatggtaacttctggaggcaacttgtaatttggcatagctaggccactgccccttaattatctcatcatctttttttctgcaactgttaaaatgcttttctttttacttaatatagaagggtaagatgcccttaaaatccccctgactcagccacagtcatcgtgttttctttccccagtgccagctggcttttcttcactgtccatctaagaatacagtttgagaaaaatagtatttggaaatatactgcttgtggatggatccttgaggactaagaagagggcagacattggaagttgacataagaatgttctaaattaagtaattatatgtatactcacatgcaataccatttatattttttctttaagagaattcagcctggccgggcgtggtggctcacgcctgtaatcccagcactttgggaggctgaggcgcgtggatcacccgaggtcaggagttcgagaccatccagcctgactaacatgttgaaacctcgtctctactaaaagtacaaaaattagctgggtgtggtggtgcatgcctgtagtcccagctgcttgggaggctgaggcaggagaatcacttgaacctgggaggtggaggttgcaatgagccaagatcacaccattgcgctccagcctgggcaacaagagtaaaactccgtctttaaaaaaaaagagagagaattcagcctaagttggtcctttttcctctcttccctgtgttaccagagggaacatcagagttccttcctctttttcttccctcctttctttatttattcatcataatttactaagtgcggggtataaatcaggttacatgtaagacacagcctgtcacattcaccagtggttccaaggttatttgatggtaaatgcctgtaatcctagctccacaggaggctgaagcgggaggatcctttgaacccaggagttcaagaccagcctgaccaacacagcgagactccaactcaaaaaacaaaacaaaacaaaacaaaacaaaaacccaaagtgggaaaaaaaagaaaatgtaattggcttgtgttcagtagggccaaggagtataacagaagcagaggaaagggggcaaataccagttccctggaaaagtacatctctgcgagattaatttatttggggggaatgttgacacacctcagctccttctacatgtccaagtggggtacattattggatcttcacaaagaatgtttcatcagtacgcatggcccctttggtagagaaagagatgcttatcgggtatctggataaaagagggttattggactggagctggaatgaaaagccccagaaaggcctgcagatacgttgatgacagagcaaataccacagggatgccaagcatgcctttacctgagcctctaatcagatgtgtcaaggatgggttgtttctaggcatttatgaggccactttttattctgtgttggccagtctcctctaggacacagggatcactcagtgtctccatggccctgactctttccctctccaacacccatacacacacagcgtctcactcaggtccctcagtccatccttgttctcttttcaggacaagaaaagttgggttttcgttcctcctgtgagtttttccttcttggcatttattaatttgcactagacttactggtgtaacacagacgtttcagtttatgttatttttttgagcaaaaatatttttttccagtaccaaagaagaaattccttgcaatcatttcctagtaagcgtgaattttttgagactttgtatgcacatggttgaagaaggagaagcaacttttgggtggtgggaggcagatggcaggtggcatctccctgtgtcctttgatggaggctcatgtcacattcagtgtcagggcttgggcaccgtgccagacactgctcacccactcccactcctttggcgcccagcgagttaaatgagaccaacaacagccagcccagagaggggcatctttgtgagcgtgttggttctggtacaggtctgctggacagccagtgaccagtgtgaagcagcctttgtgagttaaagggggcagcattactttctgtgttttccacacatcaattgggtggtgggggaaggtgtaggggtgggtggaggatggagtgcagaggaaactgaggatgcctgtttaggagacgtgcggtgttgctgggtttgctgaatcagttttacatcgagcacatcagtttctttctctggggcttgaagcttccatagggtaggatggagatttaactgtcttatggttggctccgtccagataaattcatctcctgtgcagcttacaccctctctcactgccgtcagcatggtacaagaggctgcagggtggttttttttttgtttttttcagactttagtttcaccttctcagctgctgatataggtaggctgaaaaccagagaaaaatcaagagcagactgggtgccgtggctcatgcctgtaatcccagcactttgggagaccaagacaggcagatcacctgcagtcaggagttctagaccagcctggccaacatatagtgaaaccccatctccactaaaaaatacaaaaattagctgggtgtggtgatgcatgcctgtagtctcagctacttgggaaactaaggcaggagaatcactagaacccaggaggtagaggttgcagtgagctgagatcgcgccactgcactccagccttggtgacagagtgatactccgtctcacacaaataaaataaaataaaataaaataaaataaaataaatcaagggcagtgaaggctaccttttgtagcaatacttttgaggcaaatggcatattcctggggacgttaggaataggaccaagatgaagggggaggagcggagcgggtgcctcgggggaggaatgtgtgactcagtagccagttctcaggtccagtgttagtgatcctcaaacatatgccaaattccgggaagggggatggatgttctactcccagaagctcgtttactgcctggcagctgaacatcatgatctgggaatattctctgtattttggtcaatcaggtggtctaaaccttaccggctccagaaaacatttgggtaattagagtggtcacggatgacttaactggaatctgccctttcatgtgggcacctcaccctccctgcccctatttcgctgctcccttttctcctctctcagcctccaaaggacatgacagtttgcccaagatctgacctggaccttggctgatgcgatctctcgagcagagccagcgcatctggggctggtgcgtcatggctctgataggtttactcacagagtcccagggaaaggcctgcgggaggcagagactcgctgtgggagaaaagtgagtgtctgatgaactgccttgcctaattacctaaattttgttatggaggaattaaaaatgcaacttcagaagcctttgaaggtttatctcaggcacccagcttgcggtggtgaaagcattttgtttggccataggggagtggtgggcaaggcttatattagagcagaagtatgttaatgccagcctcgtgttcttgtgggggaaggtggtttgcagcctaagagtcacagggcctgtttggcaggctgtggtccaagtgtgtttgtcagtcctggggagtaaacacacaaatattaattcgtctcttctccctggaacatctttgcttctgcttgctctgttctctgagaaatcccctctagatggtaaatttaattcagtataaagagataacactgttagaccgggcgcagtggcccacacctgtaatcccagcactttgggaggccgacgtaggtggatcacctgaggtcaggagttcgagaccagcctgaccagcgtgatgaaaccatgtgtctactaaaaatacaaaattagctgggcgtggtggtacatgcctgtaatcccagctacttgggaggctgaggcaggagaatcacttgaacccggtaggcgggggttgcagtgagccaagatcgtgcctggataatgagagtgaaactctgtctcaaaccaaaaaaaaaaaaaaaaaaaaaaaaaagaaaagaaacagataacactgtttcttggtggccctttaaaaagaaaggaaaaaaaaaaaacacttcctcacttaatctcccatatgtactatggaaatgtacgaaaagcacatttacttaaaagcttgacttatggcacatgctggagagattccggaaagtgaggaaatggaattggagtctgtgaaaatacatgcttaaaaaaaaatgcctgccaagattcgggagtgggaaaacagtttactagagtgttcgtgttgattgtttataagtaactcacttatcactaacaagagaatatgttaaaattggttaggaatgaaactctggaattgaagtttctaggtaggaattgaagaataaggaagattatgattttgtgcaaaagaaaagagaatttaatagtgctaaagaagtagaaggatttcagagatgagcagtgggagttatttgaggttcctgattcagaggaaagatgcccagtaaaacatggagtcccacaggggaatggcctgcccaggaccgggccaagcccccaacacaggctcgctcttggagtggaagggaatgaagagaaagccagccgtattttatagccccagaggggattttaaaagcatagtaaaaatgcatggaggtaaaattaagatatacctcagtagacagagcaatcaaattctatagtttcttagactttgcacgttttcttacccttttcccccgtttcgtgttcttataaaagtattttccaggtttgtacatttaatctgaatctccgtacttcatctgaacaaaattcccgtaagtcatccttcttgtagacctcatttttaaaattctaataataatgacaataaagttgataaaggctttcttatttatttatttttaggctttccatttgaaaagctgtcacatgaaaatcttctcgagacagtctgtttgggggatggtgtagatacatgtgaacttttgccaggggtttgtggatgcagattcctttggggtcatgggtgagccatagaggggtgaacttcagactgaatgttaaatttttctcttctgaggtaacccctaagccatatttgtcattaggaccctcttactgtccagttttcctcctgccctgagatgattccctgactcctggattcttcatctcctgcttactagaaccccagcccatccttggcagtgagcagagggcctcatctagcaaatcagacatgcccactaaggcatatcttctgcagtcagcctttaatgtcactgggttatcttcctggttgcacacagtttgacagtacaatcgtcgcttggtatgcgttggggattggttctaacaaccccgaatataccaaaatctgtggatgcccaagacctttatttaaaatggtgtagtatttgcatatgaactgtgtacatcctctcatatacttagtcatttctagtgatacctgtaataactaacgcgttgtaaatgctatgtaaatagttgttatactgtattgttttttatttgtattttaaaattgttgtattgttattttttattaattagctttcaaatatttttgatctgtgattggttgaaaccatgaatgcggaacccacagatatggaggactgactgtatcttacacacagaaccaccctaggctccaaacgctccaagttacccagagagaagtgtctttgtctgttctctcagatctgggcagcaaatgattctaaagggactaagagaaaatattgcagtgttggtagcagacattaactgagctcttagtgccaggcctagcactaagcacttcatcagtttttttttccctcattttatcatcacattaatgctgtgcagttggacctgttcctgtctcctcttttcttttttgagatggagtcttgctctgtcgcccagactgcagtgcagtggcaccatctcggctcaccgcaacctctgcctcccaggttcaagcaattctcctgtctcagcctccccagtagctggggttacaggcactcaccaccatgcccggctaacttttctatctttagtagagacagggtttcaccatgttggtcaggctggtctcgaactcctgacctcagaagatctgcccaccttggcttcccaaagtgctaggattacaggtgtgagccactctgcctggcccctgtcttgtttttaacagatgaggaaacccaggtctagaaaggttaagtgatttcccaaagctcacacagtgagtgagtgctcaaactgggacagggaccctgacaatctgaccgcacagtcccatgttattgcagttggtcaggatgcagcctgcctaatgcggggcctcatgttgtgaatgatgagcacaggaagggcagcaacgggattggctgttgcccacatcgaaggatgcagagatgccacaaaacctagcctggtagcagaaggaagggccgaaagcagtgatcttgtaagttttcactcattttagaagtcagcatatttcaagcatatgcccttcgttttcttttccgttgttcatgcctcagctcagatccttattattctaaaaaatatttttgttaaataaagtacttcttctagaacataaaagaattacatacacatggtcataaaatccaaatggtctagaaagttctgaaataaaatgtattttctaccccctctctcaactcctaatctctctgcccacaggtgatcactgctaagtctcttatatatccttccagaaacgtttaagtgcccttgttctcacacctcgctgtgggacagctgccttccccacatcctattctgtgagcctcgctgatgagagcggtgattttcagggaggaggcacagaagcccagccatgcctctgcctctgctgggtgttaacgtcatccaggactgcggtcccaagcaattgcttaatcggttcccactcctctattgattgcagcttcctatgcaccccatagtggaatcctggaaactggtatccagtgatgaggggctacgctgcaggccatgcagagagtgttctggctgtacaacctgccagaccctggccatttgcggaagtcgtcccattgctaggcctcttttttttttttttttttttgagacggagtcttgctctgttgcccaggctggagtgctgtggtgcaatctcagctcactgcaacctctgcctcctgggtttaagcgattctcctgcctcagcctcccaagtagctgggattacaggcgcctaccaccacaaccgactcattttttttatttttagtagagatagggtttcaccatgttggccaggctggtctcaaactcctgacctcaagtgatctgcccacttcctcctcccaaagtgctgagattacggcgtgagccaccgcgcctggccggccggttcttactagtttggctggagcttcttgcccatgatatcctcaagcataaggtccccctgcaatgagtggtgatttttgcctgttcatggggaagaactttcagaagaccttcttagtcttgaaaacacctgcgtacttaagcatccacagcacacggccctgatgcagaatgaattaggaggacagaaagatttggggaagcatcattggccgttaaacccgctcctgaatctttctgagctctgtaggtggagcttgagatgttcctgtggaccaatgcaaactggaagtcttgatgttctctgaaagttcctggcttctgatgtgtcccgcagacgaggttagctcactacagtgaggttggataccacatggcggggactttaaagttgtctgtttcatccagggtggggcttatgcctagtctgtgacctcagtggggagcaggacggattccccaggagcacccacatttaccttctcgtcttttcccgcttgcttctgccatttgcttgtgcaacccagacacttgggtgtgaggatctcagctccacaattaatgattctttagttcccgcttttaaaacattttgaccatacaatgaataaatgttgctcatactatctgcataatgaagtttaggaataactgccccctgccaaaagattgaatggaaggctcaggaagtgctcatgtacgttttaaaagataataggaattctatgtgaaaaatggcccacttctttattttaatactgaaaacaacttcctaatcctaaaatgattttcttcccctaatctattcttgggcatcttcttgaatttccagcctgctttgagggaagtctgggtttacaaaggcgagattcaaagcttttcaaacaggacaggtcctctggttccctgtgagaagagcccaggacccaccctgtgaaagttcatcccacctaaatttgttcatctggactcagtctttgccagtgtgattgaaggcgtttgtaagcacatccaggagtactatccacctgggcagtcacgcaggagacagagcccagggtgggctagttgcctgcttggagatggatcgtggttaacttcacattcttgttctcttgggccaaagtcttgttcatggtttagaataagacagtgttcaagcagcctgtggtcagactaagattgcgtagtcatcctcaaaagtggccttccagtgtgctctgcgtgagtcttttttttccatagaaaccagccaaaggacagtgatatatttaagaaataatcattttatcagacacactgaaatggatcaggataaacaagaaagtaactcggtggagccctgtgtactgccaggtgggagaggagttctcttgtgtggttatgggaaaaggtgtattttctttccattgatgcttcatcccacgtgtttagtgcactggtttctgaaaccgaagacaagaggcagcccatttccactgaatagcctggccatcaataagtttccagaaggactggggagaaacaaagaatggcccccaatgctggggtctggggttattttgagttaaagggactcggagctactgaatgtcttccacattcaagtcctagaactctttccttgagatattccactttacatttccaaagacagaggaaatatggtagagccaatttcctaaaagttttcgtagaatttcataagcacagcattgatccatgatccgggtagtctgagaggggatccattatccagggctccagtacaggtgcaggtacaaccataaaggcactaatgaagccagagaggactgtctgcatgtcctcaagtgactctctggaggaattaggacagaaagaaaatttacattgtgatcagatggtatagaaaaatttcatagaaaaacctgaacataggaacataaaatttggatgaaatctggtactgcatggactggagggcagaggagttagattccagtggttttctaatttggtttctgacttctgccagcccccaacccattcctttctaagattcgatactctggctgggctctggctgacttccagccttctcagatggagccaggattacatctgtgtctttgcattttgtatccaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagtgagtacttctcttggccatgtcccaggatggagactcagctataaatggggatattggattaacattttctttttatgacccttagccacaaaggtcttggtgtgatgatgtcagcaggagtaagattgtatttctaaataaccaactcctggaaaagaaaaaaatggatttaaaaaaaaaaataactccttgaaagcagagctacttgcccctggctggtccccaaagaagatggcatctggttatcattttttaagtgtctgggcaattcagactccgtcaaatggaataaaagtagaattatccaatttataaaacagatctgacattctagcttttggttactagaacaagactgttctctgttcacttctgtggagaaattagatgcagaatataaatggccttaaggaccgctacccagtgttgctgttctcattggttattaatgtcatattgggctgaaaagcttcaaatatggtacctgacatctaatttctgtgatccataatattttccttgttggatgatacagaggtgtgccaatcagatgtttagtcaaaatatggccacctgggtggtgttggggctacgtatctcttggtctcgcttgaactccacgtactggagctccgttgggctgcatttgaatcctggctttgccagacagtggctgggcaacctcgggtgaggcacctgattctctgaaattcattctcataaaatgagggtggtggttcagacctcccaggactgagcagagttcttggcttgtgcgagttttcctttcatttcccttcacgtggtggtaacctgggagctctgaactgcaaacctcagcaggatcatcgtgtggggcatggagtcagtgggcagaatttgagctcctagccctcgtcctctaggcagggaccgacccctagatcctccttctgaaaggaagtgcagtggtcattgtagggctgtccactcacttctggggtactttttgtcgtcacagcttgagagtacgggaaggtggaaatgctgactacttctgcatcacatacactggaataagctcttgacttgcttataagcagctaccctgtttgccttgacattttcagtagctcctcagattatatacacttctcatgtgtacctatacacatttggaaatgcaaagataagctcttccagagactgatctgatgagctctatttggaagggagaggtagcttatgtggctggcacttctgattttgattcacgtgatgtcacatcagttttgtttcccaagtgccaatttagagatgtgtaccgttagctaggactgaataattgtatggatattatttggttagagtgttaatggaagtaatttccagttgatttgtatactgtagtgaaaagaccactcactcattcacttattcattcactcaaggcatgttaattggacatttactggtggggcaccagagaaaacacaaagaatggtttctttacctgtaggatgtggagaaatggatgtttcttgtgaactccgccagccctagtttgtgtgtgattatatacacagataggttcatgtgcacattcctatatatataactgaactggagagttgtgatcatattttaagaaattgcagctttcgggtttagtccatagtttttgccacctgtgacaccacagtcaacagtggaagtctgtatgtgcccaactgttacctcccacccggggtaccctgagtgtggaaaatctgagtgctaaacatttcaaaacagtgtttagcgcaaacgtaggtggaacagatttccaatgaatgaaggctatttagaagcagtttattagatcggaggcagaagttatacaaagaaaggattgttatgcttgtagtagcaaggcggtgggacataaattagccatttttccaatgcaaatatttattttctgccaagatgttaaatttaattttcgttctgggtagaaacaaaatgacctctgcatagcacatgctgcccttagtctttatgctgcacttttgcaaactattgtgtacttaccttaaatactgtttactaatggcagctccatgctttgctgtgttatgcttaagttagaaagagccgtattcataagtattccaaagacttttgcgttttgttggtttctggaatgcacaaggacaatatatggctattcgtccgatgtgcatagaccttgtaatcttagaaatttaatttgtggtgttcactttggattttcttcattgttaattttatgtagtcataaggacttttaaacttatgtcaaaaaaaaagtccccaattttttagaattttctttttagtaaaaaattagagattccttgaaatgcttttaagaggcatatcctgtaacttggcaaggaatgtgaccataaaatccattggtatttgaataataattttaaagccaccattttacagggacaaaaaaataagaacagtcttaacgttttttctttgagccattctaaattacaaatatttaattggctcaagatcaaaagctcttctctggcacttaggaaagctgaccaccgcactagcaaggataccttccctaaagaaaataaaccgagaataccaatgtgaaatttaatagccgttccaccagtaattgacattctctaaaacgtcactaggaaaatactcaggcgcgtgtgtaccctaagtctcattagttccatatgataagcactccatgctttagtaagccgctgaaagatttttatatttagttctggaatttccctcactacaccccatcaccagatgctatgtgctaatcccctatttacacatttaggctgacactgggcaagcccctgggagaaggttgctttgggcaagtggtcatggcggaagcagtgggaattgacaaagacaagcccaaggaggcggtcaccgtggccgtgaagatgttgaaaggtgagcggggaggcgggaggctcggggaggggctgggtggagagtcttatcaagaaagttccttttgtggcatgtgaactctatcatggcacggggtcagagagcacatagttgacctaggggttgagaagttttcggtataaatcagcatctcggacagactatttatcttgagctgtgtgtacttataaagaaaagccagttttgttagaaagcggtagcctcctacatagagttattctttgactccttcttcgtgaccacaattcttcattctctctgtatttttatgtgcttagaaattatcaactcacatataattgaatttattagctaggagttggtgtgttagatttgggacttaaaccttaactttacaagtacaagaaaatttgtgtttttggagggaacgaagagacgtaagggagcagaaagccttctcttttgcgtgaggaacaaagcagaaatgacactggtctgggagagtcacttagaagctgagaaggagtgaacaggatcagggctggtgcagagcctcctgggacacataaacaattaccctgagatgtaaatgtcgtgttgtgtttgtgggactgtgaacacttctacgttaaccttccaaccctgcttcatgcccatgtccaaagaacttaaagaacttttaaccattaacttattcgtcctgcagtattcttttatgagaagagttatagggaactgtcacattataaatcctcttgtagggatctcggaaagaagatcccatgccgagtgtttcccacgtttccaggcagagaggcccatccttgggatatggtgctgggcatgtcgcaggcgctctggagttaggctttgtctttcttttgtgggttctcatgggatagtcatcacatccctcccaaggggaagtagcaggctggactttgtcaacaagatgtgcattttgttttttgggttttttaaaaggctgtttatctgagtgactcccaaggaaaactagagtgctttgagatgttccccaccttggagcctgatgccggggaggaacactgtgctgtcttgccccaggtgtcatggcaccactgactgaggcagcccctggctgcgtaccagggccaggtgtggggaggacccaggcttctcatctcttttggcggaacttctggttttgctaatggagctcagagttacatgggatattgcaaaaagggaggtctgggagttctctttctcttgtgatgcccaggctggcagccttccctgtaaggacacagaaggatattagtccccaagccattgtggcgtgtcctttcttacagcccacggctgtgtctccctccctcctcatggcccgtggctccctccttcacatacatcagtgtaaattttgcacacacagtcacttgtattgatcttccttttgtgaagctaaaaaactgtttgcaacatggttcttatccatgcccatatttcattttttttttaaaggaaacccagatttttccatactgaattagcttgaggtggagggcacatgggaaagtcttgccacttaggagaatctaagagaagctaactgcgagcccgcgtatgtggaacctgtgccattcttgcttgaaattacagagcggaagtttatgtaacttttcttaggatgggaactgcagtgccctctgagaagccactagaagtcgcagccctttacctgctcagaatgcacatgcacacacgtttatggccctgtttatggggaaccgtctgaacccacctcggaacgctctaagggcctcgaggggctgggttaagaatgcttggtcgggagcaagtctgtagtgatttgaaatggccctaccctcggtctcctcgctggtttcaggcaccatgaagtttggtgtggttttctgagacgccttagatatggcagaggatgagattatctcatggtctaggaaagaattggcattagtgtcagaagcccctgctctcgtcctgactcttggccccattggccccccagtgagctctttgacacagagtgaggcagttccctgtgtaggcctttgtcccttcctcgataaaatgagggagatgatttggaaaatcttttctgattctgaaattcaatttcatgctgtttcaactaagtctttggcaactaacagtagctgcccatgagttagaggaaatgaactgatttgtgaatatgcctactgttcatagatgatgccacagagaaagacctttctgatctggtgtcagagatggagatgatgaagatgattgggaaacacaagaatatcataaatcttcttggagcctgcacacaggatggtgagtaggaggaaaaactgcattcgcccaaatactctgcagtttgattgaatcattttagaaatggctgggcttccagatcctgctcccagagcaccctgtgtgcatgtttaaagttctttttaaaatccccattggaagatgttcctagccatgaacacaaagaagggtctgtgcccgtacctgggggccagtggaaaggagggtgcaggtgactttggatttgagggcctagagggcgctgctgtttctaggtcataacctggagggggttttggaaaaggcagcctccttatgtttttgttttgtaagtgctaagagagatttgtcagaataagatcctatgttttggttgagaagttcttcccttaaaacagggattgaagaatccacatcttgctgtgggtcacagatggctgagctcccaagaatagcttaaaagaggagaaagcggtatgaaggaatacgttattttccctgggggagagagaccctggcttcttccattgaatgtttactggcactttgaaatcaatttgctaagtaattagtaaacttgaaaacgcctatctttgacttagcaatttctcttgtaggtctatatagtaattggtgaactttttctgtaaagggaggtcgtagatattttagacttttgtgggccgtatggtctttgtcgcaacttctcgtgtctgccatagtagtgagaaagcagtgctagaagtacagaaatgaatggacctggctgcatgccaataaaatttaattacccaaacaggcggtaggcaggatttggcttgcaggctgtagtctgccaaccccgagcctataccatggagaaattattgcacacgtgtgtaagggaacatgtacagagatgttcattgcctactgtttgttatggctgaaacctggaagcaaatgcctatgcatataagggaatggataaataaagtgtggtgtgtttatacgatacagtatatgcagctgtgaaaaggaatgatctggttttgtttttataagcccaacaggttccaaaaggataatgtatgggtaaaaaatgttgcaaagatctaagagctttattattcatttatgtgattaaaaataatatattacttattgaatagttaaaatgaaccaaaaggatagagtggagggatccattgctttccaagagggcgcaggtgacagcatgagagtgacagggaagagcacgtcaactgtgtctctgtgccttttgaggctatcatgaccaagggcttatttatcattttggagagattataatcatatttttatgtgtgcttttctgtatgttaaaactttttcttttttcttcttctttttttttttttttttttgagacaaagtctcgctctgttgcctaggctgcagtgcagtggtgtgatctcggctcactacagcctccacctcctgggttcaagcgattctcctgtctcagcctctcaagtagctgggactataggtgtgtgtcaccatgcccagctaatttttgtatttttagtagagacgaggtttcgctatgctggccaggctggtcttgaactcctggcctcatgtgatccacctgcctcggcctctgtaagggctgggattacagatatgaggcaccacgcccagccgctgtatgttaaactttaaaaaaaaaaaaaaaagcatgggttgtaataactaaaaatgttttgctgaattgcccaaggggagaccctggattctctctttagggagcttctcttcttcctcaacagggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaagtgagtctttcacattctacttggctgggtggaatccaactaaaaatgtctttaaagaaaacaggcaatttggacatgctcatttgctagatcaagccctcgcatgtcttgtacaacctggaaaatatttattgcgttattcccatttgagtttaatgaactgtttaaaaccaaagcagcctcataaacctatagcatcgctgcagagatgagcagaaaagatacctcttctttgagacaggaccatgtgtgatttccctcggaattcagctctccaggtgggaaatggatggttttaaaggccccctttaattcggatgattttctttctttcttttttttttttcttaagcttcatttattttgtggttactgagtttttgaacatagactttaggtgtttagtgttttgggtttgatatggcattaaatattctaagagtaaaggtcaaacaaaggggtattttagtaaccttgcgtcctggagctctgcgtttattttgcctcgtttggcgggtgaccctctgtggttagaagttggccaggtcccctgaggtggactgcctgcattccaggcgtgccacttaccgtggaacttgaaacatttcagttattctgagagtagttagacaggtgcccagatgtcctcggaggcattttggatgacccaaaactcccttgtcagccccacacatagggaagcggaggggcggagctgcctcctgtgcagaggtgggccttgctcctacctgcattgcagtttattgcagtgccaggaattccttgggtccccaaagaggtgagatcctctggtcggcgtgcaccctctgtcactgggggtctgggttgcctgaagagtcacaaactcaagtctccatggggccatgccagtcacaccaccaaggcctgcggatcactcagagtgcagagattcgagggatggctgcacctcagctctactctctggccacataggaacatggcccagagctaccccatgttctggatggttttttctttctttcaaacaggctggagtgccgtggcataatcacagctcactgcagccttgacctcctgggttcaggtgagcctcccacctcaacctcctgagtagctgggagtacgaggatgtgccaccatgcctggctaagttttgtgttttttgttttttgttttggtagagacggggttttgccttttttctttttaatttaagaaaaactttaaaaacattttttcaggagagtttagagtttaagactttttcagatctttttcgtataaaaatctcccaatatataggttttgggaaactaattaaacacagttttgacttctgtgattgtgtttacgtacacgtgcgtgtgtgtgcgtgtatgtagggtagtttgccaatctatttggcatccagagacaaccagacagatccagaacatgggacatttgacaagatatcgcttccaaatgtcagtgtctcgaaagacaaaaactgctggggagacggttccagataaaagggggccgatgagacaattcctaagtgtaaaagtgggatcctggactggatcctgtgggtcggggagggtggccagttcttagaaaggacatttgtgagtgtcctttgaatatggactgtataatattactggttatatttctgtatcagtgttgaatttgccgggggtggtgacagtggtatctgttgtaggagaaatacgctgaagaattgagatttgtgaagtatcagtgatgcctgcagctcagttttaagtggtccagccataaaatataatcaatccattcactatcccaagtgtgtatgtgtgtgggggcaggtggggcaggacatggagacagcaagtgattgagtaggtgtaacaagcaaacccagcagtggtggatactcactgtgccatccctccttttctgcagctgtgaactcttcctaaataagcctggggagggtagcccatctgtaggctgcctattttgatattctggtcttgatcactccctgccctacctgtgtgggagataggggaagcagttttgcacccagcagggtggtgctactaggggaaatgtggtaggagggctggctcagtcattttattaaatccttcaacatctactcctagagcacccccgatgtctcatgcccttggtcaggctctccagcgaagtggccagaagagacatagtccttgacctcctggggcaagaaccatgggtgacagtaagagaaattgactgtaaatgtgggaatgaaaataaggttgtaaaaaaatattgaaaaaggtgccatggaggaaacagggggataaggccttactcatgccaggacgctgcactttgctgtcactgccatggaagcctctgagggggaggaagaggatcagttagtgcttcaaaaatgcctctcactgctgcttgtgtggtgaatgggaaggctgagcccctgtcaaaggtgatgatggtttgggctagggtctgttgggtccaaagacaccgagaaaagctggtgggctgatgttggacatattttgctcttgggataatgaatggattgattagataggagggagagaaagagagatcaagggtgacttctggatttccagcttgaaaaactggatggtggtgcagcttccaagtctgggaggacttgggaatcagggctggggcagggggcatagatttgggtggaaaatccgagctcgtcttgagcgtatctgagtcatccaaggggagataatgaagaagctgcaggcagcagctcagctctgagggtgggctaacagctgggaggcagcaaagggagctgtgagttcaagccatgggcgtggacaaactcatctgcggagaagcttggaagaggagaatagaagcctgaagtcaggtcctgagaaaattctcaaatctagagattgactgaaagcaccagaaacagcagcggaggccgagcaggcacagcctgagcagtaggaaaatcaggacacggagcacagaggccccacatgggagcttcaggaaggagggggcaggtagtagagcctcggcgctcagactggtgagaagcacgggtgttgagtcctggtcctagaggcagtggtggtacccctgcccaccctagccctgaggacccagagctccttcctgttttggagctggcagagagaaaactaagagacgaactttgctaagcagggcaaatgcatccatttaatcgtggaagaacggaagtacccatattaaagtgttgtgataatagtaactatcgttattattaattactgacccctccgggagaagctaaccatcttccaggcaccgtggcagagcatttgacataaagcatcttacgtagccctcagaacaacccggaaataggtgggatttggatccccattgtatgggggaggacgatgaggaagcagcatgaatggtttgagaccagatgtgtcaggaggactcagatgtcctcacttctgagaagcggacttgtaggtccgaagagtggagtggcaggtcccagacctaggtctcctggtcccccactcagctgtctcctgctctcatgaggcccctaactctctctaaactgaggcaagaccaatgagattccacgtggggggcgggtgaggggttgtttagtgccccagtgtggcctcattgtctctacattgaataacagcccaaggtaaaagggatattgtatgggcctttaagacatggcatggttccaaagccacttactggaggccacctgcagttaaggacccagaataggtttgaaaatggaggtagatgaagatgttaagcatggtccccttgcgagggctctgcttccaaaaatggagggcttattcttgaaagtggagaatgaagaaccaggcaaagggtccggccctggctttcccacacccatcccctcacaatggggagccatgggcttgtgagagacctgcttgcctgaaggaaggggcaaaagagaactgttgattacatcgttactgatgtactgggttcatctgtgctcagcgctgggccgattgagatgaacacacagtgcctggcctccagcagctttcagttgtgtgtgtacatgtgtgtgtgtgcgtgagtgtgtgagtgttggggtaggggttggggactggagacagagaagtgaaaaaacaccatggtgtatatagcaatgcaattaggtaatagggtatttgagccttacacaatttataaaatccttactatttttagctcaaatcacactaattttacttttttaaccaaatcccaaacccagttaaccctcaaagtgttaaacctgagcagtttgtttttcgtttttgtttttgagacagggtctcactctgtcacctggctggagtgcagtggcgtgatcttggctcactgcagccttggcctcctgggttcaagtgattctcccacctcagcctcctgagttgctgggactacaggcatgtaccaccacacctggctattttttggtagagacggggttttaccataccatgttggccaggctggtcttgaactcctgacctcaagtgatctgcccacctcagcctcccaaagtgctgggattacaggcatgagccactgcgcctggccctgagcagttttttttttttttttggttgagacagagtctagctcttttgccgaggctggagttcagtggcgctatctcggctcactgcagcctctgcctcccaggttctagcgattctcctgcctcagcctcccaagtagctgggactacaggcgcttgccaccacgcccggctaattttttgtgtttttagtagagatggggtttcgctgtgttagccagggtggtctccatctcctgacctcgggatccgcctgccttggcctcccaaagtgctgggataacaggtgtgagccaccacgctcagcctgagcagtttttttagtgaagccccagcttccccacctgtaaaatgggtataacactatccatgtcataggttgccgcaggaattcgatgtcatcagccatactgggcacagggcatactgtctacatcatagggatgttggtcttccttcccttagtgacccactgaccttcacctatggaacaccaaactgtcccagggccctaattgtataaaatggtcagctccctgtgctggagaacagctcacattcctgtggatgacggggatttggcttgcctttgattactttctttttctcgggtgtgggttccaagtctcctcttattcaacccagaggctggggtttgatgtttcctagcccctgggatgagggatggccacgctagactctggctttcgctgagaagatggtggagggagccgtcagcagtgtctctgtgcaagctgagccctaatgcatagttggagcccagtgcgtgggaagcacattcttctgaccacacagcttgccagacacacagagcgcgtgtcggcaggagcacaccaccgggagagtttggcccggggcttggaagttcaatttgaacaggcctccaaaactgggaacagggctgcagccccagacgaatctccaggcagcttctgtgagctctcatgtttcctgcttccaacctggccagggattgcaagcttgcgtggctttcttgctttcccgcttctgggcttaggctacccgggaggcccagaagtgtgtgaacacaaggaatagctaggggtcggggtggaatcaaataattccttatttatatttcagggatcacgtagcttgccccttttttaattgtccatttcgtggagtgcctaagatcgcccccatttcagccttgttgaatggactgataagactttctgcttcgtatgatagttaacctttgccaataaccagtgtaaaaggcttcggtggtgatatttgcttctttgtgtcttatctcttcccaaaatagaaggtgatgattggagaccctaattaccttgtatcttgtggaaatcttgctatatgaaagtgtaacaaaaatgcagcagctcacagtagcgtatcatttgtagaaaggaaaaatcataggccgggcgtggtggctcacgcctataatcccagtactttgggaggccgaggcgggtggatcacttgaggtcaggagtttgagaccagcctgaccaacatggtgaaaccctatctctaccaaaaatacaaaattagcctgatgtggtggtgggcacctgcaatcccagctacttgggaggctgagggcaggagaatcacttgaacctgggaggcagaggttgcattgagccaagatcgtgccactgcactctagcctgggaaacaagagtgaaactccgtctcaaaaaaaaaaaaaaaaaaaaaaagaaggaaaagtcgtaatagctagatctttctgagacccaagagttagtgtcaagacaataaattagctgttctgcagcaagtatttaatatttcagtgtttagaatcagtgtatgtggcacattcaggctgaggccaggtgttaggagaaactggactgagaacgtggatagacgggcattggccatggtagagaccaagaaaggacatgactagtcatttcaggaaccttagtcatgggacatggaggaggtacaacagggctaagtttggaagcgtagagacccgctagacgggcagtgtggaagtctcagggggaggggcagacagtgaagatggcctggactaaggcattagcagtgggaaaggcatggtgtggacacatgggaaggcattttggagttgaaatcaacaggacttgggaggaatgtgtaaagaataccggtgtatagctctccgattaagagagacaaagcattggaggagttgaaaccttgaatttgagacgtcaagggaatgtcagtggggaagtgtcccatagacagttgaaaatgagaacatgggtctcaggagggaggtcatgatggagatacgaacttgcgcatattttgtatgtgtttagaattaatgccttgaggatatatggaaatacataaacttaatggaacaattcctctatttgaagggacagaaaaagagaagagccagccagagattctaagagggcagggagagacagagaggcagctgagggaaggggacgggataaaactaaacagaggggctgggtgtggtggcttacacctgtaatcctagcactttgggaggccgaggcgggtggctcacctgaggtcaggagttcgagaccagcctgaccgacatggtgaaaccccgtctctactaaaaatacaaaatattagccgggtgtggtggcaggcacctgtaatctcagctactcgggaggctgaggcaggagaatcgcttgaacccaggaggcggaggttgcagtgagccaagatcgcaccattgcactccagcctgggcgacaaggacaagactccatgttaaaacaaaaaaaacaaaaacaagaaaacctaaacagagggaccattttaaaaaacaagcaagaaatcaatagcatctgaagccacagaggaggaacaactgaggagttggaggacgtcatttgcgtctaacaattcagaggttcttcataagcttcaggagaggcaagagtggaacacagattagaatgtttgagaagtgaccaggaatgaagaagacacaatgttggattttaaccaacgcttctgaaaattcaggtttaaagggcaggagagcaagtgttgagagaaaagattttaggatgatcagatacagatctataagcagctgaaagaaagacactggtgtggctggacaactggaggtagaagagaatatggttatttagtctaccttcgctcttcaaaatgatcattctatttatttataattccaaaacaaatacatgtcgtgttccaggctctccgatgatcccagttgacctgtcttcttaatcttagagccacactgcgttttcttttcttttctttctttttttttttttttttttgagacagagtctcactctgtcacccaggctggagtgcaatggcgtgatctcagctcactgcaacctctgtctcccaggttcaagtgattcttgtgcctcagcctcctgagtagctgggactacaggtgcacaccaccacgctcggctaatttttgtagttttagcagagatgggattttgccgtgttggccaggctggtctcgaactactgacctcaagtgatccgcccaccttgacctcccaaagtgctggtattacaggcatgagccaccgcacccggccacactgtatttcttatagtataccgcaactggtttttaacatcagctatattttctatctgcattttaagaaatgaacatatttcctttttgttctggcggtgttttgaaattagttatttctcttgcttctttcttgatttcagtgtattcatcgagatttagcagccagaaatgttttggtaacagaaaacaatgtgatgaaaatagcagactttggactcgccagagatatcaacaatatagactattacaaaaagaccaccaatgtaagtcgatggcagtaacacagtgggcaggggcgggggtgaggctcagaatgttccaggaagaaaggccgtcaatgttgagagctgggtgggatggctggggacccattcccctgccccgattcccgttcttttgacttactattcacaaactctcaatatgcaaatttagcctctattatgtcaattttagtaaatgtgaaacacttatatacagaataatcagcaaccgctaggattttcttatggttctcatcaagaactttcatagcaaaaactacagcttggaagttactggtttaatttttgcctaataactggtcaaggagcatctgtgtgctagggagataaaggatagaatccaaggagatggcattttattaacggcccagacctgtgcatctcacacattgttcatggtcctcattgggactgatttctgctctattgactgactagtgaaaaccaagaatatcagctcttaaacagggcatagccctattgagcctgctaagataaattcttttaaatatatttagtttttgcattttcctctacatttgcaggggcggcttccagtcaagtggatggctccagaagccctgtttgatagagtatacactcatcagagtgatgtgtgagtaactctcttttctctggctttttcctgggcttgagctgcaaaaatactgtacgtacttcacctttcttccttctttagtggctgctgcatttcacacattcgtagaaggtgcaggagctggccttagaaaggacagattttatggtaggctgataaccaatgctctgttactaatctgcctggcttcaaagagcacagaaggtggaactgctgacctccccctgccagagcggaagtccttcccttgaacatattcatggatgtgcaactacaaagcggttatctaattcgccaagctcttggcatgttcttcactccattaaaggagtaatcctggagcttttcccacttacgagtagtttgtcatatttccctctaacccagatttgtccttaaagagtggagctgagtgagatgtggtccaggctggggacctccacagggtctactctctatgtttatccctcaacaaaaaggtctgatcttgctttggcatccttgatagcattctagaaacacagtagaatatttctattatgatatactgacaaaaccagtggggtcaggctccaactgatattttagatttgaaaattcagttgaaggctgtgtgcagtgactcatacctgtaatcaatcccagcactttgggagggcaaggcgggtggatcacgaggtcaggagatcaaggccatcctggccaacatggtgaaaccccgtctctactaaaactacaaaaattagctgggcgtagttatgcgtgtctgtaatctccactacttgggaggctgaggcaggagaatcgcttgaacctgggagtcagaggttgcagtgagctgagattgtgccactgcactccagcctggcaacagagcgagactctgtctggggaaaaaaaaatcacttgaactattttttatttgtatgagcaggaggagttctgggtaggcattaattctgtgctaccatagttggtcctctcaacaatcctaaaaaaaagacatgactatcccatttttgctgtgagcaactgaggcacagaggctgttctgcctgtcctgtgctgctgcttttgctctgtagaaaactgcggagtgaaacaccaccatcgagtacagaaggttgagtttccagaacgaccatgatgtagctaaacctggctctctcagcttgctcctcccagagattgagcctcctgaacttggcacaggaagtccaaatctctgaagagtcaagtgtaaataaattatggcctgtgagatgtgttcagttttgttgtgtgcaact

SEQ ID NO: 14914 - DNA, 110266 bp, Human; identical to SEQ ID NO: 14913
  misc_feature (1)...(110266): n = A,T,C or G

SEQ ID NO: 14915 - DNA, 110266 bp, Human; identical to SEQ ID NO: 14913
  misc_feature (1)...(110266): n = A,T,C or G

SEQ ID NO: 14916 - DNA, 110266 bp, Human; identical to SEQ ID NO: 14913
  misc_feature (1)...(110266): n = A,T,C or G

SEQ ID NO: 14917 - DNA, 110266 bp, Human; identical to SEQ ID NO: 14913
  misc_feature (1)...(110266): n = A,T,C or G

SEQ ID NO: 14918 - DNA, 110266 bp, Human; identical to SEQ ID NO: 14913
  misc_feature (1)...(110266): n = A,T,C or G

SEQ ID NO: 14919 - DNA, 110266 bp, Human; identical to SEQ ID NO: 14913
  misc_feature (1)...(110266): n = A,T,C or G

SEQ ID NO: 14920 - DNA, 110266 bp, Human; identical to SEQ ID NO: 14913
  misc_feature (1)...(110266): n = A,T,C or G

SEQ ID NO: 14921 - DNA, 110266 bp, Human; identical to SEQ ID NO: 14913
  misc_feature (1)...(110266): n = A,T,C or G

SEQ ID NO: 14922 - DNA, 110266 bp, Human; identical to SEQ ID NO: 14913
  misc_feature (1)...(110266): n = A,T,C or G

SEQ ID NO: 14923 - DNA, 19732 bp, Human
gccacatccactaacccttcttttcacaaaagatttctgtttagcatacatttttgtttgatagcaattttcccatagtggtacttctttcaaaactggaatcaatcctctgaaagtctaatgctgctttattaagtaaatttaagtcatattctaaatctattgttgtcatttcagcaatgttcacataatcttcaccaggagtagattcaatctcaagaaacaactttcttttctcttccataagaagtaactcctcatgtatttgttttatcacgagattgcagcagtttacttacgtcttcaagttccacttctaatttgagttatctttctatttccaccacatctgcagttatttcctccactgaagtctttgttatagggccaacaggttcatatgcccactctgcaataatagaccaattacaatgagacattatgttttgcaacaaagaaagagtataataattggagggcactgagaaggaagatagttggaggccctcaaacttacctcctcaaggaaatctgggctggagtttttaaggggttaatggagggtgatggactgaaaaattggagtcatagattagtcaggataatgaagataaaatcagtaggagttggaaactgcattctttggtgagtcagctccttgtggggtccttgagagcagctggcatcagggaggtccctcagaccagctgagtcagtagtttcatcagtatgctggacctgaaggaatacctcaaagagaaaaccacatttcaaaatgtttaagttattatctatagaacagttaagatgaactttaatcttgtaacaatgtctgcataattctaagacaatagccaaaaaactattaggaagcgagtcagagagcaagctaatgtaataattaatactgaatgtactacaggcttggtttacttttgtttttttttttcccctccctttgtccttcattaattcaacaaagtctataggaatagtttcatcttgaaactctctaaatcatacatgatggttgtaagaatcaacacgtaaatgctatatcataaatgaacctttaaaatattatgctaagtaaaataagccagccataaaatatcacatattgtgtgattccatgtatttaaaaaatgtccagaataggcaaatctatagagacagaaattcaagtagcagttgcccaggataggacaaatgcagaaagaaggggtagggagtaaaaggctaaagcttatagggtttatttttaggagataagagttctctaaaattgactcttacggtagaagcacaattctgtgaatatactatgaaacattaaattttacacaataattgataatttgtatgatatctgaattatacgtcaacaaatttacaaaagtttttgaaccacatttagctattttatctttagttctgtgtcaaagagactgcaggaacatgagcctctcactgctactcttatgcacactattctgaaatatattacatgagtcaggtgatgagtccatccaagatcattgatattagctgaattacagcacttaaaaatctagggctgggtgcggtggctcacgcctgtaatcccagcactttgggaggccaaggagggcagatcacaaggtcaggggttcgagaccatcctgccgaatacagtgaaaccccatctctactaaaaatacagaaaaattagctgggtgcggtggcaggtgcctgtctgtagtcccagctactcaggaggctgaggcaggagagtggtgtgaacctgggaggaggagcttgcagtgagctctcaaaaaaaaaaaaatccaaaaagaacattaaacgcacttgtgtaaacaggtcatctaccttttatttgtctctttgtcatccacatgctcagactgttaatataatgtatttactttgaagtgtaaaagttacattttaacttcttgactgatttatactggatgtcaccatgagaaatgacagaaaggagcagcaactggaaaacaagcattgcattgcatcaggatgtctatgaaatggacttcagctcttctgctgatacagctgagctgttactttagctctgggagttgtggaaaggtgctggtgtggcccacagaattcagccactggatgaatataaagacaatcctggatgaacttgtccagagaggtcatgaggtgactgtattggcatcttcagcttccatttctttcgatcccaacagcccatctactcttaaatttgaagtttatcctgtatctttaactaaaactgagtttgaggatattatcaagcagctggttaagagatgggcagaacttccaaaagacacattttggtcatatttttcacaagtacaagaaatcatgtggacatttaatgacatacttagaaagttctgtaaggatatagtttcaaataagaaacttatgaagaaactacaggagtcaagatttgatgttgttcttgcagatgctgttttcccctttggtgagctgctggccgagttacttaaaataccctttgtctacagcctccgcttctctcctggctacgcaattgaaaagcatagtggaggacttctgttccctccttcctatgtgcctgttgttatgtcagaactaagtgaccaaatgactttcatagagagggtaaaaaatatgatctatgtgctttattttgaattttggttccaaatatttgacatgaagaagtgggatcagttctacagtgaagttctaggtaagtaacttttttgattggtaacatgaagatctaactttcttgtacctttgaagctgagtttgtataaagccataaagtcagggtagtggggtatttttgtaatgaatttatcaaatgaaattgtaagatgatctaccaaactcacaagcactatagaaaatgtaaattataggatcagttaaaactctgtggccatcactcatacagaagactccaggaagtcataagcctgtatattagtgcacctaagatttctttaagcaatcacatatctgttttattatacattttttcatcttaaaaaaaagtcagacttattcagaaacatcttgctgaatgcatactggtagattgagtagttacacattttttagaactatctatataacattgcagaaattgttttttcttgtatatttcagtcttattatttagtaattgcaatatgtacccatgttactagaacgtttcctccacagttgagagaaatgatgtctccatttcagaatcaaaaaccaatgcatgttatttgaagtttccagtgtttctattccttcactaaaggattggaaaccatttattttaaggctaatcatcttgtcaaagtgtgaacattaagttacaactgtatagtttttttttgaaactatgtatctttctttaaaaatatgagccaaattaaggttgaatgcaaatttctgtttcaacaagttctcaaaattttctagctgtaatttgcaaacatatttacctaaaaactaatattattatgaggttagcatgactcaaaagcagtagtaggtacaaggatttcagccatcatttcaaaataatcaacagttaacctgaagaaccaaagataaaagattagattaatgaatgggaaattagactatttgttagaaaattgtttttatgggtatggtagaattaattgatcacggagctcaaagagtggtttatacgtatatctgctactatcgaaggtttacaaaataaagaaatggagattaattctctatggcttgtttgtgattgtgaatatactgatgtgacatgagggatgcagttttccctcatgattctctcaccactttgcctttcttgtaaatacacatgggtaaaatatataatacataaaaattaaattatgcctatatacgaatatatgtattttttttcaaggcacaaacactttgcctacatttttgcccacattattctaacttctttcagaaaattacctagtttaattatcttgtgtcatctatcttttctttttttttcccccatcaggaagacccactacgttatctgagacaatggcaaaagctgacatatggcttattcgaaactactgggattttcaatttcctcacccactcttaccaaatgttgagttcgttggaggactccactgcaaacctgccaaacccctaccgaaggtaaactattactgtttgttttgtctgctttgaagtttcagtacgaatggttctatattcattcaaagtgtttgacttacactggaagaaaggtggaagtgggaagagtaaagcagataccaattagaaactgacgtacatgttgatactatcacaagtttatgaatttcatcattattaccaataaagagggatactaaagagactttgaaaatagggttggtaaattaaagctttgattatgcaacatgtaagaaggtactggccattcattcaaagaatatttataaagagattagcacacaccacaggtacgtgtatgggacacagtttctatcccaacacaccttacattctattttgaaagatagaatatatgcaagtaataaaaactgtgtaaaaactgttatctccagagaaaaaccaatgctaaggaagcatccagtgtagataatagagagtatcctggagtcactgatattaataatttagatgagagctgaactatatgcaggaataggtaaaagaatgaagaagagaaaaaaacacaaaaagaaaagcaggtaaagtgttcaggacagttctcaagactcaaagtttagtttgcaaggaagatactgagtaagaatcagatgatgctgataggcaagataagagccagatactcctcaggagttgaaatatttattaagcacatttagggactactaaaaagagttaagaaaagaaaatatgggataagattatactttttaaaaaaagattccaagatgttcgatggattaaattgtggaagggccaaactagaaagagctgaccattgaggaaattttgtatgaattcaggtagcagatgatggaaaaatggactagaaagtggatagaattacctatgcctacttttacagtaatatgactaacttcatattgtgttgtgtggaaaaaagttaatacaaataaaccacttaaaatgtctctggcatatagttagtgattcagaaatattattttgcaattatggttatttttgttattactaatactatgaattacttaacatgtgtaagtcacttgagatattattcctcatttaatagaaactaattattcagcatttcaagattatattctctaacaaagtcctatggtcttctatatgacagataccctgtagacttgtttaaaataagacatatcagttttgacagtaagatgagcaaaatgaaattgtaaaattctaccacaagtgacaaggatcttcatcagtattctaacttataagaaaataatcccttaccgatataaatgtgtgattctattagtatttgcagccagacccagtgttcacttgattttactaaagcatttaaatcattctgcgttgagatcccagaggtttacatcttagcataaacataccctattagagcaggtgttttctgccttaagacaagcaacccagtaaagcttcctgggatagcttgtgtctcaacatcataagtgcctgagagagaagcacagaaaaaatgaacaacgcatgtataataaagaccaaataatttctaccactcgtatctgaatcgtgccctcagtttacaataataaaagaattctgtcatcatataacattatattctttatggaggaatataagaatgtaatatattttaaattgatatcacccttctaagaaataggtagaaagtaagcatttttattacattatgtaatctcttaagagataatttttgcctacctccttattaacagcaacatgaaactgatattttattccatggttaaaatccaatatctatgttgaatgcaaattgtatgggctttatatggtaactttctaaagagacaaaagctgagataagactaatgaaaattctgtcccaccctatcctactcttgaaagatttccccactcacattaagggaaactgacagtgccagtaagagggagaagagagtacgaggtgtggaaggataagaaaaagattgagtcgtagtacatgtgataattactaatactagctgttgttactaacttgtagaaagctttgaatgcaagtcaatggttgtgaaagccattctctaattgtttatcatgtaaaataactgcaaacccaatttgctttctattcaattaaatattagattctcagataatttatgcatactttaagagaaaaggacacttggcaaatgtattaagtattaaaaatgcatatagccattggttttataatatattcacatgaaatcatacagagaaaaaataaatcaagatgtacatatttaatatttatggaaaatattcataaaataaacatcaaaagtaatcaaacatctgaaattaaggaataattaaaaacatatactagatgcatactatagcattacaataattttatcaataaaatattcagttacagtcagctataatacaagtaaagtgaggtagaaaattataaatattacaggctgacacgttttttgtaggaggaaaaggtatatacaatcagaataaaattgtctaaataaacgtcacaagtgtacattgaactataaagatagaacaaaagccatgatgaaaacatatgtagtttacaaggtgacatctctcgacaaaaattttagaaaaaaaattattttctttttagaacttgcactacttctataaaataccttacatacatagtgtattattattttaaagttgtcacagaatgggaaacaaccagtccacatcaataatgaatcccctttagggattatattactttaacactgggtggatgaaggcggctctggacatcaagccactgaaacaaaacactgaacgtaagttacatcaaatgtggctacaggtaactgcaattacgcacaatacctggatatcctatgtattaccttgaatagcagaacaatgactctaacatcattaacactgatgtcttaagattaaaaatcatattttaaaaaatgcttagccatatgtggtctgcaaataaacatttggaatcttttttctttgttttgtagagaacacttaagaaaaagttttaccccaatgattaaatctgaaagtatttaaatttcaaaattggcgtacattggggaacacaggtcagaatgattcccagtaaattccagccaagtacatcttcactaagatttttatgtagtgtgggtgatctactcaagagggtgaccaaatctctgcagaaagttctggcagtctctcgcattctggtgcaagtgctgctgcctctgagacacagcaaaatgatgatgagaattcctcacatgcagttataaatagcacatcaatttaacagtgtgatttcagggaaaaattgttccacttaaacaatcacctgaaaaatataatcattcgaccatgtaactacatactgtacgattctgtattacaaatgagaatacagaattatttatagaaatttatagaaattccaaaccacaacagcagactccataatgtcagtgattcttaaccaccaccttttacagctacttttttttctcttttgaaaaaagactggaaaactctgacaaactttaagtgaagtgtaaaggattatagaataagataaatgtaggtttacgtaatcccagctgtgagtaacttttcctcagtgctcagagtcagggaagtcaaccactaatgacttcaaactaaaataattctgtagaaaacctgcctaaaataagcatatgtgatttagcgagcaacaatatagcattaaagccaactggtgccactttaaagaacctatattagtacttataatatgataagtgaagagtttgggtatctcctcaaatactgtgtaataactctatttcatttctccctttcacaaacgcacacacatacacacacacatatttacacaaagacccttaacagaggcaacctatctcatattatacatattgcaaaaaaaactgagtaattgagtcagttaaaaaacatcctttactccaataattcctgataaaacttgattttctctctttttataacaattctttcacagtgcttgctgtgctgataatctattatgatagaacaaattcttttttttcacaggaaatggaagagtttgtccagagctctggagaaaatggtgttgtggtgttttctctggggtcgatggtcagtaacacatcagaagaaagggccaatgtaattgcatcagcccttgccaagatcccacaaaaggtaagataaaatgttttaatggtgtaaaaaactactgaaagaggctgttaaagtttgtaaagaacccaattgtagaaacttcctgcctatatattcagctgttgggaaagcactaattatctcagatattaattcaaaatcaaaaatatgtatggaagatgataaactcatacagaaggtgtttttcattggtaattaatttggcattaatattgtgatcaggaataaatacaattaagagttgcaggtaaagttttggtattatcatgatactggggtcaggtaagagctatcaccaaattctgcccctgtgatttgatccttttgtttaagaactcctgagggcgatgtacatcctacaggtgttagaaaacgttacattttaatgagtaacttcactagcacaataacaatagcaggtatttcaaaaaggctgacatgcatcatgcagtttagtgttgccatgttacccagcctcgtgtacttcctgtacattttggaataggcctattcaagtgatattcagggtactattcagagaaaggaaggcctaggctgtcagacaactagtgtaaggatccgcagagctaggcagatttggagaaagagaaaaagcagcctgctttgctggactggacccagccaatgtctgaagtaggcagatgaaagagaaagggtggagatggatcctgctctgagggtggaccctgtgtagtataaaatgtggccccacaaggacgctgcactatgagattaacaactcctcccaatggaggcagcagaaggaaatatagaaaggactcaagcagaaggaagccaggcaggggaacaggttcagatgccccctccatagaacatagtaggaacatattttcttttatatagaataaaatgtgtatttgtcaattactttttagttccctgcctgacatatccttcttgtaatgacctatgctaatattttgccaaaaactcaaagttactttaacactgatgtaacaaatagaacttaaacaccgtaaattatttttttttaatttataaggattccttgggggttccaaaattagtaacttaaacataaaaatgtctcagctatagcaaaacatacgaatcactgttgtcaaaattttgtagcacattttctaagtgttaacaatcaattgaccaaaattcagcaaaatgcaattttgaatttattcaagagttgtatttttatttatggtaccaacaggttccttatttctacattgacaaaatatccaaaattagcaatactgagaatactctgaatttgtgtcaaaaattgtcacttgaaatttttcttggaagtagttcttgataatttgtaatttccaagaagttatacatgctacctttgcagcattaattgacttcttccaagtagcttattttatagacttgcatttttgtcaatcaaaggacatcaaactctgttaaaatgacttatagataagtagatataagtgaactacttcccatattactcaaaaaaatgaataaattaatattaaatttggtagatgaaaactcataaaatacattaaaaaagcatataggtcattagtaaattgttgttgctttttcacactagaattatgactacctaaaatttttaatgcatataattattaaaattttttatctttttaaaattaagttttattttttaacttttaatttcaagggtaaatgtggaggtttgttacacaggtaaacttatgtcttggggtttgttgtatggactgtttcatcttacaggtagtaagactagtaccttttagttatttttcctgatcctttctctcctcccaacccccaccctccaataagccccagtgtatgttattcctctctatatgttcatgtgttctcatcttttagcttccacttataagtgagggcatgtggtatttggatttctgttcctgtgtttgtttgctagggataatggactgcagctcacttatgttcctgaaaaatacatgatcttgttcttttttatggctacataatatttcatggtgaacatgtaccacattttctttattgaatccatcattgatgggcatttagattgatttcatgtctttgctatggtgaatagttttatatagagtaaaatgtatatttgtctgtagtaaacatacatgtgcatgttctaatttgcagtcctttagatacatacccagtaatgggattgctgggttgaatggtatttctgcctctaggattttgaggaatcgccatgctgtcttccacaatggttgaacttacagtcccttcaacagagtataagcatttctttttctatacaacatcacaagcatctgttattttttgagtttttaataatggccattctgactggtgtgagatggtatctctttgtggatttgaccagtgatgtaaacctttttttcatatagtggtttgccacatatagttttcttttgaaaagtgtaacaactttttaaatacttgaacttttcattgattatcttatttgtctaagctactattttgaaaaatcatgatttccttatatacctaattatgaaattaaggaaatgaaatatgagtattctatttacatcagtctgagtagttcttgttacttaacatcccttgttcttctcattgttaatctctttagatttctaacattctatgacttttgagttccactcatggaataagatattttcttcactgtaacaggttctgtggagatttgatgggaataaaccagatactttaggactcaatactcggctgtacaagtggataccccagaatgatcttcttggtaagtctctgaagaacaaatactgaatatattagtaacagattattaaagtgttaatagttatcatgaaacaagcttactgaacatttgttatggaaaaacttaaaatgaaacttctttatatttattttccagtcccgggggaaaagaataaatgataattgttggcattttatgatatgcacccacattctttacaatcagagtcagagtatctttatttcaggtgttattacctcccacagaatttttctggcacttcctgggttgtcttcctttctcatatttctacaactttacacctgttctttcctcctctgtagggttatttcaaatgtcactaaaagtaacagctcttctgctatcaccagggatgctgcattttctgtaggattaaatccctaatcttaatcaaaaagtgatgacacatttcataatgaaatgtgacctgtctttcctcaattctagcaccaccaccacctcactgcctgctgccttgcacaccctacatatcacactccgtgactgtacttaagagaacacattctggctgggcacggtggctcacgcctgcaatcctagcactttgggaggctgatgcaggtggattgactgagctcaggagttcaagaccatcctgggcaacatggtgaaactctgtctctattaaaatacaaaaaattaactgggcatggctgtttgtccctgcagtcccagctactcagaaggctgagtaggagaactgcctgaacccaggagatggaggttgcagtgagccgagattgcaccactgcactccaccctgggcaacagagggagactccgtctccattaaaagcaaaaaacaaaaaacaaaaaaacaagaacacattctttcatgtccatcccttttctgtgctttttttcttttctgcacatgatgtttccttatctaaattgcacctttttgttagttcaactggtaatcttgtattaattttttcagtctgaagttaaacacaccacatagccttcacttacatctccagcagaagtaggggttccttcctctgaagtctcaaaaacaattttaattcagttcagtgtgttatctaggaaacaccgtcacattcagattcttccattgtgcatttctcattttattcctatgaataattttgctaaaattcatccaatcctaggtcacccaaaaaccagagcttttataactcatggtggagccaatggcatctatgaggcaatctaccatggaatccctatggtgggcgttccattgtttgcagatcaacctgataacattgcacacatgaaggccaagggagcagctgttagtttggacttccacacaatgtcgagtacagacttactcaatgcactgaagacagtaattaatgatcctttgtgagtataactttttttttactcggtggtctttatagataggttcccttgtgaatagtgagtatgacttttatcctttttataagcgactgatttcgaaagaatttaagtgatttaaacaatctgaaatctgcttttatttttgagtggttatttaaaaattttatttgaaccacatacatttaatgaataatcaattattgaaataattttctacacaaaaataattttaaagtgatatagataagaagacattttaaaataaatttgacgtaatcaatccacagtagaaaggaaagataaacttgacgtaatataataaaatattttaattcaatatctaaaatgtctcaaagtatatctgttttctcactgaaaaatttatttttattatcattattgtaacagacttgataattaaatttaatttccatagcataaaaccgacctatttaagtataaaatccaaatatatttagtatgcttacagtcatgaagccatcaccatcatataattttagaacatttgtatcaacgtaaaagaagccataatggtatagaagtcactttgcatgaccccttagccctaggctaacaccaatttgctttccttctctatagattattctctctacatatttcatataaactgaatcatataatttatgatgtgtaaatgacttcttttaccaagtacagtttttgttgtttttttatggtttttagctttatttatattgtgtgtattaatagttcatttatttttgcagcaatatattttataatatgggtatgccatattttatttgtctctttattagctcattcaccttttgattgtttccagttgtggctattaggagcattgctacatgtttttgcatgaacgtgatttcatttcttttgggtagatactagacgtggaatttctggctcttgtaggaactgtgtgtttatgaaaattgccaaactgttttccaaatgcttgttccatttgtcattaccaccagcagtacaggagggttccagttcatccacattgttgccaacacctgttattatttgtctttttgttataccattcttggtgggtgtaaaaagacctctcattgtagccttggattgcattttgattatggccagagatgttgatgttctttatatgtggttactgaccatgcatatacattctttggaaaaatgtctattttaatctttgaaacattttaaaactttgatatttgtcttattattgagttttatataagaactatttatgtattatggatacaatcccatatgagatatataatttataaatatttcgtctcgttcttggtgcactaacattttacatttttgatgatggtctttgaagcacacaaattttatttttagtgagtaaaatttttgataattgattttttcatactccaaagaaagcaatgcgcaaaatgccttgcccaacccagctactatcaattcagcattcataactactattaataatgtttttatgtaaaaggggcttcacctaaaggaatactttaaaagtactttatcacaaagaaaatagaaggataatgaatgataaagctacctttaaagaatacaggaaataattggaaaagaaacataaaacaggttagacaaatagaaaagaaatataaaataaggtagtagatttaaatgtgaatatacagatacttccattaaatctaaactgacctgaaaaataagaccaaataatgagtaaggacataaaacaattgaagaacacaattaacaattgtaatgttgtaatgtaacataacacacacacacatatataactcatacatatgtattctatatatcaactggaaggcatagttttctagagcatgttgagtaggtaatagttatttgaagttacatggggagggtcataaatcaagattcagtatgtatgaaaagattcaatatcataaagagtataagatccagccatagtgaatgtgagaaattataaaaatgataactaaaaaatctttaaattttgaatattaaatacactttagaatattttaaagtaaaaaagtaaatcataattatgcacacacttttatttcaacaattccactctcaattatataggaaaatatatgtataaatttgtaagcctattgctatatacaagaatgtttatgacagaattattaatagtgtccagaaattgttggcactcaaatgtctattgattataaactaaaaagataatctgtggtattctcaatcaatgaaatactacacagcaacagaattaaaccaacaactgctacattaaaaaaaaaagacactttgggaggctgaggcaggtggatcacgatgtcaggagttcgagacaagcctgacgaacatggtgaaaaccttgtctctgctaaaaatactaaaattagccaagcatggtggtgcgcacctgtaatcccagctactcaggaggctgaggcaggaatattacttgaacctgggaggtggaggttgcagtgagccgagatcatgccactgcactccagactaggtgacagagtgagactccatctcaaaaaaaggaaaaaaaaaggagtatatattacataattaatttaattacataagcaagtaaagctgaagtatgacctttgaagtcaggttaatacttaattggaggacaaaagcagtgactaaaatggtccaggaaaagagagttcttctaagaagattctgataccctctatcatgatctgagagatagtggtatcttcacttcgaaataatgtttaagatgatcttaccttattgggctgtttcacttagcgtatgtacacttatgttatgtgttttatgcttaaatgtgtattttagaagacgtacaatgtattttaagattataggaatcaaataagttcaaaataagcacaaaaagtagaggaaatcctaggggttctatcatagtgtggccaggaaaagcctctcttattggtaacatttagagggttgcctcaaaaagagatagaagcatgccttgagttgttgcaagaaagaatactccaagtgtgggtagaggggacgcaatgtgtaagatgctaggacaggagcttaaagaaaaatataaggccaatgtccctagaagacctagtgtgcatgggaaagtggagaagagcttgccagtgtctgataatgcaggatcctgaggaccaaataacagagttggattttattcttgatatgatgaaaagtcaggcaaaagtcttaatcaggggagtatcacaatctgacttttatttcaaaaataatcattctggctactgcgtgggaaacagtaggacacaaagagtagaatagaagcagagcatgtggctatgaggcatttcacccacatgacacaattcctctttagaaacttaaagatgataattctcaaattgtattttaaggtgtatatcttttaccacttaaaacggctcatgatgctgaccatgattttatacgcctgctggagaactaaaggagtgtaactggatatttcataacacaaagataaatgcttaagcaatgggtagcctttcttcatgatgtgattatttcacactgcagcctgtatcaaaacatctcatgcacctcatagaaaaatacccctactatgtaaccacaaaaactaaaaattaaaagaaaataaaattgctcatatgttctctgcctcaaataattaactttctcacctgaccctccatttttactttaaaaatatttgtcaattatgaaattccaatttaaaagccaaactttctatgatgactcaaattaaaatacacacattctatgtcaattctatgacatttactttgaatgatctggcactttaaaaacctttcgtggacttgatgtgctcaggcaaattaacttaccttctctttttttgagagggaagtctcactctgtcaccaggctggagtgcagtggtgtgattgtggctcactgcaacttccgcctcttgggttcaagcgattctcctgcctcagcctctcaagtagctgggactacaggcacatgccaccacgcctgggtaatctttttttttttttttttttttttttcatatttttactggagacggggtgacggggtttcaccgtgttagccaggatggtcttgatctcctgacctcgtgatccgcccgcctcgacctcggaaagtgctgggattgcaggtgtgagcctccgtgcttggccaaattaacttactttcaatgttgatacttttctgcttatcgtttagatataaagagaatgctatgaaattatcaagaattcatcatgatcaaccagtgaagccccttgaaagagcagtcttctggattgaatttgtcatgcgccataaaggagccaagcaccttcgggttgcagcccacgacctcacctggttccagtaccactctttggatgtgactgggttcctgctggcctgtgtggcaactgtgatattcatcatcacaaaatgtctgttttgtgtctggaagtttgttagaacaggaaagaaggggaaaagagattaattacgtctgaggctggaagctgggaaacccaataaatgaactcctttagtttattacaacaagaagacgttgtgatacaagagattcctttcttcttgtgacaaaacatctttcaaaacttaccttgtcaagtcaaaatttgttttagtacctgtttaaccattagaaatatttcatgtcaaggaggaaaacattagggaaaacaaaaatgatataaagccatatgaggttatattgaaatgtattgagcttatattgaaatttattgttccaattcacaggttacatgaaaaaaaatttactaagcttaactacatgtcacacattgtacatggaaacaagaacattaagaagtccactgacagtatcagtactgttttgcaaatactcagcatactttggatccatttcatgcaggattgtgttgttttaactgttgttgaggaagctaataaataattaaattgtatagaaagtctcttcctcttgatattttgagatgattagtgctgcttggcttttattgtgcatcgtgcttcaacgtcattttttttcctaaaaggtatgataaaaatgcttaccattttagagcttaagtcatttcccagtgaaaagtatgtggaattagaaatatagcaactcctacctggtttctactacaaaatgaactaattttacaatgcgtttggttttttgagccaattctatttttctgttcatttgaaaatattcatctttttttattctttgttttttaggtatttcaatagcttttgggtgacaactggtttttggttacatggataagctctttagtggtgatttttcagattttggtgcactcattactcaagaagtatacactgtacccagtgtgtactgttttatccctcacatccctcctacccttccctctgagttccaagagtccattatatcattcttatgcctctatgtcctaatagcttaggtcccccttataagtgagaacatacattgtttggttttatatttctgaattacttcacttagaataatggtctccaactccatccaggtttattttgtccattttgatggctgagtagtgtatatatatatatataatatatgtgtgtgtatatatatatattccccaactagtggctaaagtaaatgtgatatttatatataatatatattagatatatataattatatatgtatgtgtatatatatataattatatatgtatgtgtatacaaacacacacacacacacacacacacacacacacatatatatatatatatatctcacattttctttatccacccattgactgatgggaatctaggctggttccacagttttgcaattgtgaattgtgctgctataaacatgtgtgtatatgggtctttttcatataatgacttattttcctctagatagatgtccagcagtggaattgctggatcaaatggcagttctacttttagttatttaagggatatccatattgtttgccatagtggttgtactagcttgcattcccaccagcagtgtaaatgtgttcccttattactaccatgccaacatctattatttttggatttttaaactatggccattcaccatttgtatatcttcttttgtaaattgtctattcatgtccttaagtcacattttgagggattatttgtttttgtcttgctgatttgtttcagcactttgtagattgtggatattagtcttttgtgggatgtgtagtttgtgaagattttctctaactctgtgagttatctgtttactttgctgattatctctttcgctgttcagaagctgtttagtgtaattgagttccatctatttaactttgttttggttgcctttgcttttgggttcttggtcatgaagtctttgcctaaacaaatgtctagaacagtttttatgatgctatcttctacaatttttatacttccaggtcttagatttaattatttgattcatcttgagttgatctttgtataaggtgagagatgagtatccaatttcattcttctacatgtggcttgccaattatcccagcaccatttgttgaataggttttcctttccccattttatgtttttgtttgctttgtcaaagactagttggctataagtatttagttttatttctgaattctctattctgtttcattggtctacatgcctgtttttataccagtaccatgctgttttgttaactatagccttgtagtatagtttgaagtcaggtaatgtgacacttccagatgtgtgttttttttgttgttgttgtttgtttttttgcttagtcttacttgggctatgtggacatcaaagctgagaatcaaataaaaacctcaacccctattaaagcatctgcaataataataataataataaaataaatacttacaaatatacttaaccaagaaggtgaaagttctccacaaagaagaccac

SEQ ID NO: 14924 - DNA, 12073 bp, Human
agacttcagttagctatgagtgcgccactgcactcaagcctgggtgatgaatgcagactatgtatctataaaaaaaatagtcactgactcctatgtaattctttttcattgagaatgtaaagagaatggctttgttttgccccagagaagagaccttgtatctctgatgtttagaaatttcatgccaaaagaacaagaataataatataatttacttgaattatatatttgtgagttatggtctcactctccaagaacaataggccattttagaagactgatggaccagaacatagctttatattttataattaagtaaaacaggtatcttgtcctctacaagcaagcgtcatgttctttgaaaaggccatgcctttcaattacaagggaaatatcaatagctactgccttatcacagttgtggcaatacactggtatgtgaattatatattatatataaattacatgtgcctaataatattaggtacaataatatatattgttgtatattacctagagaataaccataatttccaatgggactgttcaaattagcataaaacatttacctaataaatatttcctttaaaaaccacacaaattcattttattttattttattattttactttaagttctaggatacatgtgcagaatatgcaggttttttgcacaggtaaacgtgtgctatggtggtttgctgtatctattaagccgtcgtctggattttaagccccgcatgcattagctatttgccctgaggctctccctccctccccagccaccagccctgatgtgtgttgttccctttcctgtatcagactcaaattaaaaacataatctctattagtgggatcaatctaaagacaatgcgtttacaaatctgttatatagtttttcaaactctaaagtacacaaataatgttctggacatgttcttaaaattcaggttccaggtgtacaccccaagattctgactcagtaattttggaaaagtagactaagaatttgcatttcaacaggtatgagctgatgctgattgtgatggtagtatgtgggacatcctgaggaacaatggactgagctgtacaacttatctgaacttagaagttagtttttaatactcggttcttagcacattgaattaaacaaccggtagtgagtaggtgatcttttatacatgtttgtctattaatttaattaaaattctatttttctctttctgtctagtgtacttatttcaataaatgacctctgtgaagatatatgggcccctgaaaactccagggaagtaaattcaaatttctaaacataagaaatcagttttatgtgagagatatgtgaccaagcacctagaaacgtttgacattaaatatgagaatacttttatcatatggcatccaaaagatgactgaattttggccaatgtttacattcattttattacttaaaatattctaagtcaatgtaagcaggtaaaaatacaagataaatgatgatttgtaggaaaacttttgaagtgtagaatgactccaattttattatgccaattatcactatttactagagaacgtgtaaaatttttcataacatggtaagtattatttttgacatagcgttgttccatcttggacatatatttgttgaaaagtagtagatggtattctacagaaacatctttatcactgcaatcatttctatgcctggtttcctccagcgtgcttttccgttgtctgactcactcagggctagactaacactgggattagcatgtgatgggtccattcgctttccggttgccttgtcttcacaatgatctattgcagaatcacctggttaagtttatttttagaatttgtagagacagattttgggcattactttccgtctcgatcatatgatctcataattgatgttattttgaaaaacaaaagggagatttcaaaaaacaaaagggagatttcaacgtgtttaaatacatcagccatctaggaaaggacatctcttgagacttcacttcagcttcactgacttctggattctcctcttgagtaaaaggtaacatgttcaagtacaatctaatattatatattagcataagcttttgtttgctaaaatcaatagtaacccacttatgaaaatgtatattatctatgataatttcttataaagaaataattaccatttattggcatctgaagatgacttctagatctcaattcctatgaattaacaccagcaatcatcatgcaaagtaactaatgtggaatatggcaatgtattacatcctcgctgatggtgggacctcaatgaactctttttatttccttgcctagatacctgatatctactttcttattacttttatattaaacttaatgtagaagttcacattttacaagatactgatagattctgtcttgcaaattcattattataaaaatttattttttaatttactttcctcttagtcgtaaactattttattactttttcattggcctttccatcattaaaaacagttctgttataaatcaaaatatatactgtataacaattagtcttctcaatcttactaatttatttaactcattttcattcatttgtgttatggcagaaaagacagtttattattccaaatttttattattgatttactcgggaaatatgtttttcaaaactattaattatacattgattatctatgttcatttatcattttatctgttagtaaaagaagggcactttcttacagccttttttgattttctatttgcaacacaattgacagtcacaaacaacggtaaaattgtctttttatatcataaaaagagtcataatttgatttatctattaggtaatagaaaaacttcaagaaatatataatttttatagttagtcctatacaagaagtttccatttaaatgagtgaagcaaaatgaatgaagaaataataaggcaaatgggttctgctttctgtgatagagatgtagggctgtttaagagtaggacatttttattataattagatgaaaaacgttactgtaatgttctatcacaagtgacaggtaagagagattagaaaaattttttaaaatattatctattaatgaattactttatagctagcaactaacaaataaaaatgccatgtaattctaagttttgtggtaattgtattttccagtggaaatgcttttatttacatgtttgtaatttagaaataagtaatccgctttacttttttatatcagccgaagaactggattcacttgcatatgcataattataaaaacatatcagagtcccagatgaggctttgaataatattatttgaaatattgaataatcttcaccagttcaacttctcaaagtagatacaatcattttccctgtgacttctcttcattttatttttctctaaccaataccattaatgttctaatctcaaggttgcaccatctgtgctattctttaatagaaatctggctcatattcactgactttattataaagaaagtccccattacttgccattctactttctaaatatgtctttacactgtactttaattagcattcttaatgtcattatctaaatcccttgtaatgtcacaacaacctaagtggtcatcttttctccagttttgtcctccctacatgctaaactgtttgaactttcaacatgctttcctctctgttgtatttcattgcagtctcccaacacctccctttactcattccatataatccaactcaagcttgcctttctttgttatcttcttactcccattatcttggtctatttaagatgtccatttgtgtgtttccttagcatattaataattccaaattagagcactcacctttatttatcaattaatgaagctatgccctgggctcacaccgaagatccaagcattttgaaaggccaaggcaggaagattcctagagcccaggagtttcagaacagtctgggcaatatagtgagactaaaaatattctctaccaaaagaaaaacaaattagcttgtcatggtgtcacacacttgtagttccacctacaagtggaactagggaggctaaagtgggaggatggcttgagcccaggtggtccaggatgcagtgatctgtgctcatgcccctgcactccagcctggaaaacagagcatgtctcccaatgctttgaagcatagtgtcatcagtagaagtttgatgaatgaatgcatgaaagaatgtgattactgatttttcatgtttgattttataggactcagccaactatgaagttttttgtttttgctttaatcttggctctcatgctttccatgactgtaagtatatctggaagttttaaaggatacattctcagtacttatcccaaggatctttcttattccttacgttctgccatatattcatgttcacctcaatacagctttaatatttctatgtaaagattttccttgaattaacctatataagttcttaaaggacttagaataaatattcattacatacctgcgaacactcaagtacaattacttgaatataaaaataaaagaaaattaagcaagcttcataaatatgtgggactgagaactgtgaaaatatctttaaatattaaaagctctagaccacctgaagttagaaatctgaggaaagaacaaggtacacttcaatggaacctaagtattagagggtgtcaaaatatgaattttcaagtaatttcttgcacaaccaaactgttcaagttagcatacaatttattttactctttctaaaataaagctgcctattttaagccataaaacaaatctatatctgttaagtgtcatgagttcccagcttgtatcgtcatttactactgtgtaatagtagaaaaggcacttgacctctctggagctctttctccttctctactttctcatcctcttcccactcctcctcttctttctatgaagttaatagaaaattggtcacaaaagaatactaatacttcaacctatccactaaattcaaatgaatgtttcaaaaacaaaattggttatggcatcacagtttatcacatgattttattatagaaggatagaagtagaaaaataaacatataagaagaacagagaaaagcacaatgcctgtctctatcagcaaataaaatatttgtatgttggtagcttttgagctacatagaacatattcatataaaaaacaatccaatgtttcatttttcagtttccactctcttattcaccaatgatagacttttcttgcctttcataaaaaagatatataaaccaaaatgagttgatactttaatatagcatattaattatagagaagtttacccttcactcattttaaagatgtcataaagctaaaataactaatttagcatgtcatcatccaaagaatgcctccattctatttaatcataaatgtggctaagtcaatttttacacatattcttgaattatgaaattaagatattaattattttctcattttcttcttttccaagggagctgattcacatgcaaaggtaagacattttcatttactggaaaacttgataattaatcatatattgaatttttaatcttttctttttatttcatagagacatcatgggtataaaagaaaattccatgtaagtgttcttctgataatgtgcactctgaataagttttcttctctgactatttattctcctagaataattgatagttatctctcaaatatatttatatcattaattgctaaagtgtacattgatttcatttattcttgttacagaggtaaaaggtcacaaaaatcttgtgttctaacagcatttcaacggaaactcaattacactctgaataagtcaattttcaattattctttgagagcttaagtatctttctcttataaataattacattgacctaaagaatagttcctaattctatgaataattcctaattctatgaagtataacatatgcctaatgaagcatagaggctacccatgtaatgtggtttctatcttataatatttgaggatgataaagtctttaaattaaacttactgtgctaaattagacagaaaattttatttaacatttttctaaatgtatgtataaaaatatcatattattttgacctctaatatcagtatgaataggggttcaaaagttctgcttactaatatagcaagtatatgtgttaaaaaagcactaagtaaaatgatgcataaaaaggaatgaggactgtttgtgttaacagcagtgggtatgaaagaatgtaggagttgtaagagaaagtaagctcattaaaagaataagatgaagaaacaccacctaagttggaaacggtaactttctcctccccgttatactcaatgttgggcaaaatagtaacttggaggtaatgttgttaagaagatttaaaacctgtttggagaggttgcctataatcagtgttccaacatttattattgccacaaaaatatcaacacacagtaaatactttatcatttttacttgcttttaaacatttttctgaaagaagaaaaatgtaactaaaaatttgaaaacatttatgtagataacacacgaggtcataacaactttaacaatctaagctttcagtgacagtttttgtgaagcatttttactgtcattgcctctattctctgcaatttgctctctccttttgtgtgtatgcaggaaaagcatcattcacatcgaggctatagatcaaattatctgtatgacaattgatatcttcagtaatcatggggcatgattatggaggtaagctgactctagttacttttctttctagaagtatcaacactgacagttaaaacaaggaaaaataaaaaaaaagccattaagccaacaatcattccagtttaagaaatgtagcgtgggttagctctttgaagtgtgttgatttatatagatgcttctgactttgtagatatgtggtgttatttctgaggtctctgttctgttccattggtctatatgtctgttttggtaccggtaccatgctgttttggtaaccgtagccttgtagggtagtttgaagtcaagtagtgtgatgccttcagctttgttccttttgcttacaattgtcttgtgtatatgagctcttctgtagataattatgaaatttaagtacttatttctaatcctgtgaaaaatgtcaatggtagtttgatgagaatagcattgaatctataaattactttgggcagtaaggccattttcatgaaattgattcttcttatccatgagaatggaatgtttttccatttgtttgcatcttctcttatttccttgagcagtgatttttggttctccttgaagaggtccttcacatcctttgttagttgtatttctaggtattttattatctttgttgcaattgtgaatgggagttcattcatgatgcaggtctctgcttgctatctgatctacgacaatcctgacaaaaacaagcaatgggaaaaggatctcctagtcaataaatggtactgggaaaactggctagccatatacagaaaactgaaactggaccccttccttacaccttatacaaaaattaactcaagatggattgaaaattaaatgaaaaacccaaaaccaaaaaaagaccctagaagaaaacctaggtgatatcattcgggacataggcatggacaaagacttcatgaagaaaatgccaaaagcaatggcaacaaaagccaaaattcacaaatgggatctaattaaactaaagagcttctgcacaacaaaagaaactatcatcagagtgaacaggtaacttagagattgggagaaaatttttgcagtctacccatctgacaaaggtgtagtgtccagagtctacaaggaacttaaacaaatttacaagacaaaaacaaaaaacccgtctaaaagtgggcaaaggatatgaacagacacttctcagaagaagacatttatgtggccaacaaacatgaaaatagctcaacatcacaatcattagagaaatgcaaatcaaaaccacagtaagataccatctcacaccagttagaattgtgattactaaaaagtcaagaaacgatagatgatggctaggttgtggagagataggaacactttttcactggtggtgagaatgcacattagttcaaccattgtggaaaactatggattcctcaaggatctagaaccagaaataccatttgacctagcaatcccgttactgggtatatacccaaaagaatataaagcattctactataaagacatatgcctagatatgtttattgcagcactatttacaatagcaaagacatggaacaacccaaatgcccatcaatgatagactggataaagaaaatgtggtacgtatacaccatggaacactatgcggtcattaaaaggaacgagatcctgtcctttgcagggaaatggataaagctggaagccatcatcctcagaaaactaaaacaggaacagaaaaccaaacagcacatgcttcactcataagtgggagctgaacaatgagaacacatcagggaggggaacaacacacaccagggatggggggtaggaggtgacagaaggtaacatagagggctgatcaatagtgcagcaaaccaccatggcacatgtatacctatgaaacaatcctgcacattctgcacatgtatccctgaacttaaattaaaataaatcataaaataaaataaaaatgcctctgagggaaagcttctgtttgctactgttaagagacagagttctgggtaggggaacccctgtgtttttatcctgaccctgacaactagtttcatgaccttaaagtattcctaatcttctcttaaccttaattttataagagacaaatacatgttataataatacttaagctctttatagaatttgtagggctattgagagacattatagggaagcccttgttctggaaggtgtatggttgtggccatgggtttctctgccactaaatctgtacctggttgttatttgaagttttctgtcctaaaatgtaatctttggagaagctgcacaaccgccatctgggaactcatgagaaatttacgttttatgcctaagtaactctaatgagcaatggctataggaatgactaataaaatatcaacaaggagatgggaattttcaaggaaatatgatatggtaacaatgtcctttttagaaagtcatttttacttatctatattcacagcataaaatgttccaaaatctatgaaatattaaatattatacttcaaaataaagtaatattttggagataaaagagtactgttctacaattcaaaattgaaatagttcaaaagatttcaaatatttttaaatgtattgggacattttattcatattgaattcctgctcttcgtgatattagaaaaggcctgatcttgatcctccaggtgttagataattgctgatgacatttaatcaggggaggatataggtaaaatattatttgagggagatagatgaaatgtgtaggctatatttaagtgagagaataaaataagatgatgatggaaaacctcaagaaaaatttaaatttaaattgcagatgctgaatgataatttttatttattctgatacccacttaatgagtatttaattgtttaattgtctactctgtctcaaatattattttggtccctgcattataataaataaaactatctataaataaatactttgtaccaggaaaagtataaatttatttacaggaatatcaatttgggcgataaagtgttattttctttttcttcataggtttgactggcaaattcgctttggactcgtgtattctcatttgtcataccgcatcacactaccactgctttttgaagaattatcataaggcaatgcagaataaaagaaataccatgatttagtgaattctgtgtttcaggatacttcccttcctaattatcatttgattagatacttgcaatttaaatgttaagctgttttcactgctgtttctgagtaatagaaattcattcctctccaaaagcaataaaattcaagcacattattatgtgtatgctctttatttctcttttttatatttacaaacataaagacttacttcttcactttattttcccagttcgagtagcactgactatagtactttataccatagctcttttgaaatgattatttttaatttagcatgttatattcattttatcttacaaacatatggtcctcaatcacatctagattactagatatgatttgtctctggtgtcttttgccacaggacatttcttagccttgaacattctcacatcaacttatctcaggccctacaggccagcagataacccctatgtcactccacagcagtaggcaggcactcagaacaaaaaccatctaatgctctctatcggtttgtcaatatatccatcaaacaagtttattgcccctctccctctccctctccctctccacggtctccctctccctctccctctctctccacggtctccctctgatgccgagcagaggctggactgtgctgccgccatctcggctcactgcaacctccctgcgtgattctcctgcctcagcctgcggagtgcctgggattgccggtgcgcgccgccatgcctgactggtttttgtattttttggtggagacggggtttcgtcgtgttggccgggctggtctccagttcctgaccgtgagtggtctgcccgcctcggcctcccgtggtgccgggattgcagacggagtctcgctcactcagtgctcaatgttgcccaggctggagtgcagtggtgtgatctccgctcgctacaacctccacttcccagccgcctgacttggcctcccaaagtgccatgattgcagcctctgcccggccgccaccctgtctgggaagtgaggagtgtctctgccttgccgcccatcgtctgggatgtgaggagcccctctgcccggctgcccagtctgggaagtgaggagtgcctcttcccggcagccatcctgtctgggaagtgaggagcgtctctgcccagcctcccatcgtctgagatgtggggagcgcctctgccccgctgccccatctgggatgtgaggagcacctctgcccggctgcgaccccatctgggaggtgaggagcgtctctgcctggccaccccgtctgagaagtgaggagcccctctgcctggcagcggccccgtctgggaagtgaggagctcctccgcccggcagccgccccatctgggaaatgaagagcgtctctgcccagcagtcgccccgtccaggaggtggggggcagcccccacctggcgagccgccccatccaggagggaggtggggggcagcccctgccgggcagccgccccatctgggaggtggggggcacctctgcccagctgccctgtctgggaagtgaggagcccctctgcctggccaccaccccgtctgggaggtgtacccaacagctcattgagagcgggccatggtgacgatggtggttttgtcgaatagagaagggggaaatgtggggaaaagaaagagaaatcagattgttgctgtgtctgtgtagaaagaagtagacataggagactccattttgttctgtactaagaaaaattcttctgccttgggatgctgttaatctataaccttacccccaaccccgtgctctctgaaacgtgctgtgtccactcagggttaaatagattaagggcggtgcaagatgtgctttgttacacagatgcttgaaggcagcatgcttgttaagagtcatcaccactccctaatctcaagtacccagggacacaaacactgcagaaggccacagggtcctctgcctaggaaaaccagagacccttgttcacatgtttatctgctgaccttccctccactattgtcctatgaccctgccaaatccccctctctgagaaacacccaagaatgatcaataaatactaaaaaaaaaaaaaaaaaaagtttattgagtgataccaactgtcagacacactattttagttgtgctcttagaggtgtttaaaattgtc

SEQ ID NO: 14925 - DNA, 9778 bp, Human
ctctttttatttccttgtctagatacctaatatctactttcttaattattaattctacatttaacttaaagcaggagttcaaattttacaagaagatactgataaattctctcttggtaaatatattattataaaggtttatttttaaaaatttactttcttcttaataggaaactattttattacttttttattgacctttccatcatttaaaacagtgctgttataatgcaaagcatatactgtgtaagagttagtcatctcaatcttactaatttgtttaactcattttcattcatttgtgttatggcagaaaagaaagagtttactgttccaaatttttattgatgtgttacttgggaaatatgtttttcataaccattaattgtatattgattatctatgttcatttatctatcagtttatgtgttagtaaaagaagaccaatttcttagaacccttttttattttgtacttgcaacagaattgacaatcattaacaacagtaaaattctcatgccttttgtatcataaaaagagttgtagtaggatttatatattaggtaatagaaaaacttcaaaatacataatttttatagttagtcctatagtagaagtttccatttaaatgagtgaagcaaaatgaacgaataaataatatggtaaatgccataaatcttgggttctgcttttcatgatagagatgtagggctgtttaagagcaggacattttattataattagatgaaaaatgttactgtaatgttatatcacaaatgacaggaaagagagattagaaaaaaatttttaaattacctattaatgaattactttataactgcaattaacagccaaaaatgccatgtaactgtaagtcttgtggtaattgtattttccaatggaaatgcttttatttacgtttgtaatttagaaataagtaacctgctatacttttttatatctgcaaaggaactggatacacttgcatatacataattataaaagcatatcagagtcccagatgaggctaactttgttgaataatattatttgaaatattgaataatcttcaccagttcaacttctcaaagtagatacaatcattttccctgtgaattctcttcattttatttttcgctacccaatatcactaatgttctaatctcagggttacaccatctgtggattctgtaatagaactctggctcatagtcactgactttattataaagccagtctccattgcttttcattctactttcctaatatctctttacactgtaccttaattagcattcttaatgtcattatataagtcccctgtagtgtcacaacaacctaagtggtcatcttttctccagttttgtcctccctatgtgttgaactgtttgcatttttaacatgctttcctctctgttttatttctttataggctcccaacaccaccctttactcattccatataatccaactcaagcttgcctttcttcattaccttcttactcccatcctcttggtctgtttaagatgtccatttgtgtgtttcattagcatattaatatttccaaatcagagcactcacctttacttatcaattcatgaggccatgcctggggctcacacctgtaatccaagcattttgagaagacaaggcaggaagattcctagagcccaggagtttcagaactgcctgggaaatatagtgagactaaaaacattctctactaaaaaaaaaaaaaagaaagaaaaaattcgctgggcatggtggcacacacttgtagttccagctacaagtgggactagggaggctaaggtgggaggatggcttgagaccagatggtccaggctgcagtgatctgtgctcatgcccctgcactccagcctggaaaacagagcatgtctcccaatgctttgaagcatagtgtcatcaatagaagtttgatgaatgaatgcatgaaagaatgtgattactgatttttcatgtttgattttataggactcagccaactatgaagttttttgtctttgctttagtcttggctctcatgatttccatgattgtaagtatatctggaaattttaaatactacattctcagtacttatcccaagtgtctctcttattccttgtgttctggtatatactcatgttgacctcaatacagctttataagctttaatatttccctacaaggagtttctttgaattaacttatgtaagttctttaaggacttggaatagatattcatcacatacctacaaacactcaagtacaattacttgaatgtaaaagtaaaagaaaatttagcgagctttttaaatatgtgggactaagatctgtgaaagtatctttaaatgtgaaaagctctagaccatctgaagttagaaatctgaggaaagaaaaaggtgcacttcaatggaacccaagtattagagggtgtcaaaataggaattttcaagtcatttcttgcacaacctactcttaaagtcagcatacaattatttaattcttcctaaaataaagctgcttattttaaaccataaaacaaatctccatatttattaagtgtcatgagttcccagctctattgtcatttactactgtgtattagtaggaaaagcacttgacctctttggagctctttctccttctctacttccaccgcctcttcctcctcctcctcctcctcctctttctatgaacttaatagaaaattggtcacaaaagaataataatactccaaactatccactaaattctaatgaatgtttcgaaactgaattggttatgatatcacagtttatcacgtgattttattataaaaggatagaagtagaaaaataaacaaataagaacagagtaaagcataatgcctgtctctatcagcaaataaaatatttgtatgttggtagcttttgagctacatggaacatattcatataaaaaacaatccagagtttcatttttcagtttccactctcttattcaccagtgacagacttttcctgccttacataaaaaagatatataaaccaaaatgagttgatatttgaatatagcacattaattatagcatttacccctcactcattttgaagatgtcataaagctaaaataactaatttagtctgtcatcaaccaaagaatgcctccattctgtttaatcatatatgtggctaagtcaatatttatacttactcttgaattataaaattaaaatattaattattttctcattttctttttttccaagagcgctgattcacatgaaaaggtaagacattttcatttacgggaaaacttgataaataaacatatattgaatttttaatcttttctttttatttcatagagacatcatgggtatagaagaaaattccatgtaagtgttcttctgataatgtgcactctaaataaattttcctctctgactatttattctcctagaagaatcaatagttgtctctcaaatatatctatatcattaattgctaaagtgcacattgatttcatttatttatgatgcaaaggcaaaaagtcacaaatatcttgtgtcctaaaagcatttcaacagaaactcaattccacctgaaataagtcaattgtcaattattctctgagaacttatctttgtcctgtaaataatttcattgacctaaagaatagttgaaatcctaattctattaagtataacatatgcttaataaagcatagaggctactcatgtaatgtggtaagtttctaccttctgaatttttgaggatgatacagtctttaaattaaactgactgtgctaaattagacagaaaattgtatttctctaacatttttctcactgtatgtatataaagtctcatgttattttgacctgtaatatcaatatgaatctgggttctaaagttctccttactaacatagcaagtatacatgttaaaaaagcaccaagtaaaaagatgcataaaaatggatgaagactgtttgtgttaacagcagtgggtatgaaagaatgtaggagttgtaaaggaaagtaagatcactaaaggaatgacattaagaagcaccacctaagttggaaacagtaacttaatcctttccataatactcaatagtgagcaaaatagtagcttggaggtaatattttaaagaagatttgaaccctggttagagaggttacctataatcagtgtttccacctgtgctattgtcacaaaaatatcagcaaacagtaaatactttatcatttttacctacttttagacatttttctgataaaaaagaaaaatgtaaaagtttgaaaacatttatgtagataaaatacaaggtcttaacaactttagcaatctaagcttttaatgacagtttttgagaaacacttgtactgtcattctctattctctgcaatttgctctctccttttgtgtgtatgcaggaaaagcatcattcacatcgagaatttccattttatggggactatggatcaaattatctatatgacaattgatatccttagtaatcatggggcatgattatagaggtaagctgactctagttacttgtctttctagaagtgtcaacactgacagtttaaaaaaaaagccataagctaacaaccattccagtttaagaaatgtagcatgggttagctccttgaagtgtattcatttgtataaatgcttctgaagctgtagatatgtggtgttatttctgaggtctctgttctgtgccattggtctgtatgttgttttggtactggtaccatgctgttttggtaactgtagctttgtagtatagtttgaagtcaggtagtgtgatgccttcagctttgttcttttgcttacaattgtcttgggtatatgagcttttctttggatccatatgaaatttaaagtagttatttctaattctgtgaagaatgtcaatggtcatttgatgggaatagcattgaatctataaattactttgatcagtatggccattttcatgataatgatttttcttatccatgagaatggaatgtttttccatttgtttgtgtcctttcttatttccttgagcagtggtttgtagttctccttgaagaggtccttcacatcctttgttagctgtatttctaggtattttattctctttgtagcaattgtgaatgggagttcattcatgatttgggtctctgcttgccatctgatattcaacaaacctgacaaaacaagtaatcaagaaaggatctcctattgaataaatgatgctgagaaaactgggtagccatatgcagaaaaccgaaactggaccccttccttacaccttatacaaaaattaactcaagacagattaaaaacttaaatgtaataccccaaaccatgaaaacctgagaagaaaacttaggtgataccattcaggacagccgttggcaaagacttcatgtaaaaaaatgccaaaagcaattgcaacaaaagccaaaattgacaaatgggatctaattaaactaaagagcttctgcacaacaaaagaaactatcatcagagtgaacaggcaacctagagaatgggagaaaatgtttgcaatctactcatctgtcgagctctaatatccagaatctacaaggaacttaaacaaatttacaagacaaaaacaaacaaccccatctaaaagtgggcaaaggacatgaacagatagttctcagaagaagacattcatgcagccaacaaacaagaaaaaaagcttatcatcactgatcattagagaaatgcaaataaaaatcacaatgagataccatctcactaccagtcagaatgctgattattaaaaagtcaagaaacaatagatgcaggtgatgctgtggagagacaagaacacttttacactgtgtgtgagaatgtaaattagttcaaccattgtggaagacagtatggtgattcctcaaggatctagaaccggaaataccatttgatgcagcaatcccatgactgggtatatacccaaaggaacgtaaatcattctactataaagacatatgcctacatatgtttattgcagcactatttacaatagcaaagacatggaaccaacccaaatgaccattaatgatagactggataaagaaaatgtggtacatatacaccatggagtactatgcagccatacaaaggaatgagatcctgtcctttgcagggacatggatgaagctggaagccatcatcctcagcaaactaacacaggaacagaaaggaaacagcacaaggtctcactcataagtgggagctgaacagtgagaacacgtgaagacagggaggggacaacacaaaccagggatggaggggagggagtaagggaaggtaacagaggactgatcaataggtgcagcaaaccaccatggcacacatatacctatgtaacagaactgcatgttctgcatatgtattctagaacttaaagtaaaattaaaaaataaaatgaaataaaataaaaatgcctccgagggaaagcttctgttcaccagtgttaagatgctgagttctgggtaggaactatagttccagttctgacctggaactattcctaatcttctccatacctcagttttctaatcgacaaatacatattataatactacttaagctttttatagagttggaaagactattgagagacattatatagaagcccttgttctggaaggtgtatggttgtggccataggcttctctgccactaacactgtacatggatgttatttgaagttttctgtcctaaaatgaaatctttgaagaagttgcacaaccaccatctgggaactcataaaaaatttacattttatgcctaagcaactctaatgagcaattgctataggaatgactaatataacatcaacaaggagatgggaattttcaaggaaatagaaaatggtaacaatttccttttcataaagtcagttttatttatctatattcacagcataaaatgttccaaaatctatgagatactaaagattacatttcaaaataaagcaatattttggagataacagagtactgttctacaattcaaagctgaaatagttcaaaaggtgtcaaatattttttaatgtattgggacattttattcatattgaattcctgctctttgtgatatcagaaaaagcctgatctttatcctccaggtgttagataattgctgatgacatttaatcaggggaggatatatttaaaatattatttgggggagatagatgaaatgtgtaggctatatttaagtggaagaataaagtaagatgatgatggaaaacctcaagaaaaatttaaatttaattgcaaatgctgaatgataatttttatttattctgatacccacttaatgagtatttaattgtctactctatatcaaatagtattttggtccctgcattataataaataaaactatctataaatacatactttctgccagcaagagtataaatttatttataggagtatccattttgaagataaagtgttattttctttttcttcacaggtttgactggcaaattcactttttactcatttattctcattcatcataccgcatcacactaccactgctttttgaagaattatcataaggcaatggagaataaaagaaagaccatgatttagtgaattctgtgtttcatgatacttcccttcctaattatcatttgattagatacttgcaatttaaactgttaagctgttttcactgctgtttctgagtaatagaaattcattcctctccaaaagcaataaatttctagcacattattatgtgtatgctctttatttctcttttttatatttacatatataaagatttctttcttcacttcgttttcccagtttgagtagcactgactatagtactttataccatagctcttttgaaatgattatttttaatttagcatgttatattcattttgtgttacaaacatatggtcctcaatcacatctagattactagacctactgatacgaacatttgatttgtttctggtgtcctttgccacagcacatttcttagccttgtacattcccacatttcttatctcaggccctacagtccagaagatgacccccatgtcactccacagcagtaggcaggcactcagaacacaaaccatctaatgctctctatcagtttgtcaatatagccattgaacaaaaatttattgagtgataccagctgtcagatactgttctagaggctgcagtcacagaaaaagagtcagagccctgttgtcagagcttttacattgcaattgggagatgcagacaaaaagtaaacaaagaacacatgacttaggcaataataagtgtgctaaagaagtgtaaagcaggactaggatatagaagcagcctcaaataggatagtcaaggataacctctctggtataggtgaccttttagaaaagatataatttaaatatgggagtaagcatgaagaaagacattttcaagcagaagaaataacaagtacaaatccattgtgaatttttggttacatatgagttgtagaatagtttctccactcttgtgtaaaatgatggcaatttcataggaatggcattgaatctgtatattgttttggacaatgtagccattttaataatattgattcttctaatccatgagcatggaatgttttccatttgtttgtgtcttttgtgatttctttcaacaatgttttgtagttctccctgtagaaatctttcatctccttggttagatgtatttataggtttttattttgtgtgtgtgtggctattgtaaatgagattgtgttcttgatttgacaccttgcatatgattcatgaatagaaatgctactgatctgtgtccattaattttgtttcctgaaactgtactgaagtggtttatcagttccaggagtcttttggtggagcctttagggttttgtaggtattgaatcaaatttccatgaagagagagaatttgacttccacttttcctagttttttattactatatcttgttgatagctctttctatttctttcaatattatgttgaataggagtggtgtgattggacatccttgtcttgctccagttctcaaggtgaatgcttctagtttttgcccattcagcatgatgatggctgtgggtttgtcacagctagttctttttatttcaagatatgttccttcgatgtctagatcgttaagggtttttatcatgaaggaacgttgagttttatcaaaagctctttctgcatctgttaagattatatggtttttgcttttacttctgtttatgtggcaaatcacatttattgatttatgtatggtgaaccaatcttgcatctctggaatgaagcctgcttgataatggtgaattaacttttcgatgtgctgttggtatcggtttgctagtattttggtgaggattttgcatctatatgcatcgagtatattggcctatagttttcttgtgtgtgtgtgtgtgggtgtgtttgtgtgtgtgtctgtgtgtgtctttgctaggttttgctattgcagtgattctggcttaacagatgagttagggaggaatctctcctcctcagttttttggaaaagctttagtataattgataccagctctcagtatgtctggtagaattaagctgtgaatccatgtggtctggggctttttttttttttttgattggtaggttttgaattactgactcaataattaaactcaatatttgtctgttccaggtatccatttcttcctggttcaatcttgagagattgtctgt

SEQ ID NO: 14926 - DNA, 19703 bp, Human
  misc_feature (1)...(19703): n = A,T,C or G
acactatgcccggctaagttttaaagttttttatggagatggtggtctatgttgctcaggttggtctccaacacctgggctcaagtaatctgccttccttggcctcccaaagtgctgggattacaggtgtgagccaccacacccagtctggaataagatttgactgttgtagaatcacatggctagaagtgatgaaggattgattaagcactgctactaaaagaaagattgaaggaatgcaggacaggcaaaagaacacagggaggaatgcatattcagaatgtctgtttgtcaagcactgtataggttgaacacccttaatctgaaaatccaaaatccaaaacgctccaaaatccaaaactttttgagcactgatgtgatgctcaaggaaatgctcagtggagcattttggatttcagattttcagattgggatgctcaactggcatgtattctgcaaatactcaaaaatctgaaaaaatccaaaatctgaaacacttctggtctcaaatatttcagataagggatactcaagctgcatatacattatcccatttaatttacatcacaacccaacaaaatgggtactatttttagaggagaaagcagacttagaaagatgaagaaatttgccgctacaagttgatgagctgggactcaaatccaggtctgttcggctctagaacagaacctatatgtaacatgtctctcttcatctatcgctcaggttttattcacgtgtcaccctcagtcattcactatggttcactggatagctagggaagcacagaacaaacactcagtatttcactcaggtcaggctctgtgccctgagtgtgcctgtctttgccatgttctcccagccaatgttttctctccaatttctccagttttccaggctttccattagactgaaactcagctctgcttccatctcttccacgtattgtctgaagctttccctgatggtttcacatacactaatccctgtgaactcttaagttcaccacttcttctctgggggtggggatggaaagagagtagaaacaaattactctctggacaaattccatgcaaagattttcagctgggtagacccttgataagaggcctgaaaaacgttggtaaagtccaaacctacttttgaacctcaattgagcacctttctttgtggccaggtttcaccctccagagtgttggttaataggttgaggacaaagactccctgatcagaatgagactccccgaagatctgtcctcttgtttagcagaatctggcacatagtaggtactcagtgtatatatcgactcaatatcatgcatctgttgtgtcccagctaccttccacagggcttgatgggttgacttaaataatgcttttaaaattcaggttatttcaatacaaacagcctggcatcattaaggcacaagagcctcacccttctacaccactttccacgaacttccagttgccttccttcaaaatccttgttttcttaagaaacccacaaaaataccgcccctctatcaaaacgtcctcagctttgccaggtagagaattgcttctgcagtagctgggccacgtctctgtggtagtgcccactgcatgggatcggtattaatctgtttgtctttttcatcttctgggctgtgagctcctagaagtcagctttttcacttttacccaagccaaacggttattcgcgtaaggttggttataattaaaatgtcggtttgtgcacatggtttgggactctgtgtatgagtacgactaatatcttcaatttactaagaagataaagaggtcgataaataaggaggtcaagcccgttttgcaaggtcacacaggaaagaagcagaccacgaaatgaacttcggctgtcacctgcggtgggcgcactagaggtcttttgaactccttcggctaccgtcgccgcgttctcgctgtgcactcttattctgcgcctgcgcgcggctacagcacggttcgtttttcctttagtcaggaaggacgttggtgttgaggtgagtccggtcccttttgcatccctaccccgacactgcgggttgtcacaacggcaccctcccgctttctctctgcctcggatttagtcgtgactgtgtgtctccgccgtggtgcagcttcaggcctctcccgcatctactctctcacgcttccgctgcggcctgagggagggcggcgggcggaccacggaccggggtgggttgcgacggccccaccgaagccgggtgggctgcgggaccctcgagaacccagctggcttcggagtgagctggcccggggctggtacccgctgcgctttttcacagccattgtgaccttggtgaggtcatttgacctatctggccccggtgtttctcccgtgagaaaaggggtggtggtttctaatgcagctggtcgtgaggcgcaagggttagtgtaggcgaagcagctggcagcgtcgctcgctgtgtggcagcgttttaaattagagctggaaaactggaggagggtcaccgtacctgccgcaggaggggaaggatgggcttcctgcaacctcccttgccccacggcttcccatcctacccccggccgcgttagctgaaggccagcagggacgcaaaagtttttaggccccttaggtctttaggtgaggctgggcaaaggagcagttagggaatttgggccctcatggtatttgccgcgttcccgtccaggttttaatggtataccgtgtgaccgtggaaaacacctgcctcatgatctgacagggttgtcgcgaaggtttaacgagtggacagaaaatttttagaagagaaagtgttgcataaatgggtttgcaatcgttaattaccaatgcggagctactgcttatttttcttgttgttggaaagatttttgttgcctttgctcgtccattactagtgtgccgcagtttgtcgcgtttatttagggtggtcgctcagtatatggggggcggggggaagatgaaacaggctaagccaagagacagcttaggctttgtgggaggaatccatccactgtcgtgctgtgcctctctaggtagtaaaatgtactatgcatgagaattccttttgatatcttttctgagtttttcttttattattttacccgagaaagggaaaaaaagctcagagtagtgagagctacatgaggtatgcaggacgcagagacctgagtattggacttcagtgccgcccctcacccatgtctcaacccaaatcttattcctgaatttgtgatataaaggacagcgtttagtcagtcaatagcttatgttattttaatgtaaatttttgataaacagtttaggaattgcctctcattttttcttaactcacttgtaggccggaatcccagcactttgggaggacgaggtaggatgatcacttgagggcaggagtttaagaccagcctggggagcatagctagaccctgtttctgccaaaaaagaaaaacattcatttgtaactgctgctaatcggagtgtatattcagggcagctccaatcaatgcttccaggtggccattctcaagtttgtggcttaaataaactctgtacttaatcatattttctgaatctcttaaggttggcatacgtatcaaggacagtaactaccatggctcccgaagttttgccaaaacctcggatgcgtggccttctggccaggcgtctgcgaaatcatatggctgtagcattcgtgctatccctgggggttgcagctttgtataaggtatgtatgttttttactttgtgccgaaggtcataaagtatgtgtttttggttgaaaaatcttttaaagaaactcccccttgtaatgtgtttctttctaaccctttctgcactcacctcagtgtgacaggaactatagcttgtcctccatctttaaatgaagcttgttagtttgctggaatgccgtaacaaagaaccacagactgggtgccttaaatttgctcgcagttctggaggctagaaatccgttggcagggttgatatcttctgaggcctctgttggcttgtagatggctccctttgtcttcacagggtcctctgtgggcatatatctgtagctgaacttctttccctttcttttcctttacctttccttcctttcctttttctgcccttcttttcattttctttccttctttcctttttctttctttgaaacagggtcttactctgtctcccggtacctgggactgcaggtacacaccaccggaactggctaatttttatattttttgtagagatgaggtttcagagatggccacgttgttcaggctggtcttgaactcctgggctcaagggattcacctgccttggcctgctaaagtgctgggattacaggcatgagccaccacacctggcctgctgaatttctaaaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagccgggcgtggtgtcgggcacctgtaatcccagctgctcggcaggctgaggcaggagaattgcttgaacccaggaaggggaggttacagtgagctgagttcgcaccattacacttcagcctgggcaacaagagcgagactctgtctcaaaaaaaaaaaaaaaaattgggaggtggaggttgcagtgagccgagatcgtgccgctgcactccaggctgggcgatagagccagactttgtctcaaaaaaaaaaagttagggagaactgggagagcaaagaggagatggaacactgagtgggagcactaagtggacctatgctttgggactctttggagagacaagcacacaaagtcttttggtccttgagattcctgctgcctggcatatatagtgggcatgaagtaaatgtttgtagaagggatggatgtgatgcagaatttttgctccttagtttagctaaatttgggttcttgtgtcatgaccaggaggaattaggcacatggaaacattgaagggtgaggagggctgaatttattgggtgaaaaggaaaaaagaaaacagactctcagcaaagcaagagggggtcctgctaacaggcccccacctcacagattgaatactaggctaccacacaggagctgaagagactaggctcctccccactgcacaaggtgcagcttctcctggttccaccctgttcccccagtgtgcctgtggccattactcaaaaagaatcagtcctgaaagggtgggcaaatgtgcagctctccctcagggtcgtgggatctgggtccaacagtctggcctttcagccttcaggctgttttaggcttgaaggtgggtttttgctaggacccttggctgtctctctgtcagatggatgactaagtgaggtagggagagtccaaattaaccgtacatgtaatgatggcccccagcacttgtgcttctgcctctttttattttaattttttcaagacggagtcttgctctgtcacccaggctagagtgcagcgtcaccatctcggctcactgtaccctccgaggcctcccaggttcaagcaattctcctgcctcagcctcccaagtagctgggattacaggtgcccaccaccatgcctggctaatttttgtatttttagtagagatggggtttcatcatgttggccaggctggtctccaattcctgaccttgtgattcgccccccttggcctcccaaagtgctgggattgtaggcatgagccaccacgcccgacctctgcctcttgattttattactgggaagaaattgggaattcaaatagaagtgaagcagtaaaactggtcaggtaaaggattcttactgcgttactccatcaagtagcatgatttctgtgtatttctgcagagggagaccccatcttttttattttttattttttttttattttttatttttttttattttttatttttttgagacagagtctcgctctgtcccccaggctggagtgcagtggtgagatctcggctcactgcaacctccgtctcccgggttcacgccattctcctgcctcagcctcccgagtagctgggactacaggcgagaccccatctttaaaaaaaataataagtcacttaaactttccatttttgtcttgaatcttcattttttctttctctgttgaaccccacccaccctttgtgtacggaaacctcgaacaaaacaaaatagacaccttattccccattcttttctttgcaaatttagcagtttcttagactttgtcttcctttttatctgtcaccacctccaccccttaggaaatgtagggtttaaattaaagggtgaacaaaaacatgtgttctaccttgtctttatatattataatctggaatctaatttccagtaatctgaaaaataaactctaatggatggttgctttttagtttcgtgtggctgatcaaagaaagaaggcatacgcagatttctacagaaactacgatgtcatgaaagattttgaggagatgaggaaggctggtatctttcagagtgtaaagtaatcttggaatataaaggtaatatggttatttgaagttacttaaaaaaaaatttctaattgtggtaaaatgcaaatacaggtgactgtccctcacaatgtttagacttaagattttttgactttacgatggtgtggaagtgatacacatttggtagaaaccatactttgaattttgatctttgtccacatgagcaataagtggcacaatacttttgtgatgtgggggagcaccaatgaccacatcccccagtcagaaacataatcacaagggtaaacagctgatgctgtactctgtagtgttgtgtgagatactcagtgttttattataagctaggctttgtgttagatgattttcttcagctgtaggctaacataagtgttctgagcacatttaaggtagggaaggctaagctatgatgtaagttaggtgtattaaatgcattttcaacttaagatattttaaacttatgatggttttatcagaatgtaacctgatggtaagttaaggagcatctataatataaaatttgccatcttaaccatttttaattgtacagtttagtagtgttaagttcattcacattgttgtgcaaccagtctccagaactcgtcatcttacagaattgaaaccctatatccattaagcaacccattcacacctccactcagaccctggcagccactgtgttactttctaagaatttggctaccccaggcatctcataagtagaatcacacagtatttgttttcttgtgactggcttatttcacttagcgtagtgtactcaaggttcatccatgttacagcatgtgtcagaatttctttttaaagctgaatgatctattttagttgtgtcacattgttatccattcatccatcagtagatgcttgggttgcttccactttttgattgttgtgagtgatgctgtgaacctaggcatgcaaatattccttcaaggccttgctatcaattcttttggggtatattcaaaagtggaattcctggatcatatgatttttaatttcttaagaaactgccatacccttttccatagtggctgcaccattttacactctttccatcctccccaacacttgttaattttttttttaacagggtctccctctgtcacccaggccgtagtgctgtagtgcgatcatggctcactgcagcctcaacctcccaggctcaagggatcttcctgcctcagcctcccaagaagctggcactataggcatgtgccaccacacctggctaacttctttatttttagtagagacagggtttcaccatattacctgggctgtgcttgaattcctgggctcaggcgatccgtccaccttggcctcccaaagtgttgggattacaggcgtgagccactgtgcctggcataattttggtattttttgatagtagccatcctaataggtatgaggtggtatcattgtggttttgatttgcatttccctgattatttgtgttcttgagcatcttttcatgtacttattggccatttgtatgttatctttggagaaatgtttattcagttctgctcattttcaaatttggttttttgtttattggttgagttgttctgtatatattctggatattaaccccttatcagatatgatttgtaaatattttctcccatttcataggttgccttttcactctgttgtgtcccttgatgcacagaaattttgatgtcgaatttatttttatttttgttctgtgtgcttttagtgtcatattcaataaatcattgccaaatccaatgtcatgaagtcttttttatgtgttcttctaagacttttatagttttagctcttatgtttagatctttgattcacttgaatttttgtgtagggtgtaaagatccaactgtattcttttacatgtggtatccagttttcccgaaatcatttaagattgtcctcttccatggagtggtcttggtaccttggtgaaatcatttgactctaaatgcgagagtttatttctgggctatttctttagtctgtatgtctgtcttcggggcagtactacactgttttgattacagtagtccgttttatctaagatatgtttcaagacccctctagtggattcttgaaaccacagatagtaccaaaccctgtatatattatgttgtttttcgtgtacgtacatacctatgatgacgtttaactcataaattagacatagtaagagatgagcaacaataacaaaatagaacaattgtagtgtatagtaataaaaggtgaatgtgatctctcaatatcttgctgtactgtactcacctgtttttgaaccacagttgactgtgggtagaactaaagctgtggaaggttaaaccacaaataagggatgactgctacactgtagctttgtagtatgctttaaaatcagtaagtgtgagtcccctagctttgttctttctttcaccccacccggagggtgctctagctatttgtggttccttaagagtctgtgaattttaggatggatttttctatttctgtaaaaatgccattgggattttgatagggattgcattaaatctgtagattactttggtagtatggacatcgtaacaatattaagtattccaatccatgaacacaggatgtctttcctcttatttgtatctttaatttcttttagcagtagtttgcatctttaatttcttttagtgttgctactctcttactatgcctaatttatgagttaagctttattataggtatgtgtatatataggaaaaaacgtagctgtatagggtttggtaccatccatagtttcagtaattcactggaagggtcttgaaacatatcaccttggataaaaggagactactataatcaaaacaatgtgtccaaggacacacatttctttccgtacttttcctttattttatagtgacatgtttcagtttccttcttacttccttatgtgtatattctgtattttctttgtggttaccatggggattgcatgaatgagatttgctaatttttttagcagtatacaggtatatatctgtttcatctaggtcagtgtttaagtctttcatattcctgattaaatacattcctaagtattatttttggtgctattataaatagaattattttcttaatttcctttattaggcattcctttatttccttcattgttggtgtgtagaaagagctgatttttgtatcctccaacttagtagaattcatgtattctgacacttgtgtgttagaaatctttagggtttgctggaggtaagattatatgatctgtaaacagatagttttacttactcctttcctttttggatgttgcttattccttcttgcctcattgctctggctaggacttccagtactacaatgaatagaagtggcaagagcgggcatccttgtctggttctaggtattagaggaaaagctttcacgttttccatgttcagtatactagacttgtcctttttggccattgttgggttgaagtacattccttctgttgatagttttgatcatgaaaggatgttgaattttgtcaagtactttttctgcattttttgagatgtgttttttatccttcattctgtcagtgtggtatgtcacatctattgatttgcatatgttgaactatccttgcatcctagggataaatcccacttaatcatagtacatgattcttttaatgcgatgtcaaatctggtttgctagtgttttgttgacgatttttgcatctgtgttaaaggatttggcctatagttttctcgtgtgtttgtctttgatatcaggataatgctggccttatagaatgaatgtggaaatgttcccttttcctcactgtttttggaaaaacttgaggaggattggtgctggtttcatagagggctgggcatggtggctcatgcctgtaatcccagcactttgggaggctgagaaaggaggatcactataatccagaagttagagatcagcctgtgcaacatggcaagaccccatctctaccaaaaaaaaaaaatatatatatatatatacacacacacacacacacacatacatatatacacacacacacatatatatacacacacacagatatatatatagttagctgggtgtggtggtacatgcctgtagtctcagttacttgggaggctgaggcaggaggttcacttgagcacaggagtttaaggctgcataagctatgatcacaccactgcactccatcctggataacagaatatgagaccctgtctcaaaaaagtttggtaggattcaccatatggtcttggactcttgttttttgaagtttttggctactgattaaaaattcctactagttatagacgttcagattattgttttcctgatccagtcttggttagattgtgtttctagagtgggtgtggtagctcataaggcctgtaatcccagcactttgggagaccaaagcaggtgaattgcttgagcccaggagtttgaaaccagcctgggcaacatggcgaaaccccgtctctacaaaaaaaatacaaaaaataatgtgggtgtgatggcacacgcctgcagtcccagctacctgggaagattacctgagcctgggaggtcaaggctgcagtgagcagtgattgtaccactgcactccagcctaggcatcagagggagatgctgtccccactcccccacaaaatttttttttgagttatgtatttctatttcattaggtcatccagtttgtttacatataattgttcatagcattctcactcctttttagatctgtaaaatcagttgtaatgttccctctgttagttggtggttctctttttttattagtctgactaaaggtttgttgatttgatcttttcaaagaactaactgttggctttgatttttctctattgtagtctattttgtttaatattattcagctacatttgggtttaattcctctttttctagttcttaggttgatacagttttttaaaaatttccttgtaatttcttttttaatttattgattgttaagagtctgtttaatttaaacacatttgtggattttcctcttttcctttggcttttgatttctagtttcatgccattgtgatcagaaaagatactttgtatgatttccagtcttttaaaattgaagacttattttgtgacctaacatatggtttgtcttggagaatgttccatgttctcttgggaaaaatgtgtattctgttgttagctggagtgttttgttaagtccagttgatttgtagtgttgttcaagtcatatgttttcttattaatccttctatctagttgttctgtcaattattgaaagtggagtattgaagtcctctactgctattgtagagctgtctgcttctcccttcaattctgtcagtgtttgcttcatatatttagagctctgatgtttggtgcatatgtatttataattgctagatcttattggtgaattaatctttttaaattatagaatgttcttttttgtctcttgaaacattttagacttggtctattttgtctgatttagtgtagctacccctgttctcctggttgctgtatgtgtgggacatctttttctacccgttcactttcaacttgtgtgtccttagatctacagtgagtctcttgtagacagcatataattggatccaggtttttaatccattctgtcattgtcttttggttggggaatttaatccatttacatttaagataattactgataaagacacagtattgccattttgttttctatgtgtcttacagcttctttgtccctcatttctttcctcactcttttattttatagtgacatgtttcagtctttccttttatattcagtattttctttgtggttaccatggggattacatgaaatatgctaaagttagaacgatttattttaaacttaaaacaacctcaattgcatataaaaactcaactcctttacagcaccaccctcttttcctgtgttactgatatcacacattatgtgtttatatattatgtatccattaacatggacctatatagttacttcttatgcttttgtcttttaaatcctataaaagaattaaaaatgaatttacaaaccaattttttttttttttttaagagatggagtcttactctgtcacccaggctggaatgtagtgatgcaatctcggctcactgcaacttccgcctcgtgggttcaagcaattctcatgcctcagcctcccgagtagcttgaattacagatgcaccccactgtgctcagctaatttttatatttttagtagagatgggatttcaccgtgttggccagactggtcttgaactcctgacctcaagtgatttgcctgcctgggcctcccaaagtcctgggataacaggcatgagccactgtacctagcacaaaccaaaaattaatataagctnnnnnnnnnnnnnnnnnnnnctggcctgggcctccccaaaagtccctgggataacaggccatgagccactgtaacctggcacaaaccaaattttaatataagctttctatgttcctttgccagagaactttatattttcacatgggctttgagttactgactagtgtcctttttgtttcaacttgaaaggattccctttagcatttctgtagggcaaatctaattggtaaaactcctttgacttttttatctgggaatttctccttcatttttgaaggactgttttgtgggatgtattattctcaattgacaggtgttttgtttgtttttttaagctctctgccctttttctcttctgggactcggtaatacctatattggtctgcttggtatagtcagatatcttaagctagttacttttttttttctcttcagacttttaaaatttaatttaattttatagagatggggtctcaccatgttgcctgggctggtcttgaactcctaggctcaggtgatcctactgccttggcctcccagattacaggcatgagccaccatgtccggcctgctcttcagacttgataacttcaaatgatctgtcttgaagtttcctgattctttcctctgcctgagtctgctgttaaatccctctagtgattccgaccccttctccccccattcagttactacatttttcagctccacagtgtgtttggtttttagaaataattttctctttgtttatattctcacttgtttatatattgtttatctaattttgcttagttgtccacactctcctttagctcattgagcattttttagatagttgttcttaaggttttatagagtaagtcagcagcctctgtttctttagggttggtttgtggagatttctttctttcaatcgtccgtgtttccctatttctttatgtgccttgtgatcttttgtgaaattcaggcatttgcaaaaccagctacctgtccctttgcagactggctccatgcatggaaaggccttcactgattagcgcaccataaaggcttggtgtcctctcaaacttttcctggggatgccatcttccctgggcctgtgcatatgcattagttttagtttcctcctatacacagctgcctttcagtttttcttagttttcctgagtttgcctccagcttcctcttggagtcttagctgttctgttattcttttgtctctgatctcttgcccacaggtttctgtaggtctgtgttcccctgcagctcactcatgccatggtacccatcattgctttcagctctttccaacctcctatccaaactatgccattgttcccattagcactctgattcaggcaagacagaaagcagtcccttgggcagctccacacaaaccagaacattgtaggtcagtttcattctttaccttatgtcctgagggaagagccagggtagttttcttctgactattgtactgaggagggcatttggcaagagtgagcaaaaatgccatgaaatttcctgctactttgagtgtggctttttcttggataggtggttcctttggttgctgctcaactggtttctagagttctcataaagctaaacatttttaaatttttggtccatatgtttattcattattttttgtgggggtttgggggcctggcagcttcacagtctatcttgctgacatgaaactactttttatgttcaaaatcatttttataggttatgctattaattgctagattggcattatgaatgttacacttttagaagtcacttttttaaaaaaaagtatttgggacagtatagtttgttaggtgggtgtccacgagtgactagctgtctttccataggtctggtttggtctgttgtattcacaaggtccttatgcctcatggacagtgtgaattaaagttctattatctagaaaaggactgactggtgtgctgatggaaagtcatctaaactgatttgatagcatgtatgaagtaccttgatgagacttcctactctggaatcttatgtgtatatttaacaaaaaagaacaatgtagtttctttttgccacttcagtctgggtttatgccttgtaaatgagtttgctgtgacacagagaatgtgaaactgctattttgtcaggcagtgttcctaaataagcatttcagttgcactatatatatgtgggttacattccaataaaccttatcatatgttgagaatatcgtaagtcaaaaatgcatttaagaccctggaaaacccattagaaagtcaaaaaaattgtaagtcaaaccatcataagttgggtaccatgtgtattaaggaaaaaaaatcaagaaaatattaatggttgtttataatcttaacatatctgctttaactttgaaattttcaaaatttacagtgagcatgcattttataatcagaagatgttaataggctaatttaaatttgttagatttttaccatttttaagattatgtttaaaaacctgtatgagagaacatatttggagacaggaacaaaaatatggcttggaacagaaacagtatgtggctataagggttaatggcaggggggtgggggcggtggtgggcatagaattgagaaggaaaaaagcagaatttgttcaatgcacacaagcaatgagagtaaggtgtggtatgcccaaaatggaaaagaggctattcagagtggtcagggagcttagaggagcgtaaaggagagtgaaacttggagtccaggtagcctgaactgtgctttttctgtggctgagggtgagtgatcaaggtgtgaagtctactagtaggaatagacctcagttgatcctcaaagatggtgagtattgagagagtgtttatctctaacttagcctttgtgtttctcttcacagaatttcttcaggttgaattacctagaagtttgtcactgacttgtgttcctgaactatgacacatgaatatgtgggctaagaaatagttcctcttgataaataaacaattaacaaatactttggacagtaagtctttctcagttcttaatgataatgcagggcacttactagcataagaattggtttgggatttaactgtttatgaagctaacttgatttccgtgttttgttaaaatttcattgttctagcacatctttaactgtgatagtttgtccgtttcattgcagttacttggtcttgggctatggattaaaaagtgttcttcatgagcctgtaagactactgtactgtgggctctaagaagagatagaatcctaataaaatctatccttggccttcattgccactatttggtagctgtgccaccaccacatagttgaaataggtaattcaaatgtagggtttcttactcagtattgctttattaataacaagctaacagtatttaatagaatttggatatatatctaatccagaaaaggttacttaactagaattgagtaatgtctcctaatgacaagcagagtatggtactttttcagaggtcttcttaggactttaattcatgtttattgcgagcaaagtgatactggagaactttaaaaaatgacacttattcaaagctaatttaatcagtaactttattataacaaaacctgtatattacccatttaaactcatgtgtaacattcagtgatgtgagctgtattaaacccaggtattagtgaaaatttgcattgtaaaacctggtaacagtagacatctatgggtggtcagtaattcaaggacaccttttattttaaacaattttatataattcatatcaatatgcaaaattaccataaaagatacaaggattaatacatatttacatttttagaaatagttactctgaggttgacagctgtcacttttctaaatatttacagaacaaactgaaagagacatttttcatagtcagaattgttcgttaagtcttgctttccagtaacaattatatagtgacttcttatgcccaacatgtgagagttaaagatcagtgggtgttgggcatggtggctcacacctgtaatcccagcagtttgggaggtggaggtgggaggaatgcgtgaactgaggagtatgagaccagctgggcaacatagtgagacctcatctctagaaaaaattttaaaaatcagccaggtatggtggtgcatacctgtggtggtgtagtcccagctgcttgggaggctggagtaagatcacttgagcccaggcagtgagcttaagctgcagtgagccatgactgttcccactgtactctagcctgggtgacagaatgagaccctctctccaaaacaaataaaaccagtgggcatttaaaattgcattctcttagtatctcaaaattctaggtaacaagctgtagccccaagtttaaatgtaatatcaatcagcaaacatgctctaagctactggactgtaagaaagatatttactgaacatttaagacatcttggtaacccaagatcttgagtcaaacccattcttagatgcaaaatattatcagacagacactgggaatatcttcatgctttgtcaagtcaattccacagaataaacaaaatggactggtataattgttagcattaatattggggttcttgtgtgctctatggcataccagggagttcccactatgtatgttttgtttatggaactagagaaactcacctgaacactttgggactggattcaatataggacaaaggatttactcaaagtttgcttagtaaaacaaactggaagaagaacactttttctaaaatgtacctggacagtaatcaatcaatcatcagactgttgtaaattttagtaaaatgcagacttcagagaaaatacacatagcagctttcaaagaatagcactgcagttaaatgacaaatgtaacaagccacaaagtcctaagcatttcatttaaagaaagaatcctaggcctttgcagacaaaggagcatgaggcaaaggtggtgactcagcccaaaaacagatgcaacttgaagttttaact

SEQ ID NO: 14927 - DNA, 45314 bp, Human
  misc_feature (1)...(45314): n = A,T,C or G
ttctttctttctttcgttctttcttttctctctctctctctctctctttctttgcttcatgcagtggcatgatcttggctcactgcagcctctacgttctgggctcaagccatcttccccacctcagcctcctgagcagctggggctgcagatgcgcacaaccacacctggctattttttgaattttttgtagagatggggtttcaccatgttgcccaggctggtctcaactcctggcctctagcagtccacccacctcggcctcccaaagtgctggaatcacagatgtgagccaccgcgcccagcctagatttctttttattatgatcaaatacacataaaattgaccattgtaaccatttaaaagtgtacaattcagcgtcattaagtacattcacattgttctgcaaccatcaccactatctcattccagaactttcctatcactccgaaaggaaaccccacatccgttagcagtcactcctgctctcccctcccccttgcctctggcaaccaccaatctgatatctgtctttatggattcgcctagttttagatatctcccgcaaatggacttacgcatatttatccttttgtgactggcttctttcacttagcgtgtttcaaggttcacccatgttgtagcatgtattcattcccttttatggctgaataatattccattgtgtggatagacacatttatctgttcctcagtcactatttgaattctgacataatattttcctattttaaattttaagatacatttttttaaagtttcatgtggcccaaagcacatacctattgatctcacatatctctgtgagatctgttttatgacctgctgttgcatattttcccagaaaattctcggaacgattctctgaagtccttctttctctttctcttttttttctttttctttctctctttctttttttgttttgttttgttttattttgttttgttttgtttttttgagattcagttttgctctgttgcccaggctggagtgcaatggcatgatcattgcacctctgcctcccaggttcaagcattttcctgcctcagcctcccgcgtagctcagattacaggcctgcaccaccacgcccagctaatttttgtatttttagtagagacagggtttctccatgttggccaggctggtctcgaactcctgacctcgtgatctgcccacttcggcctccaaagtgctgggattacaggcatgaaccaccgcgcccggccttttttttttttctgagacagggtctcactctgtctcccaggctggagtgcagtggctggatctctgctcactgcaacctccgtctcccaggttcaagcgagtctcctgcctcagactcccgagtagctgcgattacaggagcccaccaccgcgcccggctaatttttgtatttttagtagagacggggtttcacccaccatgttggccaggctggtatcgaactcttaacctcaagtgatccacccgcctcggcctcccaaagtgctggtattacaggcatgagccaccgcgcccggccagtatttgttcttttcttcatttttcacgtcaggagactgcgtttcagaatagtaaaaagaaatgcctaggaaaaggcctgcggtctctccatttccacagtagcgtgttccccaaagaccaaaccctcaggggaaacgtctagaatgagtaacaacttaaggctgcaaccttaaactttcccaggactcagtttccccagctgtgaaatggctgctgtcgggctgtcatctccaggcccggggcgctgacatttgggccactctcggtctccctcttcattctgggcgcgcattagctctggtccggccggttccgctgcagctgaacagcaagatgcggcacccaggttaccctgatcatcgcagatttctccccggggctctgttctgaggcctcaaaagtgctccttgtagatgggaccaggggtcatttgggcagtagcagcgcctggtctcagtctggtactgaagtcaggaatggcttaaggtgaaatcgtggtcctctggtgaagctcagcgaagaccccctcgccttgtttatgacaagagaacttctgggggcgggaggaagagtccctgttacgatgctgatcatcattgagcttttgctgagcagaaaactctttagtactcaaggtcgagagtctctggtggtctgcctggcaccaggcaccttcctacaaccctagttttccaaaaggacaaagcctggggcaggcgacgtcctagctcgcatttgaacagggccgcgggccagcagagatgcgcgatgcccaactctttccaagagcacctcgcgtcccgaaccggtgccttcaactcggagaagtcaagagacccgcaagaaacttgcacgactgcacccgccgccgcgctctgggggctgggcaggggcagctgggctggctcccggggaacgcgacccccccgcgccccgcagaccggctgtctcccatggacccctcggcacctgcagcctccgaggaagggtcagcgcgcgtgtccgcacgcccgcccccaccgcgcgcccagagccgggggtcgccgtgcgcccttcgccacctccccaggagggcgtccggggcgtcccctctgggggcgcaggaggcccgggggcgctgcccggtggccgcggcgcccggaggccgcactgccggcggcggcggcggcgcggctccccctgctctgtgcagctgccgcccggcgcttgcgcactgggccaggcgcgcggcggccccgggctttgtgtgtgtgtgtatgtgtgtgtgtgtgtgtgtgtgtgtgtgagtgtgtgcgtgtgagagtgcgagtgtctgtgcgcgagtgagtgagcggcgggcgggcgcgagtgtggccgccgcggagcgcgagcaggacccggcgggcgcgctccccagcctccgtctccccgccggaaccatgtcgggcaggtcggttcgagccgagacgaggagccgggccaaagatgatatcaagagggtcatggcggcgatcgagaaagtgcgcaaatggtaagcggaggcgcccgccgccagccgcctccccggccgccccgagcccgagcgcggctccagagagccgcggggcgcagcgccccggccgcctgccccggcccagccccgccgcgggccccgggacttggcgagggcgggcggacgggcgggcggcgcgcgagccgggtcacctgcgccaggctggggccgcggccgctgcccaggtgcgctcgcgcctgtagcccacctggcgcggcggcccggaggcggcgggcgccggggccaggcggttggagcggcggggcggcccccgccgcggcgctcggctcccgggaggggggctcggggccggccccagaagccatttcgttttgtgcaagtcacatgaaagcggcttcccgcgcgccggggccgcgatgccggcggcggcggggagagcgcgagctccattgtgcaggctccgagcgggccgccgccgccgtctcctccccgcgcaccccggcccgcgccccgccgccctccgccagccccggcccgcccggccgcccgctcccgcctcccgggcccggcgccctcgagtctgcggagtttgcagagcgcgagccgtttaaatttagcgctttgggctgcctggagcgagggctctcggcgaccaggaaagatgggggcgagcgctgggagccagcggccaggggcgcggggcgcccacgtcccaccccgctctgcgcggcgccccgggcggggggctcgggccagccgatgtttttggccagaagccgttcgtcctgggccgcggctgcctctccacaccgggagctcgtgtttgttttgcggagggagctgttgtttttgttctctgcaccggggagagggggacttggtggcggccgcgcgtggttttcgggatcacattagcgtccgcccggcgtggcccggtcgacattaaggggatcgaacctttccgcggcctcgtcggggtctgctcggaatcggcccctgggccaggcccgaggcgcaagcagatcgccaggttgggtcagagttgttgaaaactccccgctgcctgatttcaactttattatttttttcccacgccttcactggggtcccggagggagaggagccgccgcaacgctggctctgagtgtcagcgcccgcgggctcgtctcgaccctttatttcgagcctggaagctgggcaggccctgtggcaggggatgtttacgtttgggggtgtcgtttctcgagtagcgcctcggtctctaaaagccactgggggcgagcctccggtgtggcggtgtcacaagttagctgtcctttctgagtcaaacccaacaaaaaaggcaagaggaaaatcaataaagtccacgtgctccccggcctcctatggaaagggctggctgcgatggccggatgcccggccgtgggctgggtttggctccagtgggacaaagaattttcagaaccgtgagaaggggaggctttccaaagttgaaatccaagtcgtcggtgtctcgggagctcccctggtacacagggtgcccggtgcccgactggagccatttaaaaatggcagaaacagctgcaggccaacacacacacgctggaaaacaacccgcagccccctctactgtgggattccccgcgggaagcccggagttgctcccctccttgcctcagcccctgtgcaaagaaagaactggtgtctgtgcctgggtcccttctgtcgccggcctggaggttgggaaacagccggcaagccgcctttctctgctcgaggaggcgtggtggggcctcctactccaggttcccggctggacagaggctcctgcaccctgacagctgctcccgcagagcggccagctgctctgcagggagggcagatggagagatggggcttcccaccccgcgggccccggggcggccggcctggaggccttccagcccgctgaccccgcggggaccaggcctgtagttggagcttgaggggctgtacctctgcgcctccctgggtttggggaaacaacacatcgtgtcctctgaagacctcaggctttgggatctcatggtccagcttccagttcacttcgttgccgcgaccttgggcatatcattgtcacttctctaaccatggtgacccggggttttgtgcttggcttccaggtcccctcgggttattgaggacgattgaggtcatgcctccgagagcaccgcgccctgggcgcaggaggagctgttgctcagtgttgtctgtgttgtaaggtggactttgtagaaacttggctttgaggtttttttttttttttttttttggccccttctaagcgaaagccttggacttattgcccaggtttctctggcccctgagaagccatatctcaccttccccgcgccttcggattgggtcttagactcagcccatgagactgtgggttgtttattaattgtgtggtcaccaaccatgcatttcaccactggtgggggggtggggttgccaggtttaaccagataaaaatacagcacacccagttaaatttgaatttcagataaacaatgaaagatttttttaaaaataaatgtttttgagtatgtctcatgcaatatttgggacacacttatactaaaacattatctaatttatctgaaatgcaaatttaacagggcaccctgtattttacccagagggaagccgaagtgtttggcagatcatttggccccatgagccttgggtgggtttctcctcagccctagtgacccctaaaattacccccccgacccacccactgtcccctgatgcttcccccacccccggaaaaagctgtggcctccctctcatttggggcaggctgcctcctgttctctttttctggtgtttcagcaaggcaggccagtggaggtgaggtgaccagaagatggctaaagggaaaacaaaatggtgggcctctttttgggaaactgggccagggtttgggggccctgtgctggtggaggagagaagaccccagggcgatggtaggagacgaaagcttgggctgcagcgtaagcttggaggcccgctgcggtggctcacgcctgtaatcccagagctttgggaggctgagacaggaggattgcttgagcccaggagtttgagaccagcctgggtctcaaaccaaaaaaaaagaaaaagaaaaaaaagagccgggcgcggtggctcacgcctgtaatttcagcactctgggaggccgggcaggcggatcacgaggtcaggagatcaagaccatcctggcaaacatggtgaaaccccgtctctactaaaaaaatacaaaaaaattagccaggcgtggtggcgggcgcctgtagtcccagctacttgggaggctgaggcaggagaatggcgggaacccaggaggtggagcttgcagtgagcggagattgcgccaccgcactccagcctgggcaacagagcgagactccatctcaaaaaaaaaaaagaagaagaagaaaaaagaaaaattagtctggacgcagtggctcatgcctgtaatcccagcactttgggaggccgaggcaggcaggtcacctgaagtcaggagttggaaaccagcctggccaacatggtgaaaccctgtctctactaaaaatacaaaaaattagctggatgtggtggtacacgcctgtaatcccagctactcttaaggctgaggcaggaaaattgcttgaacctgggaggcgcaggttgcagtaagccgagatcgcgccactgcactccagcctgagcaacagagcaagactccatctcaaaaaaaaaaaaaaaaaaagaagaagaaagaaaagagaaaaggccgggcgcgttggctcacacctgtaatcccagcactttaggaggccgaggagggaggatcacgaggtcaggagatcgagaccatcctggctaacagtgaaaccccatctctactaaaaatacaaaaaattagccgggagtggtggcaggcgcctatagtcccacctacttgggaggatgaggcaggagaatggcatgaacccacgaggcagagcttgcagtgagccaagattgcaccactgtactccagcctgggcgacagagcgagactccgtctcaaaaaaaaaaaaaaaaaaagaaaaaaattagacaggcatggtgaccctcgtctgtaatcccagctactcaggaggctaagcctggaggatcacttgagcccaggaggttgaggctgcagtgagctacgattgtgccactgtactctagcctgggtgacagggtgagaccttgtctcaaaaaacaaacaaaaaaagtaggcttaggcccaggaccccttagcacctggtctgagggttccctcaatgacttgctgtgaggactgagaaaggtctgtgcctgaagagctcccgtctgtcccaggagaggtagaggtttgggcctgaggcctccctcacctcagctcctccagaggtttcatcatggagacattcctactgggcacatggcaggtcaggcagacctgggcctagctagggtgaggccagccatgggccaggcctcttgaggtgacagggactagccatgaggagtgagtacaaggacagggagtagagctttcctggagggagtcagcagggtccccttgagtggtgggtaaccctaagatggtcttgttggctaacccttggacctggacacaggagaacattcgaaattggccttagcctggagaatctgggatggattcttgtagtttatataggagtccgtgctggggaggagcagttggggctatattcctactgctgggacctcattttttcctttcctcccagaagctcaagtgtaatgggaagggaaaggtgctgaagtcagggtaaggtgacggggccgccaagacaggaggcgcggggcacacccagggccagctttgcagcaagttgggctgcagcctggtggttgtggggatttctgcacctggtgcttacaggtgtcaagagtgagggcatctgaggggggccagagagcccatctggggcaagctgtcgctccctggggcatgtgggcccaggtcatgttttcaagagtagccagaagtctggattcttatgcaaagcctgttttgttgtttgtttgtttgtttgtttgaagtttggcagcagatttaacatttttaaagtactgtgcaggccaaacaaaacacgcctgttgactggttgtttgccatcctaaatataaagtggggcccatgtgtggtggctcacacctgtaatcccagcattttgggaggccaaggcaggaagatcacttgagcccaggaggtcgaggctgcagtgagcagtgatcgcaccaccgcactccagcctgggcaacagagggagaccttatctcaaaaaaataacaaataggctgggcacagtggcttatacctgtaattccagcactttgggaggccaaggcgggtgggtcacctgaggtcaagagtttgatgtcagcctggccaacatggtgaaacccgtctctactaaaaatacaaaaattagccgggcgtggtggcatgtgcttgtagtcccagctactcaggaggctgaggcaggagaatcgcttgaacccgggaggcggaggttgcagtgagccgagattgtgccactgcactccagcctgggccacagagcaggagtccgtctcaaaaaaataaaaaaaataaaaaaataagaaagtgatgagtatagcttaataccctcattggggaagaggagcaacgcccttttttgggtaggggtatgtgttctgtggtgatggttttggggggcaattgtgggaaacctcagctgctccgctgaacccgtgtgcccacccagtgtgtctgtggctgtgaaatcccatgtcctcctgggtgctcacttggtgccttaaacttgagctccatggcccctccgggtggctgcttagctgagcataggtccagctcagaggtagaattcttaatgttcttgcctctgtcccagagtcccctcaatgtccacacctagaaatacagtttctcatcactggggtaacttgagaactcggtgaagaggttgccagttggggcaaagagaggcacgaaagcctggctgcattcagcttgtagcctgcggtggcctcgagcctcgctgggaagcagctgcaaacttgcatcttggctgatttgcggccgcaaagcccagatctctggcacactttctgccctgaaaggtgtcctgtgtgttacaagtcaattacttttttttttttttcccaaacacaatcaaaccttgaatgggttgatttactgggaagctggtccagggctcatgagtaatgaatggctttggccaatctgcatggagtcctggcaatttgtcattcttcctccagcttctgttaccctggcgctcctttagaatgattcttggttttcatggccaacagaatagcaggaggtggtgtctggggtccgagcccaaatctaattctcttctgccacttcctgtctgtgagaccccaagctagtggtataacctctctgggcatcctgtttctgcatctgtaaaaagggtgacaatcgtccccctcttgtagcctgttgggaatcccagggagagagggtgtgtaagtagagtgcttggcgtggagcctggcatgtaatagcctgggcacacagtggctattgtgatggttgctctaacaactgaggttcttcccaggagcactcggtctcttctggacaccttctgattgctcagaattgaggaggggaaaggtgggcattgtggtttgtctgctctgcccacaggaggcaggagacgggccagtggacttagacactcgtctttcctgcatcgtttctgggtgaaaaggtgcaaggaggagggagcagagaggctggtctcaacagctgtgctgggtgaagggttcgagtgctggctctgggagaatgagttcaccttcaccgccctgtgcctcggtttctttatctgtcaaatggggaagttgccatttcctgccggatgagccggcacagtccttggtacatagaaggcgctaggaatggccactggtataataagaaaagccgggccgtagcgtcctctgatggaacacgtgggacccgagcgggcagggtttttgggggtgaggtgtctgtggtttcggctggctgggtttgagtatgctccgtcatcccgcaacccccgtggtgacagggtgggagtcctgtaacctgtcacaccagcatgtgagggccacatgccccacgagggggtgatctaaggctgagtttgggcagagaggccaaaaaaaggtgccaggcagctcacggacagaggtgctcgtgccacacagaattctcagttctgggaatttttgtcaccaaaattgctgaggactcgggcagctacgtcgcctgtaccaggggtgcgcctgccccaacagtgcctgctgggccccttaaatccgccagcctcctagctgagccatcagtggctccttggtggcctcgcaggtctcctgatctggcagagtcttgatttaggagcctcggttccaaccccagccctgcttctgggaggctctcctgagcctcagtcccctcaggggtgtggctgctgggtcttcgtggcggtaagggacaagtcggagtgcagggggtcaaggacaggaggtggctggctgtagcaataatcggaaaaatgacagtggctcggagcagagtggtggtggtggaggagagggtgggcattgttatctcgaatgaaaaccagtcctgtttgcttctgtggcttgtaagtttctcctcatccataaacctgcctctcacagtggggggtctggactccgtccttcaggcgtttgtaatgcagctggggtgaccttgcagacagggtcactaggagccctgaatcaggggtgcagttcccctcccacctggctgcacccacacattcaggctgtgtaacctcctttcgggccgaggtcaccactccctggctctccttggccgccacgaagggcattcttccggcagagtgtgggcggctccccggcttgcctgctcatgcctcccctgacctcagacgcatcgcccagagggcaggaggagccccggggtgtccttggtgacgactccaccccccatgagaggaatcggcctgctggcctgaagccctctctgctgcccagacaggcgcgggtggcccagtccactggctgcgtggcattggcagtgacacaggaggaacctgggcccgactcgtgccacccataggagtccttgtaatggcagccccaccctcagcctttttggcgacagcctggagagggcaaccaccctatgtggtgtaacgggtggagaaaccaggcttagatgggtgatgtggcctgcccagggcctcccgctagtgagggtggagctgggattccaaccctcatctgtgtgatctggagcttgctctcagccccaagggagtgtggcctgtgtcccccagggatgaagagtccccggtaacaggctcttcctcatcctcctcagggagaagaaatgggtgaccgttggtgacacatccctacgaatctacaaatgggtccctgtgacggagcccaaggttgatgacgtgagtatggagggctggtcccctggggtgggccacccattcgtgctcctcccaccatggggagggagattgtccactgctacccaccgtgctggggctctgggaccaagagcccctgggagtagaaggacccagattagacctggggaggctgctgtaccagtccccacccctcccactccagccccagagtctggccctcagagcggtggacggggggatcccgcaagctgtgtcttcttcttcttcttcttcttctttttgatacagagtctcactctgccgcccaggctggagtgcagtggtgtgatcttggctcactgcatcctctgcctcgtgagttcaagcgattctccagcctcagcctcccgagtagctgggattacaggtgcacaccaccacacccagccaattttttcgtatttttagtagagacgcagtttcaccgtgttggccaggctcgtcttgaactcctgacctcgggtgatccacctgcctgggcctcccaaagtgctggagttaaggcgtgaaccagtgcgcccggcctgcaagttgtgtcttctgggccgagcgccccccccagggcttggcactgtgttttggggcaggtgtggtggtgcccacagttaggcacgttctccccacctttgtggttctgttcctgagcctctgaccatctgccaggccctgggctgatgcctcacatgcggcatctccgttatttttcctactcagcctgtggagttgatctttttaacctctcctctgtacaagtgagggcacaggctcagagaggtgaagccacttcacatggctcacctcagagctgtgaatggagctcaggtctgtctgactccaaagcgcaggttctctctgcgcttggagaggcttctggtgagtggagctgctggtgacaggggtccccggtgctaggaaagcctggtgtagggatgcggggctccaggagggctccaggaggggtggcgccatcccgacttccaccactagagggaatgcgaggcgctgtcctgtgatggctggcaactgccccgagcagacagtgctctcccaacttcgtggttcccaggccagttacctccagagacccctctcatttccatcccaaatcaagaacagtctgccccataggcctttgcctgggccattcccccctgcctggactgccttccctatttactcaaactcagtccttctacctgggaagatggcgcagactaacccacatggctgcggccactcctgggagtgacgtaaagtcatgattggtaggtttggggtgggggaagcatgtgggggtccagcttcctccaaaaagacaggggctaagtttctcgcccccatcttcagttatctgcccggcaagtcttgggtctctgggcagggctgtggctccattcttcaccccgtgatcacatgctcacccctgaacttgggcctttgttgtcccttctggttctagcctgggctcccggaatcaccagggctgctttccccaaagggactgagccttggtctctctccgcatctcccagggaagagcagggcaagctcctcgaaggcagttcctggctccggcccatgtctgtgccttgcccgccattaggtgtagaaatgctggttgcatttgagaagatgtggtccctgctctcaaggaatttctaatctcgtttggggaagataattatagaatagcatgaaacagatatcagggaagtgccaaatggaatatgatcaaggggaaaacgtaagccctgggccatcgggaaggaccgggcagctctaggcttcaagggaccgtttgatttggaggcagacagaccagccccgattaacctgtgatgttaggcaggtgaccccacattgctgggccttagttccctcttttgtgtaatggagcagtaacatccaaatcgcggtttctgcaacagagcaaaagcaatatatcaccacggagaatacttagcactgtgccggctgtgcagacggtgccgagaaatgcaaattccctcttcatctgtgagccatgatgtgccatgtgccactcccccaccccctttccctctagggcgatggttctcggcctggctgagcaccttcagaagatgcagattcctgggcccatcaccagccgctgagtctctgcaggttgaggctgggaatctgccttgtggagggagagctttttattgttttaaacactcagtatctatatggttatatccatttgttactttagaactcttgaaaatttcatccttttaaataggtaaaatatgttacaaaattcaaattcaaaacaattttttgattaagacaatttacatatcatagaagtcactttttttttttttttaagagacagggtctctgttgcccagtctggagtgcaatggcaggatcatagctcactgcagcctcgacctcctgggctcaagcaatccttctatctctgcctcctgagtagctgagactgcaggcatgcatacctggctaatttatttattatttttatttattcatttatttttttgagacagagtctcactctgttgccagactggagtgcagtggtgcaatcttggctcactgcaacctccacctcccgggttcaagcaattcttctgcctcagcctcccaagtagataggactacaggcgcgcgccaccacgtccagctaatttttgtatttttaatagagacggggtttcaccatgttagccaggatggtcttgagttcttgacatcatgatccgcccgcctcggcctcccaaagtgctgggattaccggcgtgagccaccacgcccagccacacacctggcttatttatttatttaatagagacagggtctggctgtgttgctcaggctggtctcaaactcctggccccaagccatcctcctgcctgagcctcccaaagtgctgggattacaggcgtgagccaccatgcctggccagaagtcactgttttattcagttcagttagtgtattcacaaagttgtgcacctgtcaccactgtaattccagaacattttcatcaccctaaaaaaggaactcatacccattagcagtcacttcccattcccctcgcctgccccggtaaccaccagtccactttttgtctgtttggatttgtgtatcttccgatgttactcttttactgcatatcttttataaatctgcctctcatccctgcatgcaccccccatccccaccccagttctcgcccctggaggcaaccagtgttgccaggttttgtttatccttctaaagggagacttcgctcgcaaacatgcatgtaaatacacgcatgcacatacagagcatgcacacacacacacatcctttgcttaccactggtggtgaggctcacgtatcctgcatctttcatatatatatatatatatatatatatatatatatatatatatatatatatatatcttggcgatattgacatatgttaagtgttagtattctgcagatcaccccatgttagtctgtgaagaaccaccttattccctgtaattgttgcatccgatttcattgaatgaatgtaccacgattgatttaacgagtctcctacagttcagccaaggttgtttctaacatgattcctttcgtaaaaaaaaaaaaaaaaaaaaaattgaatggccgggcacagtggctcacacctgtaatcccaggactttgggaggctgaggcaggcagatcacgaggtcaggagttcgagaccagcctggccaatatattggtgaaacccgtctctactaaaaatacaaaaattagccgggtgtggtggcaggcacctgtagctccagctatttgggaggctgaggcagaagaatcgcttgaatctgggagttggagttggagcttgcagtgagccatgatcacgccactgcactctagcctgggtgacagaacgagactctgtctcaaaaaaaaaaaaaagaaaaaaggaatggcacgaaaagcatccccatcctccctcctttctcccggggtcctccctcctttctcccggggtcttccttcctaactcctcttgcgcttttgtgctggaggtcagtggagtacactttgagaaaggctgccccagggggcctgcagctggtggaagtgagtgacctctgggtcacctggcattactttgtacctgggctgatggtagcctcttccccagatactctccctaaaagaggaggcaggtcctgccagccagggtgtttccacactgctgctgacagccccagaaacaggcaggcttattttccagggtgccggagctgggccagcctcagaaccctccccactgtggggctctctgattccacagtgggcgagacccagaggccagtccctaataggacgtgttcaaatgtgggcccaggaaaacctccagaggcctgggggctccaggaggcttcaatggaataaaatattcacaccactccccaggggctctgagcacgtgtgcgcacacacatgatctggtgacttggtttctgctccattttcccctgcagaaaaacaagaataagaaaaaaggcaaggacgagaagtgtggctcagaggtgaccactccggagaacagttcctccccagggatgatggacatgcatggtgagtgcccatggcctgccagcctctcctgcccagcccggggccttggccaagcactcggtcatgtttttgtttctccagcaggtttgttcacattccaggcaaggggtaggagggctgggcagggcccggcggcctctgtgccaaggagaagagtcagcggaggagaggatgtttcttttcccagcgtaccaagccaagagacataaactaagccagagacatagaaattagaccctctcctcacccagggacaagaaccccgcaggagatgtttctctcagcctcgtgtgtccaggaagattgtttgggcgtatgtttcttcgccccctcatataaattatataaatggctgtgtttcccattttgctttggctgctgggaatctccaaactggattttgtttgtttgttttgttttgttttgtttttgagatggagttttgctctgttgaccaggccagagtgcggtggcgtggtcttggctcactgcaatctatgcctcctgggttcaagcaattctcctgcctcagcctcccaagcagctgggattacagccatgcaccaccatccctgaccgatttttgtattttttagtaagacggggttccaccatgttggcaaggctggtctcaaactcctcgcctcaagtgatctgcccgccacgacctcccaaagtgctgggattacaggcatgaaccaccgtgcccggcctccaaactggatttctgatttcatgttaatcccaccaggaccttgggaactgcccttccacgtctacacctaacttcctttgctgtttaatttcaaatgttgtaacttagccgggtacaggaaacacgcacctgtagtcctggctccttgggaggctgaggtgggagggtcgcttgagcccaggagttcaaggctgcagtgagctatgattgcacctgagagtagctgctgcactccagcctgggcaatacagtgagaccccatctcttcaaaaggcaaaaaaacccaaaaaagttgtaatctaggtccatcaaccaaatccagatggtgctgtctgccattgtttcctgttggcggtgtctgtttctgttttgacctttttatttgagaggaaacgtgcaaatgatgtgtgtatgactccatgaaatgttcccaaactgcacacacccacgtaaccacccaggtcaaaacacagaacgttccgagctagtccccagtgtcccccgcaggtcctcacggttttctccatccacccaaggaaaatgccctcagagattcaaacctaaagctccttttttttttttaaggcagagtctcgctcctgtcacccaggctggagtgcagtggtgcgatctcagctcaccgcaacctccgcctcctgggttcaagcaattcttctgcctcagcctcctgagtagctgggattacaggcacgtgctaccatgcctggctaatttttttgtattttagtagatacaaggtttcaccatgttgcccaggctggtctcgaactcctggtctcgaacgcccgccttggcctcccaaagtgctaggatttacaggtgtgagccaccgcacccgtccctaaagcttcataaaaattaagttggttttccgtgtttggaaatcaggaaatctccgtcctgccatcccttgagaaatcagatctggcagccccgtggctgtgtgctccctcgaggcaagggctgcctggaactgcctgaagccagagccgccttcccttagcaagagtgtggcgcctccaggcccacctggctcacccactgcctctttgtcacctgcctggcctgctaggacaagagcctgcaacccctgcctttttctatctcttgaccccaatttcaacgtctttgtacttttgaccactggaagctttggtacagccaggtagtagtagacaaataactaaaaaaggaactggaagggaatattggtttgctggagtttctgatctctccagacccagggctgtcttgttctggggaaggaaggccagcgaacttccccacgtgctcaaatcgacctgtctggaaaacacagtcaccagctccaagggcagggggactggcaggtttctgaacgggctttagaaaagcacagtggcggtggctcatgcctgtaatcctagcactttgggaggctgaggcaggcaaatcacaaggtcaggagttcgagaccagcctggccaacatggtgaaaccctgtctctactaaaaatacaaacaatgggtgcggtggctcacgcttgtaatcccagcactttgggaggctgaggtgggcggatcacctgaggttgggagttcgagactagcctgaccaacatggagaagccctgtctctactaaaaaatttacaaaattagccaggcgtgggggcgcgtgcctgtaatcccagctagtcgggaggctgaggcaggagaatcgcttgaactcaggaggcagaggttgcggtgagcggagattgcgccattgcactccagcctgggcaacaagagtgaaactatctcaaaaaagaaaaaagatacaaaaaattagctgggtgtagtggcgggcacctgtaatcccagctactcaggaggctgaggcaggagaatcgcttgaacctaggaggcagaagctgcagtgagccgagatcgcaccactgcactccagcccaggcaacagggtgagactccgtctcaaaaaaagaaaaaagaaacgcacagtgggagccaggcacagtggctcacgcctgtaatcccagcactttgggaggctggtgtgggcgggtcacttgaggccaggagttcaagaccagcctggccaacatggcaaaaccccatctctactaaaaatataaaaattagctgggcatgatggcgtgtgcctgtaatcccagctactcaggaggctgaggcaagaaaatcgcttgaatctgggaggcggaggctgcagtgagctaagatcaggccactgcactccagcctgggcaaaggagcgagactctgcctcaaaaaaaaaaaaaaaaaaaaaaaaaaaagagcagtggggctttgttgctggttaatgtgtcaagaaagcccccccaaccagccatacaatcatagttgggttatgtttcattttcagaaatagatatgtgagctgggatgtggcctgtctcagtggcattccttagcatcccctttccctctggggactggggagaccccacgcccgactcaggactgaggttggattacagacgcagaattacaccagagggccttttcgagctgaggccaggaccccacctgggttcacatcctaactctccctgcaccttcccctggctgtgtgatcttgggctatttgtttaacctctagctttggggtttgtttagttttaatctgtagaatggggatggtaatgcctacttcataaactcactgtgaggattaaattaaataatctcttaaaaaccttggcatgggaccaagcacagtggctcacacctgtaatcccagcactttgggaggccgagttaggaggatcacttgagcccaggagtttgagaccagcctgggcaacacagggagacctcatctctacaaaaaaaacaataggtggttcgtatctatagtcccagcattctgggaggccaaggcgggcagatcatgaggttgggagatcgagaccatcctggctaacacggtgaaaccccatctctactaaaaatacaaaaaaattagccaggcgtggtggctggtgcctgtagtcccagctactcgggaggctgaggcaagagaatggcgtgaacctgggaggtggagctttcagtgagccaagatcacgccactgcactacagcctgggcgacagagcaagactcagtctaaaaaaaaatagattaaaaaaaaaaataataataataataaatttaaattagcaggttgtggtgatgcgcacctatagtcacagctactctggaggctgaggatcatttgaacctgggagttggaggctgcagtgaacagtaattgcaccactgcattccactctgggcaacagagcaagaccccatctcttaaatatatatatatataatatatatattatatatattatataatataatatataatataattatagtaaatattttattttgggccaggtgtggtggctcatgcctgtcatcccagcactttaggaggccgagatgggaggatcatttgaagtcaggagttggagaccagcctggtctctatggtaaaatcccatctctactaaaaatacaaaaattattgggtgtggtggcacacgcctgtaatcccagctacttgggaggctgaggcaggagaatcacttgaacctggaggcaaaggttgcagtgagctgagatcatgccactgcattccagcctgggcgacagagcaagactccataaaaaaaaaaaattattttactgtattcaaaaatagagacagggtcttgctatgttgcccaggctgtttccaaactcctgagttcaagcaatcctcctccctcaacctcccaaagtgctgggagtataggcatgatccactgtgcccagcctataataaaaattttaaaaaccttggcatgttaacagctcacatttatgaaaccgtcacaatgtgccaagtattgtgctaagcccgttacatcattgcctcatttgagtctaataaccaaccgcattttacagatggagaaactaaggcccagtgaggtgaagtaacatgcatggttagcaagttcataacttccagtgccattgatggcatttgaggttggttctttgaagacagaatccaggtttgtggctggccgtggtggctcacacccataatcctaggactttgggaggccaagttgtgaggatcgtttaaggtcaggagttggagagcagcctggccaaacaatggtgaaaccccatctctactaaaaatacaaaaattagccgggcatggtggtgggcacctgtaatcccagctactcgggaggctgaggcaggaaaatcccttgaatcgggaaggggaggttgcagtgagccaagattgcaccactgcactccagcctgggcaagagagtgaggccgtgtctccaaaaaaaaaaaaaaaaaaccaaaagatccagatttgtgacctggataaactctccagaaaaatctaggatgctgaacaaaccaggtccccagacacaggtgccctgttgactttctgattttcattttagtgcacgtgcagccgaaagccagtcagactgcagagtgtgtaaatgggaaggtcagggaaaggtgtgggccgggcaagttttctggaaggcttcaagtgggaggatgggtacagcaggggatgaaggagagggcggtgccccgggccctttagtccacaagactcagctgaagttagcccaagtatcagggtcacgctgttaccaggctaccaggctagaccagacgttaaacattagtgctcattgtcattcattaacagagcctcaggaacctacggggccagcttcttgtgcgtgtgcttgccataggaaggaagtctagtttttctcaagggagaaatcggggagcacacatccttcttttttttttttaagtcccagaattcacaagaggatgcttttgtgtaacgagcaccccagagtacagttaaaatcagatccaggttacccgtgtggggccgcctgactgcctggtgcttcctcggcaggttgaggtagaggaggggcgtggggctgggagttgggcagatgggtccggcaagtggctctgctgctcccagcctcagtttccccctccggaaagtgaaggtggtaacggtgcctttccaacgggttgtggggaggattccacgaggtgtccataaatgcttctgcccagtgcctggcatggtggcaggtgcccaggtctgttggggtgtctctgtctctttctcatgtttacaaaagtggccatcgccccgggtgcagcatggcccccagaaaggctgctttggttttgaaacctccacttgggtctctgctgtttaaaacgactctcctaggttgggcacagtggctcaggcctatgatctcagtgctttgggaggccaagacaggaggatcacttgagcccaggggtccaagacagcctgggcaacatagtgagaccccatctctacaaaaacttaaaaattagccagatgcagtggcacatgcctgtggccccagctactcaggaggcagaggcaggaggatggcttgagcctaggagttcgaggctgcagtgagctatgattgtgctgctgtactccagcctgggcaacagagcaagaccctgtctctaaaaataaaaaatacataaatggctgggtgtggtggcttactcctgtaatcccagcactttgggaggttgaagcgggcagatcacctgaggtcaggagttcaagagcaagcctgaccaacatggcgaaaccccgtctctactaaaaaataataaaaacaaaagttaactgggcatgttggtgcatgcctgtaatcccagctacctgggaggctgaggcatgagaatcgcttgaaccaggaggtggagattatagtgagccgagatcgcgccaccgcactccagcctgggtgacagactccatctcaaaaaaataaacagagtgactctgtgcctgagaagggggtgcaggacaaggggaggtgcagcccgggccccagctctgcccccagcccaactgtaaatgccattgcccaattaccccttctctttcttctttgtattgtgaagggttttgttgtcaagaacagtagagagaggaatacgatccccctgtacactccaccttgattttcatgaacacggtgccacatttgtctcatctattttttcaatgtgttagatttttgtaattaaaatataattcacatataaaaaatacacagctagtggccgggtgtgatggctcacacctgtaatcccagcactttggtaggctgaggtgggcagatcacctgaggccaagagttcgagaccaggctggccaacatggagaaacccgtctctactaaaaaatacaaaactcagccaggtatggtggcaggcgcctgtaatctacttgggaggctgaggcaggagtattgcttgaacccaggaggtggaggttgcagcgagcccagatcgcgccattgcactccaatttgggcgacagagcaagactccatctcaaaaaaaaaaaaaaaaagtgtaaaagttcagggagtcctgacagtggccggcagcctgcactgaagtattttctggtaaatttccctgcctcatgacattcaagtctgcacctaaacgtcatagcatgcattgctgaaaatatgacgtttctacatacccactgtcccatgatcacttctaactaaattaacaacagttccttaatagcttttaaaacccagaccatattcaaattccccaattgttccaaagtgttacagctggcacgtttgaaacaggatccaaatcatttccatacatcatatttagtcgagtctcctagctttctttattctaaagtcatctcccctcccccaacttttttttttttttaaatatgatactgactttaagggagtggaccacgtgtcccgtggaatatgccacctcccgctgtctctctctcccttttatttcctatcaagtggaactcagctccaggctggatgcagtcagacagaacgccttggcaatcccgcctcacggaccatgccgtgtcttctgtatcgcttccctgccagacacacaagacgtctggtttctacacccagaatgaggcctcaaatgtccccccaggattttaaatatgttaggccaccatccccagctggctgcctccagacgcagggtacagttggctcagtgtggggaaggtcaggccagtgccggaattctttgcctctctggacacatgggatggctgtggtgcttgggtgggtgggtgggtgggggtcagggggcgggagtgagctcaggggtcccaggaggaggcgtatccagtatccagacccctaccacacggccgggtgcagtggctcaacgcctgtaatcccaccactttgggaggccgaggcaggaggattacctgaggtcaggagttcgagacgggtctggccaacatggtgaaaccccatctctactaaaaatacaaaattagccaggcgtggtggcaagtacctgtaatcccagctactcgggaggtggaggcagtgagccaagattgcaccacggtcctccagcctggttgacagagcgagatccgtctcaaaaaaaaaaaaaacggtaaccagacccctccccgggagagctgccatggggttccgggcattgaggcacagggatgctgagccctctgacctacccgtccttggcagctgtgggatttcatcctgtggttctgttcccaccccctacagacgataacagcaaccagagctccatcgcagatgcctcccccatcaaacaggagaacagcagcaactccagccccgctccagagcccaactcggctgtgcccagcgacggcaccgaggccaaggtggatgaggcccaggctgatgggaaggagcacccaggagctgaaggtatgtggcctctggaggtggggctctgacggcctccctgtaaccggccttcaggcagtctgtggctaggtgttccaggaggccctgtcatgtgccagccccagcaaggagacagtaaagagaggtgacacctggagtacatggtctcgtgggggaattaaaaaaatcagacaggccaggtgcagtggctcatgcctgtaatccctgcactttaggaggccaaggtgtgaggactgcttgagcctaggagttcaagaccagcctgggcaacatagcaagacctcatctctaccaaaaaaaaaaaaatagccaagtgtggtggcacacacctgtgatccagctactcaggaggccgaggtcggaggatcacttgagcacaggaggtcaagactactacagtgagccatgatcatgcctccgcactccagcctgggtgacaataagaccctgtctcaataataagtaaataaataaaaatcaaacaattggccaggcatggtggctcacacctataatcctaatgctttggaaggctgaagcaggaggatcacttgaggccaagagtttgagaccagcctggatagcatagcaagaccctgtctctacaaaaaaatgctttaagatgagctgggcatggtggcatgtgcctgtggtcccagctactcaagaggctgaggcgggagtatcccttgagctcaggagttggaggctgcagtgagccgtgatcacacaactgaactccagcctgggtgacagagtgagaccctggctcaaaatataattatattaataaattttaaatgtatttaaaaatcagacaacctagtattaggaagataagtgtggcagagaattataaagtaggaaaggggtggggggtcttgctgaatgacctggagagttgcagttttaaatggggtggtcggggcggcctttgaataagacaaggctcaaactgggcgactgagcaagccatgtggggatctgggaggagagcagtgtgggcagaggtaagagtgagtgaggagctggaaaataagatgggcaccaggcgcggtggctcacgcctgtaatcccagcactttgggaggccgaggcaggcggatcacttgaggtcaggagttcaagaccagcctggccaacacggtgaaaccctgtctctactaaaaatacaaaaatcagcagagtgtggtggcatgtgcctgtaattccagctagtcaggaggctgaggcaagagaatcacttgaacccaggaggcggaggttgcagtgagccgaaattgtgccattgcactccagtctgggcgatagagcaagactctgtctcagaaaaattttaaaaagttaataataatacggggtcagacagcaggcagcgcctcaggtgtggggggctcgtaaggccactgcctggcctgggttttcatggtaagacgggagccactgggggcttgggtgacatgatctgaaggattaagaacagatgatggggtgattgtgtgagagtgtgtgtgtgattgtgtgaatgtgtacacaaatatttgtgtgtgtttattttgagtctctacagaaaaattaaaagaatggcataatactgtcctatatatccacctgctgaacttggcaattgttggcttttgggtttcttttgctttgtattttttctgggaccatttgaaagtaagttatagatctcaggacatttcatccctaaacatgtcagcacgtgtcttttaaaaataaagacattctgggctgggcacagtagcttatgcttataatctcagcactttgggaggctgaggcaggaggatcttttgagcccaggagttcaagaccaccctaggcaagaagacgaaaccccgtctctacaaaaaatataaaaatgagcccggcatggtggcatgcgcctgtagtcccaggaggatcgactgaacctgagaggtcgaggctgcagtgagccatgattgcaccactccagcctgggtaacagggtgagaccttgctaaaaaaaaaaaaaaaaaaaaaaaaggcattctcttacagatttacaaataccgttactgcatctaagaaaatgagcagcattccggatggtctaacatggaggtatattttgaaggtgaggggagagcctgtgttgggcagtacataggggtgagtgcggacctgagggcaactctgggcacctggagggacagcagtggctgagcgggtctggggagggcaggccaggtctggagcgccttgcacacccatgaggagctggcgagcatggaatgtggaatggcaaatgtgaccagcctgcagctagggccaccccagggctcagggcgtgtgtgtcctgggagcagccagtgtggttctaggagaaaggctgtcccctgctgcagagctgatccgcacccctgtgcaaggaggctctgggctggcgccagggccccagtcatagctgcactctgcttcctgcaccccaagaacccataggtcagcaggggagacagacactggaacgaaggactcattggcagagatgcagacagactctatccagcccgtggtgtgagaatctggctatacaaaaccctgcagtatcattttttaaatttgaatgtgatgtcaaaatttaaaaattgagcttaaaacaggattgatttctagcttcttttgaagaatcagctttgacaataccgggcctgctcttccctggggcagttaccagctgaagcagaagagacccttccctgttgtctctaaaccaaggccaaagggcgcttgccttgtgttacctcatggccactgttgtttttcttattgtagattttaaaaggaaaattaagatatttcttgggttttttttttttttttccagacggagtcttgctctgtcgcccaggctggagtgcaatgacgtgatctcggctcactgcaacctccgcctcccaggttcaagtgattctcttgcctcagactcgtgagtagctgggtttacaggcgtgcaccaccacgcccggctaatttttgtatttttagtagagatggggtttcaccatgttggccaggctgttctcaatctcctgacctcgggatccacccacctcggctcctaaagtgctgagattacagatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacgccgttcgcggcggctcacgcctataatcccccactttgggaggccaaggcaggcggatcacttgaagtcaggagttcaagaccagcctggccaacatggtgaaaccccgtctctactaaaaatacaaaaattagccaggcatggtggtgcacgcctgtaatcccagttactcggaggctgaggcaggagaatcgtttgaacccaggaccacctcctggattgggagccgagatcatgccacggcactccagcctgggcgacagagtaagactgtctcaaaaaacgacaacaacaacaaaaacaggctaggcacggtggctcatacctgtaatcccagcactttgggaggctaaggcaggtggatcacctgaggtccaggagtttgagaccagcctggccaacatagtgaaaccccatctctactaaaaatacaaaaaatagcccggtgtggtggtgcatacttgtaatgccagtttcttgggaggctgagacaggagactagcttgaacccaggaggcagagattgcaggttcatgccattctccatatcaactataatacttcccgttcaagtctgtgactgtgccataatttatgtgaacagtcccttagtgatggtcacttaggtgttcccgtcttttgttttgcacatgcagtcctgcggggggtctggtaccctcatctctcttcacttttgcccaggtgcaggtggctctgcaggctgcgtccctggaagtggaaccgtttagtcagaggctgcatatgcactcagaatgtcacaggttctgcctggcttttccccccgagaagtcatgggtaggatgacaccactagcacaggggttctcagcctcagcacccctggcatttggagacggatcattctttttgtttttctgagacggagtctcgctgtgtcacccagggcggagtgcagtgatgcaatctgggctcattgcaacctctctgcctcccgggttcaactgattcttctgcctcagcctcacgagtagctgggactacaggcgtgcatttgccatcacacctggttcatttttgtatttttagcagagacagggtttcaccatgttggccaggctggtctcaaactcctgacctcaggtgatccacccgcctcagcctccaaagtgttgggattacaggcgtgagccaccacaaccagtcttggatccttctttattgtgggggggtgggccatcctgtgcattgtgggacattgagcagcatctctggcctccaccaaaatgtttccagttgttaaccaatgtccccaggataggggcaggggtaaaatcaccccctgctgagagccagtgccctagcggctttgccatagccttcgctgcgtacagtatgtgtcgtcccctctcatctcccctcatggcccccgtgatcccagcatgcccaccaggcttccctggaaggtggttctgcaggtagaaggcagagggggtgagacgggggctgtggtcacatacagggggacactcaccagctgtgtgggcctgggcaggaacatcacctccacacaccctcctacttccttgtttgtaaaatgggatgaccagctactcgggaggctaaggtgggaggatcacttgagcctgggaggtggaggctgcagtgagccatgatcgtgccactgcactccagcttgggcgacagagcgagaccctgtctcagcagaaaataaaatgggataaacagaagctgcctccctcgccgggagcgaagggggcgagaacgccagcaaagtgctcggcctggagctggggcttaggaggagggtctgggagctgcagggttgccttgtccacccttctgtcgggggagcgattgcggggttcccaaggacggacatgggcttcgtgtgcagccgcgttcctgcttctttcccatcctggtttctttctggccgtggccttgtttctcccacgttgggggtgtgtgtctcctttgctctagaagcccgatttgagctccgcagcaggaattatgttttgagttagtgtgtccagttggttgctactttctcgccactaccaccagatgctaaattggtgggacgcaggtgggacctacaccagggtcctctctggccaccccaggcccctgggcctgcacggctgccctgcactgctcagccaggatccacctgcctgctgcccgagctgcccgtgggaagggcacaaggacagacccgtgtggccttcccaggtgggtgcgtgctgtctgccgggatggggcaggtcggccaccagctgttgaccttgctttgaacttgtttactgctgtgtgagttcagggaatgacataattcctgtccaagctccctggactaaatttaggtcccaggaaaataattttccctgggtgagttccagcaccgcagcgcccagagaatcggctgctgccctgagctcctgaatgctctgtgggttccaaggccagttcccaccaagctctagggcctggctctcaggagaggcctctgccgggcacctctctgcccagcacgggtcagcgtgagtctctgggtgactggccaccttcatgatttctaagcctacatctggggcacccacctcccccaccactctgcagagcctgctgtgcccggcagaaaaggagctgtggtcagatccaaagccacagatgggcaacttttctagtaaaaactttaaatatttatgttaaagcaaacatttattatgaaatagagtataacaataacatgatttctctctctctcttttttttttttttttttttttttttgagacaaagtctcactctgtcacccaggctggagtgcagtggtgcgattttccgctcactgcaacctccgcctcctggggtcaagcgattctcctgcctcagccacccgagtagctgagattacaggcacctgccatcacacccagctactttttatatttttagtagagacggggtttcaccatgttggccaggctggtcttgaactcttgacctcaagtgatctgcctgccttggtctcccaaaatgctgggattacaggtgtgagccaccacgcctggcctggcctggcccctctcttttaaaaaaaaaaaataaataaactagagatgagatttcactatatttcccaggctgttcacaaactcctgagctcaagctatcttcccaccttggccttccaaagtgttgggagtacaggtgtgagcaactacacctgggtgatttttctttttattgagatgaaattcacataaaattaaccaggttaagtgaataattcactgacagtacactcacaaggttgtgcaaccaccacttctatctggttccaaaacattttaatcaccccagaaagaaaccttgcacccagccgcaatcattctccacttctcccttccccagcaacactgggtccctgcccagggcaaccacgaaactttctgtctccatgggtttgcctattctggacttttcatataaatggaatcatatactctgtggccttttgtgtctgacttctcactcagcataatgttttctttctttttgtttttttattgttttgttttttgttttgttttgttttggagacagagtctcactctgtcacccaggctggagtgcagtggcatgatcttgtctcactggaacctccgccacctgggtttatgggattctcctgcctcagcctcccaagtagctgggattacaggcgcgcgacaccacgcctggcttacttttgtatttttttagtgggggggggggggtttgccatgttggccaggctggtctcaaactcctgacctcagccgatccacccaccttagcctcccaaagtgctgggattacaggcgtgagccaccgtgcctagcctgtttttgttgttgttgtcgttttttgagacagtcttactctgtcgcccaggctggagtgccgtggcatgatctcggctcccaatccaggaggtggtcctgggttcaaacgattctcctgcctcagcctccgagtaactgggattacaggcgtgcaccaccatgcctggctaatttttgtatttttagtagagacggggtttcaccatgttggccaggctggtcttgaactcctgacttcaagtgatccgcctgccttggcctcccaaagtggtgggattataggcgtgagccgccgcgcccggccagggctcctagtctgagaagtaagtgtcaaccctgctcagactccctgggaaggagggtcttgctgtcccgttcccccgccctctgtgtcccggcctgtcccaggccctgcactgtctccttcttcttcccatcttgcctgcttgcttttaaacttaagcatgggttattttcccctttgttattactctgcctcagaaaccccagcagggaagtcttggtcgcacaggcattctctaggattcgtttcgtgtgtgctttttaacatcagggtaccatggtgtccgggcctcgggtaggatttttgctgccccttcacgagtgtctggctctgtgtccagtaagctttaggaaaaaccgctgccgccactgcctcctcccaagctgcacccacccccccgccccatccagcctgcaccttccttctgctaaagaaaacttggggtggagcagcaggaagacaggcatgagaaatcacccgaataactgggttcattctactggcgattccttgatggaatggtgtgcggccatcttgtaagctgtgatatttaaagaacctttaaagacatgaagaattcctccgaaataccacatgacccccatttgggaagaggagaaaatttgtacgcatggagggaggggaaactggaaagacgggaattaatcctctaaaacattagtggggtggtccctgggtggtgacaggtgatttttaactttattttttctgtacttttctgtttcctgcaatggtcagtcattgctctggcaatcggaaaaatacccttattattgttattattttgagacggagtttcgctctgtcacccaagctttagtgcagtggcgcgatctcggctcactgcaacctccgcctcccgggttcacgccatcctcctgcctcagcctcccgagtaggtgggactacaggcgcccgccgccaccacgcccggctaattttttgtatttttagtagagacggggtttcaccgtgttagccaggatggtctcgatctcctgacctcgtgatccgccagcctcggcctcccaaagtgctgggattacaggcctgagccaccgtgcccggccaaatacccatattattaagagaaatgtttacaaaaggttaggacgaagccaccttggctgcgggagagaggaattgacagccatgattgttggtgcgcactgcggccgccagggggtgctgggtgcacgcagcacagagactgcagcctcctccagtcgcctcccagggccctcagcagctaagtgtgcaggagagggttgcagacgccagggtccgtgtgtgacctggctgctggaaacagcgccactgaaaaatcaacaggagactccccagccctccagccccccagctcattgtagccttcaaagaccactggccccaaaactacccgattcaaggtattttcagtatttggccccaccggccccgcctctcacgtgtctgaaaacagctcctgtcgtcttgctcttccctcagatgcttctgatgagcagaattcacagtcctcgatggaacattcgatgaacagctcagagaaagtagatcggcagccgtctggagactcgggtctggccgcagagacgtctgcaatctctcaggtacctcgctcgaggtctcagaggggcagccagatcggccgggagcccattgggttgtcgggggtacgttgaaaggtgtttcgtcattgtgttttgttgttttgtcgttggaccattggaactgtcatttgtccattgggctatgcccatgaacacagtcctgggctctgccttgggctctggggccgagggataatgagacttgtggcctctgccctcaaggagcctctgggtcggaggaggatgaagggaccttgaacccagcctcggctgctacgttttgtctgttcaggttcacacaggcattgcctcatctcagtgatccccagatcggtgacctttagagctgggaagacaagacttcagaaacctaagtggtggggcctccgacggagcggtgctgctggccccacttgcactgcatgggcccctctccagggcatcactctgtgttggaatctggtctgaatgagtcagcacaggtgcagtggggcccggtggttaggagcaaacctcccagagtcgggcccaagtttgaatcccagctcccacaatgggatcacggaactgtcttagggccaccgtgaggattcgatgggagaacttgggtaaaacacttagcatggagcggacacaagatgcagaggtgtcattggccatgaccactattaggatttttcactgtaaatcctctagactttttttccttcgagacagagtctcactttgtcacccaggctggagtgcagtggcatgatcccggctcactccaacctccacctcctggattcaagcaattctcctgcctcagcctcccaagtaggtgggattacaggtgcctaccactctgcctggctgatttttgtatttttagtagagatgggtttcaccatgttggccaggctggtctcaaattcctgacctcaaatgatccactccctcagcctctcaaagtgctgggattacaggcgtgagccactgcgcctggcaacttcaaaatctttaaaccctttgattggcaggtccctttccagaacctcaccccatggaaccccctccacatgccctagctctaaggggctgcttagggaaatctggggtcttgtctgagacagactagggcgcagccatctagaagagcatggttgtgccttccaggttctgataaacattcttgcagcgtgcagtgagaaaagcaagctgcagatccgcaggcgtagcatgagcccatctggttaaaaacagtagaaaccaaagcctggtgatttatattaagaccaaagttgtcggctgggatctctgggcctcttgatctcagagaagaaaagctcagcttgaaactttgatccataccctgagagtatccaatgctcccccgcagtacctggaaatgccaggagtcccccattctcacatcgcccccactaccccacactcttgcttccaggagacccagacctaaaattgggcctcttccaccattttcacaggcacaccgacacacatattgtccacagagctaggtgtgtgagtgacatggaggatgtactccagtaaagcagacagcctgacatttcaagcaatacgtttttggccgggtgcagtggctcacatttgtaagcccagcactttgggaggctgaggcaggtggatcacttgaggccaggagttcgagaccagcctgggcaacatagcaagaccccgtctctccaacaaaaagaaaaagaaaattagccaggcatggtggtgcgctcctatagtcccagctactctggaggctgaggcgggaggattgcttgagcctgagagttcaaggctgcagtgggctatgatcctaccattgccctccagcctgggtgacagagcaagaccctgtctcaaaaaaataaatacagaaaaaaggagagaaaggacagaaaggtagccttcctgactccctgcgatccctgctcccagggtcccccagaaggggctcacgtcactgtctctgcaagtccatcgcatgtcctactcgaggcctctcctctgcaacatttatctctgagaacccaccatggaccaggggctatacctaatccctgcctgccacagtggggctgacaatgggctcaggataagcagacacaagtaggtcacagagtcccactaagtgccgtgagagagtgaaacagggtgacgtgaagaagcagaacaggccatgggtagagggtgctgtggctggcgtcagcagggaggggctggctgtgagccggacatgaagggggcccaggctgggacggtgagctctccaggcaggggcagaccaaggtgcagagacctcaagacaggagccagcttgaagaacgaaagagaggccagggtggccggggaggccagaacctggtgggtgaggaagagaatggtctgatgagggaagaagtgggccaggcttgtcactagggccttcttggtcctggtgaggaactgggtttgttcagaagtcagtaggaaagttgtggaatgctttgtatttgtaagttgtggtttctattggaggaaggttgctggggccatcctgttggccacaagcaggctgctccatcagccaggccagaggccgggttggagcgggggtgcgggcggagaggtggcttcagggggtgtccaggcctgggtctttctcccaggctgatggggagcaccagttaggatggctgcggtcaggagtttggtctcaggtgacaggttaggtttgagaggcccaagacaattgtgtgatggatgagtgagtgttaaaccttttctggtgtcctgggtttcatgggatttcagtgacaactacagaccctttcccccagaataacacacacacatatgtgtatacccagcaaatgctgagagtccagcccagaccaggcactgtgcccagccctgcaggagcaggagtctacatggcagagtgggtctgggcctctgggagatggcctagaacttgcagagattgccaggcatcatggctcacacctgtaatccaagcagtttgggaggctgaggcaggaggatcccttgagcccgggagttcaagaccagcctgggcagcatagcaagaccccatctctacaaaaaacttaaaaaaaaaaaatcatccgggcatggtggcacatgcatatagtcccagctactcaggaggctgaggcagggggatcctctgagaccaggaagtcgaggctgcagtgagctatgatgaccactacaccccagcctgagcagcaaagcaagactctgtctctaaaaaaaattataaaaagaacttggaaaagctggtgcggtggctcacgcctgtaatcctagcactctgggaaggtgaggcgggcagatcacctgaggtcaggagtttgagaccagcctggccaacatggtgaaacatggagacatggtgaaaccctgtctctaccaaaaatacaaaaaattagccaggcatggtggtgtgcacctgtaatcccagcactctgggaggccgaggtgggcagataacctgaggtcaggagtttgagaccagcctggcccacatggtgaaaccccgtctctactaaaaatacaaaaattagccgggcatggtggcgcgtgcctgtaatcacagctacttgggaggctgaggcaggagaatcacttgaacccaggaggcggaggttgcagtgagccaagattgccccactgcactccagcctggcaacagagtgagactccatctcaacaacaaaaacaagaacttggaaaggtgaacttgaaacaataatcacaagtaatcaccctagcaatgaatcatagatgggaagattgataacagcaacttctggtccagtctgaatgagtggggagagcctagggtccaaggcagcagtgtaggaaatgctcccgagttaccagccattggcatgtgatagggtcaggcaggggccaggggacaccgcgctccatagctccaggaagagtttgggtgtgagggtctccataggtcctcaaactctctggagtccacgcttgggcctcgggtctggaactgctggtctgaaccacaaagccgcccccgctcggttccttccttggctgaccttcggcctcacgcctggcctaacttgctctcctggcccattaacctgtgttccccttttctcctctccccaaggatttggaaggagtgccaccctctaaaaagatgaaactggaggcctctcaacaaaactccgaagagatgtagacgatgctttaaagcctccgatccatgttccatggaaggtacatcagcaattaattctagagcaactttgccccagcgattcctcttgggtgcgaacagaactactaacgtttcaagtttaccaagtgcaaatccaagaagacccagaacggcgtcacttctcagacactgaagaactctgctgtgaagcaaaacactcaaacctttaagggactgtccttggggaggcaggcggggctgacagctcaggagtgtctgcacactgtctcggaagccaggattccatttgtgttgctgctgtattttccccccacttctctatgtaacgatataagctatcggagggtggtaccgatcaggaacgctttttggcggggctttccactgttcaaccgattccttccgctttctttttttgtgccttgtgcccttgaggtgacctctggcatgtatcctggtggttcttacatccccctctgcaaagtgccctcttggtttggttcgggcggcggctgccaccctactcaccgctctcctccctgccccaggacttcatcggagcaggcagggtggagcgaaggagctccttagcccacctggtttgcaggtgcagggggaccttaggcacgccccaagcaccaggcaccagggcccaaggacgcgcaggtgttggggcacagtccccaagggctcggccccttggatcaggctgggcactcgctgtgctctcccctccttggggcgtttaggactgggcgtctccaagcccaccatggcccagatggacgtgcaaagcccttggaattttctggcacttcctctctattgcccccaccaccaccacccccatcactgctttctcccagacctccgaatacgaaatggcttctctggctgactgcaaggctgtctccttaaggcactgagtgggccggggaggctgggagccggcggcaggattagctggtgctgaactttctctcataggacgtcgcttggatttcaaatccacggtcacctgctgccctttgcctcccccgacgccccagcctgtgccccggagaggcaggatcgcagtggtcagaatccacgtgctttcctattctcaggctgttctgactctgagccaacagctggaccgtgtctcatccccagaacatgccgtctgtccccaccggggagtgggccttgatggccgggcctcgaaggccacaaacaaggcgtcgaggaattggaaagatttgcacaccctccagaaaggagagacgcaatctcccctccctcccatcccccaccttcgctggaacagcttcctctcactgaacggagacgcccccttggacgaactgcctaatcgtttggttctgaggcctggtttgctcttaattaatatatgaactcctcagaccttaaaccttttcctaagctttctttactgcactggagttctgactccctttgagttgtgtgttactgggggtggggtggggtcatgggttttgttgtttttgggggctaattggtgcatattcaggtaccacctttgacgtgtggctctttctcctgaccatcatgggaagtgtctgctggattccattttctaagagtttctgagggtgaggctcttatttttttttttaagggatcctgtctatttcctgcacttcgagaagaatcaaaatgttcctgaatttcaaatacctcatgcaaaatgtctcctgaaataagggaaaaaaaaaaaaccacaactttgaaaatcttaatgttgaagttagcaatgccgaaaggtttctgtcttaaaaaaaaaaatccttgtacttatcaattttgccccttaggcagtcagttttgttgagaactgtgtcctgcatcctggcgcagaacctacctgatgcggttcctctccacgcatctcgaggcggcgttacctccagattccgtagagttagagtcacatttttctttgcagcgaaactccatcttggtgagagatgaatttggatatttatttccttctctgtttttgggaaacgagaggctacaaccaagacagctgaaggagaatgaaacacacacatccacagaaacagagaggcgtaggtggccctgccgttgaccgcagcctctctggacaggcaaggggagttggcgcaggtgaggactcagacgacgtccaccgtcccaaggctgtcactagtatttctctgaagtgcctgaaggtaggaatgggccggcgattgggaccagctgggccccaccacggccacgccaggcaaagcgccagcagccctgcactccacgctggccaagaaggccttccacgcagaatgacaagactgcaaaaatccgatgtgcttccttccctggcgcagtcgctcctcgagccgctgccccccacccaccctgcacccctcgccctccccccaccacagaatctaagacctttcagcttcgagccagggggcgggggatcccgagcaaaagccttccgtggacatcaggccccgtggcctcaagggctcccagggcaaacctaattccccccaaaacgtgaagtcggggaagctgcggctacacattccacaaagtgctggcacttacacccacaacccggaaggctgtggaccgattcctctagggtggtgacctcccattagcaaacggtgtcatggtttggaatgttcattatcgccaagaacctggttagaggcataaagaccttttttcaccgttacctaattttttcccctttcaagaattttttttttttttggtgtgttgtacagcagtataatttttcacttatttattccatcagtagatatggtttgtacaatgtacaattgtttcatttcagaaaataaaaatttcaaatcatgaataccttgtggttttgtctcattttaagtaaggtcagatcgatggtgacggtgtccctctccagctgctccggcctctcttgcttggccgtgtggccctgattctacaagacacacaagttccttgcacacaggagctgttgccttccatagtcataagagctgccattattaagcaccagctggatgccaggcaagccactagttgctcctttctgtgggcaggtattgttggccaccttgtgcaggtgagaaaacagcaggacagtcccctgcagggctctcatgccgggtcaggcccccaggttgaaagccacacctgaggccaggcgtggtggctcatgcttgtaatcccagcactttgggaggccgagaagggcgatcacctgaggtcaggagttcgagaccagcctgggcaacatggcgaaaccccgtgtctactaaaaatagaaaaattagccaggtgtggtggcacacacctttaatcccaactagttgggaggccaaggcaggagaatggcttgaacctgggaggcagaggttgcagtgagctgagatcacgccactgcactccagcctgggtgcaacagagtgagattctgtctcaaaaaaaaaaagccacacctgatccgcctaccccgagacctgggttccagcagggacatgttttcagcttccctgtctctgaggggactctggattgtggtagggactcaggggcgttagtgcatgggtggactgcaacctcggcttgacttgtcctaacagcctctagtgacttacatggttgggctggaaccagacctttcccagggctgtgaccctttcagcccagactccttcccccacgctgacttccccacctctgtccagcgtcacctggcccttgggtcagcccctaaagagagctggcaggggtgggggtgttgtgtcagcgggtctaggccaagctgcactgcgtggaccggctgcaggcagatgctctctcctgtttgttctgtctgactctccttcctacccgttcctttttaacatgttccagtgtttttaccagaattggctgctcagctaaataaactcctgatatggaaagttcagcctgacaaaacacaaatcatagaggccttgtttgcttaaggaaaaaaaatgcctgagctggcacacgttcccgcgcttcctttctgccctcccctgcgtgtctgttcccagctctcactctctggatcggtccctccctcctctctctaaggcttctgccctttccccctgcctcccttgtctccacccgcctagatcactgtctcacagtcattctgtggaacttcctctgtgtctctcactggagccgcctaacttcctctcccacctcccttcatcaaggagcagtctcatgcccaggagctagaaatgtaggctttgccggcattggttgagctgtgctgggccctaggcagcgatgactcaaacttgacccttaacccccaggcaggtaagtgagccgcagtgctttacgatgccgaccacagtttggaattaggggatacagacattctgatggcaagggtcagggaatctcctaggacactggaggaataccaggcctggggctaagcagctcgtttttcctttttgacacaaaggaggggctggaggcttctgagccaaggctctgctggactagggatggtgttgccaatgaatagcatggattggaaaagaccagactggaagtgggagccgggcaactagggaactggaacaataggccaagcggggggccagcggttggcaacagggcccatgtggccccaggcaatgtgaaggcggtcagtaggcagggaggtggggtgggaaagggatcagctgggggaggtaggcagaaaaggctcaggtccaagttccaggccatgctaaggcaacaagtgtcacagaggtccgtggtggggccgaggatggactgcagaccctaaaggccaagtccaacttccctctatcgctcct

SEQ ID NO: 14928 - DNA, 8090 bp, Human
acacaggtacccataaacatttatgaagtacatgagatgttttgatagagacatgctatgtgaaataagcacatcaaggagaagaaattttgatcttaaaaagcaacattattatagctgtataatgctttgattaaagttagtggagttttttctaacacattatcttatgtttgctttgcatgcattcgttcatatctttctgacctcaagactacatggtccttgagggtagagaccagcctattcatctttattaatttcaattgtttattcagtatagatttatttagcatgttctccatgccaggccttgtgttcacaatgtagttagggaacgagtattcagcaatggtgagttcttgtagaggaggagacatgcctcagtcactttcctgcctctctcagtacttaatgtggcaaagggaatagacagcatggatggtgactgtaagtttaattgaactgaatgtagtttgcaaaaataatcagaatctctgagttccacataaaaagccaaattcctagaacagtgatacttgtatagaaacagacaaattcactgatggaacaaaacagaaaagccagaaatagacccatgcatgcagcagatttgatgtatgatagaaatggcattacagatcactgagtgggaacattctttctacgtgagaaaataatgaaactgtattcctacctcacaccatacatacaaaatagatgtcagatgtaaagacgtgatcttaaaagcaaaactttaaagattttaggagaaaacagagaatatctttataacctcatggtaggaaaggtttttgtaaacagacacaaaaaggactaatcctaaagataagatgggtggtaagattggtaagtttttttccttgaaatatgccataaagtgaaaagataaatcacaggggagaagatattgactctgcacataggtttgtgggtgtttaacttactattatgctttatagcctacatatacggaacatcgtctctttttgtacatacgaaattgttgtgtgtatcacatatttcagaaagagaaagagaagaatctgtagggtattaacaaacagtgctgtttttctccaacttttccctcccttttgtttaagaaaggccattcctgggattcgtgtgtgattgacttaatcaaggttcactgtcttaatattcatcacacattattataattatttaattgtctgttcttcctgctggactatgtattataaatcatgagaacaaggaactctggctgtaatgttcagtgtgctgcctctgtcactcagggcggtgcctgccatctcagaggtgcccaataactatctgggtggatggataggttaggcatgagaaacatttcagtttgtagtaaacatctgtgcctgttatttgcaggaaattgtttataaatgttaatgtttgtattctggctcactaagttaactgttgtttctttcattggcaaacatttagtgtggacctaatcaccctctaaaatttcagggtggtagtaattggtgcttcaaatattcttcattactttgtagctaacattttttaatgcctggaagccatatgaaaaatcaaaattttcttaactcaagcaaataaagaatatattcaaagttttgctgtgccaggatttcatttaagctcaattttgatcaaaagagttgaaataattattaaatataacagtcaagtttttaaacctaactttgttatactttactatttaaatcttgaaaatcatgaagacttacatgaactttgaagtttttctaggaaaagaggatttaacaatacttatagtgtcacatttcattttagattactcattttaaagtatttaaaagacgtgaatgtaaatttcctttggggtgtattttgagtctgtcagtgttgtgtatctaggcaggactttgaggttgaggtgcttgcttttttgaaatcataattctctaacttgggcctgactgttacagggcctccaacaccaagtggctcacgtggccacccagctggaagctgcaagattactaacatacaatgctgctaggcttttagaagctggaaagccattcataaaagaagcgtcaatggccaaatactatgcatcagaggtaaaaaaaaaaaaaaaaaaaaaaggaaaaagtaattcagcctttttttttttcagatatatacttattaacattttctcttgggaatgttgattgtactttggttgtttttcaagttaagataacatggacttttatttcttataatagaaaagcaaaaaaggaaaactgccataggaaaacacttgaattctgtgaggtctcaatgtttcgttgagtagcccagctcagctagaccacccatctcaaactgccataggaaaaccttcagttctgtgaggtctcgatgtttcgtgagtagcccagctcagatagaccacccatctcaaatccatggctgagcctcctctgaatgagggtgtcatgcctatggtgtcaagttcgggcaaagtgaatgccgtggaagatgatgggtccatcatgtgaacaaatcagatttaaaacaccaagaaaagattgtctaaaactttctactcatacatttgctttctagagctaacacattagactgaggctagagaatttagccaaatcactgggcagctgtttcgtagcctcagcagtatcttattcattccatggctttaaattctcatttaacctctccagcccataaattaaatatcctacctcaacttctttctgaattccagactaacatgtccaacttctgcttcaccatcagaacctgagcgtcatcttggcaccctgctttccctcaccccccacattgagtccagcatcatttcctatgattctacccctaaaagattccttaaatggtgtgtttgtctccctctccactgccacctctgtacttcagtcacctcactgccctcctggtccctggtgcttcctcccatccagcctctctcctttttcaaagtggcagtgaggccatgtcaccttccagctttaacccttcagtggcttctcacaacaaatggagctctatctgtactagattccaattgctgctataacaaattaccaaaaagtcggggacctaaaacaacgcagtttcgttttctgtcacttctagaggtcagaaatctgaaatgggtctcactggaatacaggggctgcctttctgtggttctggcagacagttgtttccagcttctaggggctgctcacattccttgactcgtagccccttcctccatcttcaaagccaacaatgtggcatgttcagatctctctctgactctgcttcctgtctccatggtcacgtcaccttccatgactaactctcctgcctcctccttttccttataaggatccctgtgattatatcacagccacccagataattcagggtaatctctccatctcgtgtccttacccacatctgcagagtccctattgccatggaaggcagcatattcacagctctgagggctaggatgtggacgtccttgaggggccattctgcagggtctctcgctcctccattctcttttcacatttcaccccgatcccagcccactggctgtctcaggggctggaagttgaagagctcattctccccttggaggatttcgacgtgttggtcctcagcttgaaatgtcccttagctcgtccgttaggcccccagtaaacatttcctgaataaatgatatctctcagcatgcagattcatgtgaacaatgctctaatttcttaagaaaatggggattctgtgaattaataggatgttttacagaaatggtatggagaatgggactgaagagacaatgctagtttagaagataactttagtccttccagtgccactaacagtgaatccatgttgctgaaaatgttacccagaagtgtttatcatgtataagttatgtggtttcagtgtgtgatttgcacttgcttttggtagattgcaggacaaacaacgagtaaatgtatcgagtggatggggggagtaggctacaccaaagattaccctgtggagaaatacttccgagatgcaaagattggtaaatagatttttttttttacattttattttgttttatttgcctctgtaggtattttggctgttttatttgtcgtttttttcctaggtaaaagcaattttaatttcttcagtatatgtttggtggctctatttatgtggctggatttttttcttacctcgtccttcaaaaaaaattgttctatatttttaaaaaatatcaaattgcctttttaaatgcctcaacaggctttttagtaaaactgccacaaataacagtctgagcttatgcatcaattgttgaagaatcaaaatcttcaacttttgtttacacctttagtcagtttaatactgatcctggacatcgagaaaccaaatggaaaattgtcatctcttagtcaaaattactgtgaaatagtaccatattcaggggacatgaagtgatgtgactagtaactgttttatagcaagcgcagaggtgatgtttatagagctatttcttgtcttaaccatgcgccaactcctcattgttccttctgcttccttttgcttaaggtacgatatatgaaggagcttccaacatccagttgaacaccattgcaaagcatatcgatgcagaatactgacgtctataggagtgggacccctccctggtgtcactgctgtaaaattttaaacggttgtgtcttgttgggagtaagtgccttgcgtgggaataaacttccacagcattcgaatattttaatgaagcccttagtcagggtcctggtgttggcctttttggttttctcttttcaggctgtttaacttaggcacaggagatccacttttaaacttgggaaataagcacctgtatttttttccaaaactgtttttaaagctgtatacgcatacatatatatatttttactctgtcttactctgtcacccaggctagagtgcagtggcgcgatctcagctcactgcagccttgacctcctgggttccagtgattctcatgcctcatcctcccaagtagctggaactacaggtgtgcaccaccatgcctggttcatttttgtgtttttagtagagatggggttttaccatattgcccaggctggtcttctggcttctggatatcgcccaccttggcctcccaaagtgctgggattacagggatgagccaccatgcctggctgggtatttatattatcattctagtttcagagtatacagaagtttcatcccatcatttggaaaaataaaggcatctgaagtacaatattacttatagaaatagtttatattcctattaaatcttaatcttgtggcatcagggaaatatttgttacatagtaggcaatttttatccagtactttatagattcaactctaagttgcaagcgaagtcaaaactgatgaaaatttatttagaaaaatctaaaaattctggttttaaatatgagaatcagtggaaaataagggtataattttgtaggtcatatgattgaagaaaatattattttaacaatgtaaagcaatatgatttgttactataattaacctgtataaaagatacattttatggtggtttcagtaggtcattttaaaaaccaatgtgcattagttttcaagtataaggtttaagtaatttggtttaataatcagaaaatattcaatacagtgttggatattctgtcatgcactatttttcagttgacaatttctgtattttaattgaatactgtttcttcagtcatggttattgcactttatcctgaataataattcagaaattgggttttggttcagtgattctcaagaaaaagatctcttgcccattaagaagtgtatcaaaatctcataaggaatgagggagagaagggggctgtagagtttgaaaaagcatattcaatattaaaatagttttatatttgggaaggcaaaaatgaatctattgttttgcaatataggttataaacaggcaaaatgcaataaaatatatatctggttgtattagtctgttttcacgctgctgataaagacatacctgagaccaggaagaaaaagaggtttaattggacttacagttccacatgactggggaggcctcagaatcatggtgggaggcaaaaagcacttcttacatggcggcagcaagagaaaatgagaaagaagcaaaagtggaaacccctaataaacctatcagatcttgtgagacttactatcacgagaatagcacaggaaagactggcccccatgattcaattacctcccccgggtccctcccacaacacatgggaattctgagagataccatttaagttgagatttcagtggggacacagccaaaccatatcattctacccctggcacctccaaatctcatgtcctcacatttcaaaaccaatcatgccttcccaacagtcccccaaagtcttaactcatttcagcattaacccaaaagtccgcagtccaaagtttcatctgagacaaggcaagtcccttccacttatgaacctgtaaaatcaaaagtaaactagttacttcctagatacaatgggggtacaggtattgggtaaatacagccattccaaatgggagaaattggccaacacaaaagggtaacagggcccatgcaagtccaaaattcagcagggcagtcaaattttaaacctccaaaatgatcacctttgactccacgtctcacaatcatctctctcaagttcgaagttccacaaatctctaaggcaagggaaagatgctgccagtctctttgctaaaacacagcaagagtcacctttactccagttcccaaaaagtttttcatctccatctgagaccacctcagcctgaattttattgtcaatattgctatcagcattttgggcaaagccattcagcaagtatctaggaagttccaaactttcccacattttcctgtcttcttctgagcccttcaaactgttccaacctctgcctgttacccagttccaaacttgctttcatatttttggctatcttttcagcaatgccccactctactgttagcagtttactgtattagtctgttttcacactgctgataaagacattcctcaagattgtgaagaaaaagaggtttaattggacttacagttccacatggccggggaggcctcagaatcatggcgggaggtgaaaagcacttcgtacatggtggtggcaagagaaaatgaagaagaagcaaaagtggaaacccctgataaacccatcagatctcatgagacttactatcatgagaatagcacaggaaagactggcccccctgattcgatgacctccccctgggtccctcccacaacatgtgggaattccagaagataaattcaagttgcaatttcagtggggacatagccaaaccatatcactggtgatgccacttcttcagtattagggattctcagtcagaagagaccccctgtgtggcctgagtcccctcaggaggaaggtggacaacagagaaatgagagttttgatattttctgaaagaggaacatgtgttagagatgaagaatcttccaaggctcatgcagttgcttagaataatcattactgttatatgagaaacattttagtaatttaataaaaggataatgtttatttaaaaaacctgacttttccagagtaattttgttttgcacattcatgtttattgaagtggactaatttctataatgcaaatcagagttaaatattaaaaattgtgtaaatacaattgacataggaattacattaaaatattaggaagaaacaaggacaaatttagaccttgaatccgaagagataaagcttacttgactttcaaatggagagatgatgaaaacccactcattcagtctttcagaacaaaaagacagtcatctgataagagtatgacatggatgaaatgccctacaggggccttggacatctttaatttctgcgattatgtgaaagaggtggactttacagataatggagcagaagccaacatt

SEQ ID NO: 14929 - DNA, 7948 bp, Human
gaggggcattctacacagtaactctcctgtgatcttcacactgtgttcaggtcatgaaggtgaagggaagacagagggcctttgtgggtttcaggaccctggagaagcgtgacaaccgaatacggcacatggctcagaaatggatcctttgctataaaggacactattggggcattgggtacattttgcatagggcctgaaggctatttggagttattatatccatgttaatttcttgattatggttataatgcgaaaatgcctttgcatgaaaaacacattaaagtattggggtgttggggtttcatgctgacaacctactttcataggttcagggaaacatatttgtaccgtgcctgcaattcttctgtaaatttgatgtttcaagataataaaaacaaaaaggaaactgagcctcaaaatgttacataacctgactgagtccacatgggtaataagtgacagctctgggtgaaaactcaggtgtgcctttcccctaaagtcacgccctgccctgccaaccacaaggccctgcacatctgagttggcctctgttcctgctcatcacctgcaaaacagccctgcctccccacagccaagttgctggagctgcgccccacctgcccccaccctgcactggcctgactcccccattccacacctggcccagcacccaccacatggtgtggcagacagcactggggcagctgaaagactccatgctacaaattggcactgcccagcttcctgcttctgggagtggggtccattggctgagcttccgctccctggaagagctccagactcctcaatggtttgggatttttcaaaccaattccaaataagccaggggagattttcctgtcttggttcccatcattaccacctccacagttggagattccctcctaatccagatgctcaaaccaggacctcaacaactagggcttcatatatcactgggacacttagcataatcaccattgcaggttgccagacatcacccaaagtgatgttctaccaaagacagaaactgcagctctcccgtgaccttccaggtgctgccctgactcctccagctgaacctgctagggcagagggaagtggaacgtgcagcatatttgcctgccactctgcccatgtgcccaccaactcagctgcaggctccagggacacaggctggtgggggggcctggggctcatggctgagccaggtcgcaggacagacaagttggcctggatcaacctgaccaatctcagctggagcagtgagttcttcattgtctgaatctaaaccaggaacccagtggggcttccttagtgcctgtgtaagggctctcggctttcactgctaaggagcttgctaggggcagggtgggtgacctcagccaagggggggatttctcttcttacagacctggagttcctctttcgcaggttctgtgctcccctcaagggtcctttgagatcctccagcctgagtgctcttggggaaacatgctgtgtaaacactatgcccatttcctgcctggagcacaggttttgtggtagggctctcaggggtgaggaggaagcctggcagcccccacatctataaatgctgcgtctaccttaccctctgacttggaggcagagacccaagcagctggaggctctgtgtgtgggtgagtttagccccatcccctaggtgttctccagcttgaggatcgcaggcagagaggaccagcccagcagccacaggcctgaccaaagcccaggctgggaaggagggcaactccccattttccactgggaggtgtttcacagcacagtcaacataggtgacctgcaaagatcctcatgtttgttattttctttggccagatccatccctacagggttcagcagggcctacaggaggggcagtgagagaacagaccccaaaaagaaaggggactccatgactgaccaccttgaggggggccaggctgcgggccccgttcatcttttttcattctcaggtcgctgatttcttggagcctgaaaagaaagtaacacagcagggatgaggacagatggtgtgagtcagtgagtgagtgacctgactaatagcctgggagggacagggcaggttttctgcagagcacggaagattcagctgaagtcagagaggtgaagccagtttcccagggtaacatagtgaggcactgaaagaaaggagactgcactggagcccaggtccccgggctccccagagctccttactcttcctcctcctcagcagcctggagaccccacaacctccagccggaggcctgaagcatgaggccatgccaggtgccaggtgatgctgggaattttcccgggagcttcgggtcttcccagcactctggtctcgcccgccctgcctctcgggctctgcccagcttcctgagtcctgacagagcacagtgggggagatgttggcagaggtggcagatgggctcacggccatccctcctgcaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggtactgtgctgcagaccccaccctcagctgagggacacagaccccttttcaggaggcccatctgtccaggcccctaggctgtgggccatagtgagctgggggctatagtaagctgggtgggacttcagtctgcagggctggtgggttcctggggcccttatgatggcgcatcctggagagtctgtcctcatagtgcccacggagtgatagagtgatagctgagccagccctggtgataatgggcatcgagtctcactagctccaaccagttgtgggtgacagatcctacacatccatgtctcttttctctgcaggccccatgggtccacctggagaaatgccatgtcctcctggaaatgatgggctgcctggagcccctggtatccctggagagtgtggagagaagggggagcctggcgagaggggccctccaggtgagcagggtggggcaggtgggcagtggaaacatgggcacagcgaccctgaagtcagttacacggggatgatggggatcagacaaaccctacaggttccccaagggcatttggctcaacctaagtaagagaggataagcttgagggagaaagctgaggtgtctggggagtgtggtcacaattcagggaaaggcaggtgtgggaagtcctccgtgcctcatgaccaccgatggggacacactgagtcaggtgtgggatgagggacagcactgggaggcaggggaggcatgtcctgggatggaggccctgggggcagtctgaagggtgaatgcggacgaggcatccaggcagatggtgtgatcaggagccccacagacagaggggaactttgaagctcagagcggtaagcaagtccatcagggcagtgcagagagcatcatgcttgcccttggtggagggtgcgggagagggacttgccccacagaggcgggcagacagaacccctcgagggacagagcaggaaagaggacaaggggtgggggtctcagcaggggcaaggcttcactaaagaataggggaccacggggtgtggagacacactggaatctcgtggaccctctgagcctagggtctgggtggtgcctaacagcaatgaaagggcagagttccaggattgcagatggcaaaacgcctgcgtggcagcaagtgggagtcttcactggcctgcccctccttctgtgtggggcactctccacagggcttccagctcatctagatgaggagctccaagccacactccacgactttagacatcaaatcctgcagacaaggggaggtaaggggaccccctgggcctcacggggtaggagtttcccacaaattcccctcattctcagcaccagcttctagaacatagagattacaaataggcatgcacatgcaggtgttggggaaaggaatgatgcttgcttttctgatgtctttgaatggcccagaggagacaagcagacacaattcactccccatttcataggaaagcaagttctccacctgccttgctttccactgaattctaggaaattgcaccatttctggcaataagtaattgttacttaggtgaatgaataaatggaggagagtctaaaagtgaatttagaaaactgcaattggaagaggaagagaagacacagagagaggcagagatggagagactggggagaatctggtagcagagaccccaggtgagggaggtggcttagagacaaagtggtcagtggcctgacccggactcctctgctctcagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactctcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctgcctctgcagcccactgcctgcccagtgccatcaggatgagcagtcccggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacaccaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatcttcacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccatagctttggttccaagaaatatcacatttctgtatttttgtaaatcaaatgaactctgactctgagcccccacttgcctgaagattggaaaattcaatctcaggatgtgctttctttgtttggtaggaggagccacctcctctcctcactatgatgctgcagagggatggggagctacagccaccatttggaagaacatacgggcttcctgagtccacatggtccatttgtgggtgggaataccatgtcttctgtcccctactcagccacctgaatgatttctgcagcccagcagtgatggtggcactcagggctcagtcccaggccttagtgagccatcctagtctcaggtctgcatggaatgggaccacactctcatgacccagggctgcgcaggaatgagacaatgtctccaattgcttgaggaggcagctacatatgtgtcccacctcccacttctccccctataacacctgtgaacactctttctcagtgcatttattgcttttcttgggcggaaggaagctcagaaaaccaatgagaataagaggaaatttttctcagtcttttatgagtgataatttttaatctgatcaccattccatatgtgcttaggacccagcacagaaattattgagccttcttcaaaattaagaaaaaaagcaagtagaagcatgtacagatgtatctcgacttatgatggggtgacatcccaataaacacattgcaggatgagaatatattaagtggaaaatgcatttaatacacctaacctaccaaacatcatagctgagcctggagtaacttaaacatgcccagaaaacttatgttagcctgcagttgggcaaaatcatctaacacaaggctgattttataatgaggtgttgactgtctcatgaaatttatggaatgctggactgaaactgaatgaataattcagttatatgtgtacttgaagtatggcttctactggatttgcattgcttttaagtcattgcaaagtggaaaaattgtaagtcggacagttgtaaatccaggacagtctacattcccaattatatagataaatactttaagcctctgaaaatttgcatctattgagataatcatgtggtttttgtctttagttctgtttatgtgatgaatcacttttattgatttgcgtatgtggaaccaagcttgcatcctagggatgaagtttacttgattgtggtggataagctttttgatgtgtcacttgattcggtttgccagtattttgttaaggatttttgcatcaatgttcatcaagaatattggcctgaagttttcttttttgttgtatctgccaggttttggtatcaaaatgatgctagccttacagaatgagttaaggaggagttgcttcttttcaattttttggaatagttttagtaggaatggtaccaactcttctttgtacctctggtagaattaagctgtgactccatctggtcctgggatttttttggtgggcaggctatttattactgcctcaacttcagaactcattatttgtctattcagggattccatttcttcctgattctttcttgggagggcgtatatgtccagggcatatttatccatttcttctagattttctagtttatgtgcacagaggtgtttatagtattctctgatggttgtttgtatttcgtggggtcagtggtgatatcccccttatcatttctgattgtgtctatttgaatcttctcttttcttctttattagtctagctagtgatctatctattttattaattttttcaaaaatccacctccag

SEQ ID NO: 14930 - DNA, 7960 bp, Human
tctaactgtaaggcaatacaaacaaacaaacaaacaaagtgaggggtattttacacagtaactcccctgtgatcttcacactgtgttcaggtcatgaaggtgaagggaagacagagggactttgtgggtttcaggaccctggagaagcgtgacaaccgaataaggcacatggctcagaaacggatcctttgctataaaggacactattggggcattgtgtacattttgcatagggcctgaaggctatttggagttattgtatccgtgtttatttcttgattacggttataatgcaaaaatgcctttgcgtgaaaaacacattaaagtattggggtgttggggtttcatgttgacaacctactctcataggttcaggggaaaaaaaagtcgtacgatactggcaatttttctgtaattttgatgttgtttcagaataataaaatgaaaaatgaaactgaccaaggccacctggttaataagtgacagctctgggtcaaaactcaggtgtgcctttcccctaaagccatgccctgccctgccaaccacaaggccctgcacatcccagttggcctctgttcctgctcatcacctgcaaaacagccctgcctccccacagccaagttgctggagcttcgccccacctgcccccaacctgcactggcctgactcccccattccacacctggcccagcacccaccacatggtgtggcagacagcactggggcagctgaaagactccatgctacaaattggcactgcccagcttcctgctcctgggagtggggtccgttgtctgagcttccgctccctggaagagctccaaactcctcaatggtttgggatttttcaaaccaattccaaataagccaggggagattttcctgtcttggttcccatcattaccacctccacagttggagattccctcctaatccagatgctcaaaccaggaccctaacaactagggcttcatatatcactgggacacttagcataatcaccattgcaggttgccagacatcacccaaagtgatgttctaccaaagacagaaactgcagctctcccatgaccttccaggtgctgccctgactcctccagctgaacctgctagggcagagggaagtggaacgtgcagcatatttgcctgccactctgcccatgtgcccaccaactcggctgcaggctccagagacactggctgggggtcctggggctcagagctgagcaaggttacagggcagacaggttggcctggatcaacctgaccaacctcagctgaagcagtgacttcttcattgtctgaaactaaaccaggaacccagtggagctccctgagtgcagagtgggtgaccttagccagtgaggcatttctcttcttacagacctggtatttttctttaccaggttctgtgctcccctcaagggtcctaagtattcctccagcctgagtgttctgcagggaaatgtgctgtgtaaacactatgcctatttcctgcttggagaacaggttttgtggtagagctctcaggggtggggaagaagcctggcagcccacatgctataaatgctgttgtccacctttatgctctaacttggaggcagagacccaagcagctggaggctctgtgtgtgggtgagtttagccacatcccctaggtgttctccagcttgaggatcgcaggcagagaggaccagcccagcagccacaggcctgaccaaggcccaggttgggaaggagggcaactccccattttccactgggaggtgtttcacagcatggtcaacatggatgacctacaaagaccctcatgctttgatatcttccttggccagatccatccctaccagggactcagcagggcctaagcagggggagtgggagaacagaccccaagaggaaggaagacctcatcactgactgtgagagggtcatcaccccccgatgatcaccttgaagggtccaggctgtgggccctattcatctcttttcattctcaggtcgctgatttcttggagcctgaaaagaaggtaactgggcatatgagggacagatggagtgagtcagtgagtgagtgacctcatccttcctcctaacagcctgggagggacagggcaggttttctgcagagcatggaagattcagctgaaatcagagaggtgaagccagtttcccagggtaacatagtgaggcactgaaagaaaggagactgcactggagcccaggtccctgggctccccagagctccttactcttcctcctcctcagcagccttgagaccccacaacctccagccggaggcctgaagcatgaggccatgccaggtgccagatgatgcttggaattttcccgggtgcttcgggtcttcccagcactctggtctcgcccgccctgcctctcgggctctgcccagcttcctgagtcctgacagagcacagtgggggagatgttggcagaggtggcagatgggctcacggccatccctccagcaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggtactgtgctgcagaccccaccctcagctgagggacacagaccccttttcaggaggcccatctgtccaggcccctaggctgtgggccatagtgagctgggggctatagtaagctgggtgggacttcagtctgcagggctggtgggttcctggggcccttatgatggcgcatcctggagagtctgtcctcatagtgcccacggagtgatagagtgatagctgagccagccctggtgataatgggcatcgagtctcactagctccaaccagttgtgggtgacagatcctacacatccatgtctcttttctctgcaggccccatgggtccacctggagaaatgccatgtcctcctggaaatgatgggctgcctggagcccctggtatccctggagagtgtggagagaagggggagcctggcgagaggggccctccaggtgagcagggtggggcaggtgggcagtggaaacatgggcacagcgaccctgaagtcagttacacggggatgatggggatcagacaaaccctacaggttccccaagggcatttggctcaacctaagtaagagaggataagcttgagggagaaagctgaggtgtctggggagtgtggtcacaattcagggaaaggcaggtgtgggaagtcctccgtgcctcatgaccaccgatggggacacactgagtcaggtgtgggatgagggacagcactgggaggcaggggaggcatgtcctgggatggaggccctgggggcagtctgaagggtgaatgcggacgaggcatccaggcagatggtgtgatcaggagccccacagacagaggggaactttgaagctcagagcggtaagcaagtccatcagggcagtgcagagagcatcatgcttgcccttggtggagggtgcgggagagggacttgccccacagaggcgggcagacagaacccctcgagggacagagcaggaaagaggacaaggggtgggggtctcagcaggggcaaggcttcactaaagaataggggaccacggggtgtggagacacactggaatctcgtggaccctctgagcctagggtctgggtggtgcctaacagcaatgaaagggcagagttccaggattgcagatggcaaaacgcctgcgtggcagcaagtgggagtcttcactggcctgcccctccttctgtgtggggcactctccacagggcttccagctcatctagatgaggagctccaagccacactccacgactttagacatcaaatcctgcagacaaggggaggtaaggggaccccctgggcctcacggggtaggagtttcccacaaattcccctcattctcagcaccagcttctagaacatagagattacaaataggcatgcacatgcaggtgttggggaaaggaatgatgcttgcttttctgatgtctttgaatggcccagaggagacaagcagacacaattcactccccatttcataggaaagcaagttctccacctgccttgctttccactgaattctaggaaattgcaccatttctggcaataagtaattgttacttaggtgaatgaataaatggaggagagtctaaaagtgaatttagaaaactgcaattggaagaggaagagaagacacagagagaggcagagatggagagactggggagaatctggtagcagagaccccaggtgagggaggtggcttagagacaaagtggtcagtggcctgacctggactcctctgctctcagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataataaatcgttagtgtgttcacatgagtttccatagctttggttccaagaaacatcacatttctgtttttgtaaatgaaatgaactctggctctgagcccccactttcctcaagattggaaaattcaatctcaggatgtgctttctttgtttgatgggaggggcaacctgctctcctcgctatgatgctgctggaggttggggagctacagacaccatttggaagaacacatgggcatcttgaatccatgtggtgcatttgtgggtggggatataatgccttccgtcctctgcgcagccacctgaatgatttctgcagcccagcagtgatgttggcactcagggctcagttccaggcctcagtgagccatcctagtctcatgtcggcttgaaatgggaccactgccccataccccagggctgtgcaggattgagacaatgtccccaattgcttgaggaggcagccacgtatgtgtcccacctccagaaaggctcccactactcccaccctcacacctgcgaacactctctctcgtggatttactgcttttcttgggcagaggcaagctctggatcaagacccacaaaatcagatgagaatgaggggaataatttctgattcttttctgaatgataatttttaatctggtcaccattccacatgtgcttgggacccagcacacacattattgagccttcccgtaaattaagagaaaaacaaggagaagcatgtacaaatgttccttgacttatgatgtggttaggtcctgataaacacattgcaaaatgatatcttaaatggaaaatgcatttaatacatctaacctaccaaacatcatagctgagcctagactactttaaccatgcccagaaccctatgttagcctgcagttaggcaaaactatctaacacaaggtctattttataatagggtgctgactatctcatggaatttattggctactgtactggaggtgaatgaatggttgtatgtgtacctgaagtgtggcttctcctgaattcacatcgcttttggaccaatgtgaagtctataaattttaagtcaagcctccataaatccaggaccgtgtgtattccgaacttcataagtaaataagactctgaaaatttatgtcttctcatttcttgggaggattatttttactttctttatgcatttatttgctattgttactattttatcatattttaaattaactattgctggtttatgagaaaaactcttgatttattttttattcatcttatacccaaccatctttttggattctcatttttttcctaatattaatacttctaagataattgattcttttatttttttatttctatttttgagacagagtctctctttgttgcctgggctagagtgcagtggcacaatcttggctcactggaacctctgcctcccgggttcaagtgattttcttgcctcagcctcccaagtagctgggattacaggtgtgcaccaccacgcctggctaatttttgtatttttagcagagacagggtttcaccctgttggcctggctggtcttgaactgaccttaagtgatcctcctgcctcggcctcccaaagtgcagggattacaggcataagccaccttgcccagccagtgattcttttatattttatagataaatagttatatttatgaaggatggaaatttgatctgtccttttatgacatttatattttttccatctcatttcttagctccaccccaggagctcagttaaggagggaggagaaaggactgagccgggcaccccttccctcctcccatcttgggcctgggatgtgaatgcacactga

SEQ ID NO: 14931 - DNA, 11643 bp, Human
ccaacctcaggtgatcagccagcctcggcctcccaaagtgctgggattacaggcgtgagccaccgtgcccgaccaattttttttttttttttttgagacggagtctcattctgtcacccaggctggagtgcagtggcgtgatctcggctcactgcaagctctgcctcctgagttcacgccattctcctgcctcagcctcccatgtagctgggactacaggcgcctgccaccatgcccggctaatttttttgtatttttagtagagacggggtttcaccatgttagccaggatggtctcaatctcctgacctcaggtgatccacctgccttggcctcccttttgtgtatttttaaaagagacggggtttcgccatgttaggcaagctggtcttgaactcctgacctcaggtgatctgcctgcctcgggctcccaaagtgctgggatgggattacaggcgtgagccaccgtgcccggccttttttttttttttttttttttttctagagacagactctccctctgttgccctggtgcaatcatagcttactgcagcctcgacctcctgggctcaagcaatcctcccacctcagcctccccagtagctaagaccacaggcatacaacaccatgccttgctaatttttttttttttttttttttttttggtataagcagggtattgctgttgcccaggctggcctggaactcctgcacctggcctcaagcgatcctcttgccttggcctcccaaatggctgggatgggattctaggcgtgacacaccgcagctggctgccttttttgttgttgttgagacaaggtcttgctctgttgcccagggcggaatgcagtggtgcaaacatggctcactgtggcctcgacttcctgtgctcaggtgatcctcctgcctcagcctcctaggtagctgggaccaccaaatgcacaggtgtgcactaccatacccagctaatttctaatttttttttgtagagacatggtctcactttgttgcccaggctggtcttgaactcctgggctcaagcaatcctcccacctcagccttccaaagtgttgggattacaggcgtgagccactgggcccagcctctattgagttttaatctccgtttacttgactatcaccttcaggatttcaaacatccagagaccaccaaggtgcatggtgcacaggtctaaattgcaggttgaatctcaatctagtattagtattccccaatgcgactacagaactgattattactatttattttttttgagatggagtcttgcactgtcaccagggctggagtgcaatggcgcaatcctggtttactgcaacctccacctcccaggttcaagggattctcctgcctcagccttccaactagctgggattacaggcgcccgccaccacacccagctaattttttgtatttttagtagagacggggtttcaccatgttagccagaatggtctcgatctcttgacctcgtgatctgcctgcctcagcctcccaaggtgctgggattataggcgtgagccaccgcgcctggcccagaactgatgattaacccagctgagcctctgttcatctgaatgggtattgtcaacagcactcacttacaagagttgctgagaagatccaatgagacaaatagttgctaaagtgccaggcatgcagcagtgcttaagaaacttctcaccctgggttttttattggtattgattgatgtagaggtgggggagaagatcaaagacaaggattgagaatcagggatgggaaaagcagtgggccactgacagccgccctgcctgcctgggaggtggggtggggaaagtgggcgggacatgctcctgggcctggcccacccagatcacccctacaggctgtcggcctgtgcgtctgcatccggtggccacagagcaacttcctctagagggagctgattggagccgggtgccgctggcacctctatgatcactggagtctcgcgggtccctcgggctgcacagggacaagtaaaggctacatccagatgccgggaatgcactgacgcccattcctggaaactgggctcccactcagcccctgggagcagcagccgccagcccctcgggacctccatctccaccctgctgagccacccgggttgggccaggatcccggcaggtaagctggaagggtcttgtccatcctcccagatctcagcagccccagccccagggtggggcagggagcctgccgggagccgggtggggaaggggaagctcaaggcttccctgggcaggtctgccgccccggctggggacctgatcctgccatgcctgcctctggctgcccctcacagcttcccctcttggcccagccctggatgccggagaactgtaagaactgggtcctttaacagtctgggagatgggagtggaggtcagagccaaggtcaagggcagagagagaactttctcagcgcttgctgctgcccaacatccctagactgggtccagggcctggccaggcatgtatccctgggcaacattcatcggggcccagcaagcccaggaagtcgggggtggctcccctcaccgggaatttaggccacttggatgggggaggcagagctaggcctgagtcagcataggttgctggccttggtgggtgttctgaggctctacctgctcccctcggaagcctggggtgttggtagagggagttggaggtgcagtcagcatcctccagccctactgtcctgggggtgccgggtcctggagactggggaagaaggaaggccatcttatgtaaggagctacggggggtgggaggcaagcaaaactctttttttttgttttttgaaatggagtctcgctctgttgcccaggctggagtgcagtggcgcaatctcggctgaccgcaacctccgcctccaaggttcaagcgattctcctgcctcagcctcccgagtagctgggactacaggcgcacgccaccatgcccagctaatttttgtatttttagtagagatggggtttcattatgttggccaggctggtcttgaacttctgacctcgtgggccactatgcccggctgcaaagttctgttttaacaaggccttgcccctagaggtggaggagaggagggtctgccttcaccctgtccctgtccggcagatcgaggaggagtggggagctgggtgagggcacaggtggtccagccctcctccaccccttcttgagagctcttggggcactttcgaaaacactcccaggcctagcggaaggagggtgggcgaaggtccccaggccctgggcggtgggggtggggctgtgtgcttggcccagggtggggctgcacaccccctccctctgggataggaggagggcgctctccttctgagggctggaggctgcctggggaaatggggctctgggaggggtgcaaactgaaagtgaaacagctgacatccaggaaacactcgccctgatgaggggtcacagcaggttggggctgcggtcaggaccaggcaaagaggaaaattggggccggggacagaagaccaggtgtgtggtgggagtacgaggcaggttatggggcttcaaagaaggccctgatcctgagggctccctccggtcactgcaaggcagcagtggggaaggcacagacaggaggtaaatagggaaagttgccctgagaaagaacacactctgaggtccacaaactggaaaagaaatcttgcatgcgtgttgagtacatggactcacggagattcagacaaacaacctgactttccgtgactaacgatgtgacctcgggcactcaactctttgtgcctcacttttcctgcctgtaaagtgggtatgatggcgctcaccctgctgggttcatgtgagtttccagtgttcaccacccacagagtgctcctaagtgggagagtatatcttaggctctcaggaaatgtttgcggctaacagcccagagttaaaaaacaggtgtgttctggccagccagagggaagtagggcctctgaggacagccttcatgggccattggctgggcagtggctcgcttgcaataagcatgtgctgggtgggctgcaggaggccccaggaacagctaaaaaccccccaggctcttgccccaggagtggcatgaacttgagagccagcgggcactgctgcagccacaccctcctcgatggtgcagatacctcagtctgcccttggctgcctcaccttcttaccctgtctccctcaaagagggagtgttcagtaagttgtttcctcccagcagacttcactgggacccatgctggagtaagaataaaaagtcccagaggaggccaggcacggtggctcacacctgtaatcccagcactgtggatggccgaggcagactcacgaggtcaggagtttgagaccggcctggccaaagtcccagaggactaagggcctttctgggaatgggggatcctctctcctatgtggacatggcaacctgtatggggtccccagtcacaggtctgtgctcacccccatctctgctttttctcgcccttccccgcaggctgatcccgtcctccactgagacctgaaaaatggcttcggggcaaggcccaggtcctcccaggcaggagtgcggagagcctgccctgccctctgcttctggtaagggtcttcctgccccctcacccatcccataaccatgagtgctgtcgtgaggatggaaggagcaggactcaggcaggctccttcgcctcggttcacccactgtggctggggaatactcttccccacccacgggctcagaggctggagctgctgtcaaggttaagcccaggagggggaggagtctggactggggagggcctggaggttgggagaggccaggaagtgagtgtaaggtaggcacagtgccaccggggcagagggctgggtcacgggcgagggaggcaggaattagagtggggcctggctgctgtatccctccagcgggagaaataaggaagtaagctggccaatcacccagtcaggtctgctcaacagggaacgcaattattgtgacttggggaggaagtaagatggctgccctccttccctcttcccaggggatagccagggaagccccagctcacacctcacggcgggctgttccctggacttgggaatcaggtcccaggtctgtcactatctccctgtgtgacttttctgggccgcagctacaaattcagattttgtttcccacatttccctgcacgcaaagggctgcggagctgagatgtactaatgtagactcaggaccccaaatgcccgggactgtcccggttccccggcttgttctggctgtatgaccttgcacacgttactcagacaccctgtgccattttccccctgccagctggggattgcctgctcccagggctactgtgaggactcaatgcaagtgccggaacaactctccacacagcataagctctaggggcggctaaggtgctgaagtagggatatttcttttcttttttttttttttgttttttttgttgttgttgttttgttttgttttgttttttgagatggagtctcgctctattgcccaggctggagtgcagtggcgtgatctaggctcactgcaagctccaactcccgggttcacgccattctcctgcctcagcctcccgagtagctgggactacaggcgcctcccaccacgcctggctaattttttgtattttgtttagtagagacggggtttcaccatgttagccaggatggtctcaatctcctgacctcgtgatccgcccgccttggcctcccaaagtgctgggattacaggcatgagccaccacacccggccattttttttttttttttgagacagagtttcgctcttgttgcctaggctggagtgcagtggcacgatctccgctcaccgcaacctccgcctcccggggtcaagtaattctcctgcctcagcctcttcttgagtaggtgggattacaggcatgtgccaccacacccggctaattttgtatttttagtagagacagagtttctccatgttggtcaggctggtcttgaactcccgacctcaggtgatctgcccacctcggcctcccaaagtgctgggattataggcgtgagccaccgcacctggttgggatatttctttccatgggtgaggacagctatggccttaggaagagtgaatcccctataaggcatggggctgccagggttcggccctctctccctgactcccagctttgatcctcagaggagcaggtagcccaggacacagaggaggttttccgcagctacgttttttaccgccatcagcaggaacaggaggctgaaggggtggctgcccctgccgacccagagatggtcaccttacctctgcaacctagcaggtgagctacaaccgctgggcccacaaggacatcttcagggaggcagtagctcgcatgggtctctgtgcaggtcctgggagctggggaggcctcgggggtcttgcccttctctcatggttgctcctcttttatgttgggctcccacccccatccaggaccttgtatcctttttagcccatgcctgccccttctcctggagcccagcactcatgtcttagaacactgtcagggacctccaagaagggatgcacagggccatggacagctcaggcagaacccctctgccatgagccagggcctggtcccgactgcctggttactggctcacctgcatgcctcctgctcctacagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccaggtaccccagccacctccctgccagctccagtcactcctctgtcatgtcacaaccataccataccctgcctgcatgatgctctcctggcatggggagaagccttctgtcagtgtccaatgtctgctgtgaactcacatgtggtctcggccccctatttttctctttcggggtcccagacttgtattttgggcattagctcacagctcttttgagctctgactccaaggtcttgactggttagatcaggactctagagggggcctgaggtggggacgtcccccacagctccccagcccagctgggacatagctgtccttcatagttccaatttgaaaccacatatcacactgaagatggtgagggtgctaacctctgccaggtcctagaaatggctcctacttgctataatctggcatccaagtggttaaagacaccgaatatttgggtgcaaatccaagctttgccacttactgccttcgtgaagcttcctagcccttagtctcctggtttgtaaaatagggaaaatatgcttagattagtgtccaccttacaaagtgttagccattgctaccaccagagttagggaagtcagtgtcggagtagatttgaaactggaggtgaaggtaggagtaagtgatagattttagaattagtgctcagagctgaaatatccagtccgtgaacttagaggccagccttcataccactgtgatgacaggaactaccctaatcttttctgtccttttctctctgctgtccctcgggctgccaggccagcagcaacacccacaggtaatctccccgctgactccatccacttgctctgccctctgccctctctgtgccccgttgcacctgagcgtacaccccagcagtggcatccagctcatctgcccctgagctttctcctttcgcagagacccaggttgttcccaaatacaggccaggttggggcagcctctgcggccttaattcacagctaagctatttagcttccagctgggagaggggtgggagaggccaggcaggctgaagggcttcctgggggctctccaccaatgctatgggatgctctgcccacagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtgagtatccaaggactgcaatgtcctccctgctgttggggctgcccctctcccaggccccaccccttcctcgggttcctatatcttctgctagcctctctgtgaccaccttgtttctcccggcaggtggcagccctgaacttgggcaatggtcccatcctgaacgtgctggtggttctgggtgtggttctgttgggccagtttgtggtacgaagattcttcaaatcatgactcccaagggtgccctttggggtcccggttcagacccctgcctggacttaagcgaagtctttgccttctctgctcccttgcaggggtcccccctcaagagtacagaagctttagcaagtgtgcactccagcttcggagggcccctgcgtgggggccagtcaggctgcagaggcacctcaacattgcatggtgctagtgggccctctctctgggcccaggggctgtggccgtctcctccctcagctctctgggacctccttagccctgtctgctaggcgctggggagactgataacttggggaggcaagagactgggagccacttctccccagaaagtgtttaacggttttagctttttataatacccttgtgagagcccattcccaccattctacctgaggccaggacgtctggggtgtggggattggtgggtctatgttccccaggattcagctattctggaagatcagcaccctaagagatgggactaggacctgagcctggtcctggccgtccctaagcatgtgtcccaggagcaggacctactaggagaggggggccaaggtcctgctcaactctacccctgctcccattcctccctccggccatactgcctttgcagttggactctcagggattctgggcttggggtgtggggtggggtggagtcgcagaccagagctgtctgaactcacgtgtcagaagcctccaagcctgcctcccaaggtcctctcagttctctcccttcctctctccttatagacacttgctcccaacccattcactacaggtgaaggctctcacccccatccctgggggccttgggtgagtggcctgctaaggctcctccttgcccagactacagggcttaggacttggtttgttatttcagggaaaaggagtagggagttcatctggagggttctaagtgggagaaggactatcaacaccactaggaatcccagaggtgggatcctccctcatggctctggcacagtgtaatccaggggtgtagatgggggaactgtgaatacttgaactctgttcccccaccctccatgctcctcacctgtctaggtctcctcagggtggggggtgacagtgccttctctattgggcacagcctagggtcttgggggtcaggggggagaagttcttgattcagccaaatgcagggaggggaggcagatggagcccataggccaccccctatcctctgagtgtttggaaataaactgtgcaatcccctcaccctgacttagtttttgtattctctgctacccctctttccatcaggccagactgtgggaacctgggcacgcctggcatacatctggcttattactgaataaaacctcacactaggcctccagaatcccatagaggcctgagtatggttctgcagcccccactccgatggaaggcgttcgcccctccccatgaacttctctcatctcgttgggtttcatgcagtttccaccctttaggaagtctgggaggtcctttagctacagagctggtggagcagctgcacatatctgaggacccccacaggctacctctgacctgggctgaattcttctcccaccctggggctaccacccacgctggtccaaaaggcccttctcccccacatttagctctgcctgggacacaatgtcccagctcccccttcctgatgtctccacagtcagcacacacgcagggctttcattctagttttatgctgcttgggagtccctatgggtacccagccaggggtgataaaaataacaagcatgggggcgtttaaatgttccaaaatctacagtctttccagtcctgggcaccctggtctgtgtttctgacgcccttccaaaagggtcacatgcaagtccaagagaactcgtgagtttcaccttcaccctcctggggtgggcttgccaagccccttttccctccacaaggtcttcagagtctagtacagacgcgatcttggaaaagggaaaaggcggcgctgcaggcagtggtggctggaaggtggttgctacaaggcaccccgcagtgtacaggaaaagctcacagacaacatttatagaacacatactgtgtgccaggctttatgctgagagttcatcatctgcccaaataataggtaggagacgggggtgggggtactcaaactactatttacagataaggaaacgggtgctttctcagagtcacccaaggagtgaggacttgccaccaggaaactggctcgagttttacgtggaggccggagagcaatgtggggctcgcgagcacaggtttaagaggcccagagtgcggggtcgcctccctcccggagcgatgccatagaggttagaagtgggcggctgcccgagtccaagatggccgccgccgcgagcacgcaagcgtgcccttccttgggcggggcctttggggcgcacccactccagcctctgggctttgaacagcatgcggcattgagcggcgaacagatcgttgcatcgctggaagaaaggcgggtgggctgtggttagcctactcgtctaaggagctgcaacgctaaccggaaaggcatgggtggggcagcccaaaaagttttggcctgcaccgccccccaacgccctctattccgctgccaggatattctgaaaccagggggcgagaagttaggtcggacacagtcagccaggggctgcgaggataacgggagtgtaggggctctgtgggtattagggaagagaaaccaaaaaaactcatttctactcaaactgtgcgctgcttctgagattgtggcttggtttccaccaaatacgtctgggttcgtcacagtctgtgatgtcactgagctggggcagcccggccagggaaaggagcggtgtgcagctgtcacctgcttagttctgcagtttcagtatgaatacccgcccttccttgcacacaacagcctcacattctccccacccccaccctgccgttttaccttcacgtatttatttttacctcctctgaagagtatattttagagagtcaccgagtgtccatccaaaccctttcatttgaaaaaatccttccttagcctaaaatcactcagtatattgaacaagttattatgacatagtcacctgaatgcattaaaataaatttacatgtattcattaaacttaaaccaccatatccactagttttttttgtttttgttttgttttttcacccgtgacaaaaatgtacccctcctgctccagttgtatgcacttcagatgt

SEQ ID NO: 14932 - DNA, 38805 bp, Human
agcctgacagaattgtgattacacttaaaatatcatataactgccacatcatcaacagagtccatccttggagatgttttcccaattggagggatggacttgtgctaattcacttaaactctttcccattttagtgtttcatttttgagacagggtctcgctttgttgcccaggctgtagtgtagtgacacaatcacagctaactgcagcctctaccttccgggctcaaatgatcctcccacctcagcctccccagtagctgggaccgcaggcacatgccaccatgtccagctactttttgtattttttgtagagaaggggtcttgccatgttgcccaggctggtcttgaacccgtggactcaagctatctgcctgcctcccaaagtgctgagataatgagagtgaaccactgtgcctgggctttttctcattttaatgtatagcattatatattgatgtatagctctgaagagatcattgcagtcccctatagaggaatgaatcaatattcaccctcatcactcatgtctcagcactaagaaacacaaataggcatttctatttctaaaagatactttaaaaatatggtttctttctgctactgaagtttcctaaaaatcaaaaagaaaatagtttcattttatctttacaatcttttgaacactagagatatcaatcagatatatccatttacaaatgaataatagctaggttactctaagaaatatatgtatgtgtatattcgtttaatcctcagcatcacctgatgagttaagtgtttttgttgccagtattttattgccgtggctatcaaagcacatagaggttaaccaacttgagtgaggtaagagttgcgcattgaagaaaatacaggtcagggtattagtgaaagtctccagcaaagttcccagggttcataggttctatttattctgctctgtatgccacaggttattccttatttcttaaaagatcttttcctcagggctttcataacatcccgttcctttcttgcagcttcattatatctttattgtgcagacacattgacttgagtatgtaaaacctaacagtgcctattgttgcactaaaaaatgccttgctattaaagcatgaggcaaaagcctaacttagctgtttcctgaagtaaatccatatttatacagaaaaaccccttaacttcctctaaaacaaaaggcatatactctacatagacatatatttgagacattaaagaaacatcaatttccattttaaaaaaacgtttaacttagtatcctctgtcaaatttctggtgcctacgaaaaaactgtaaaaaaaatagcttttgaaatattactcattttaagtgagtcacgccctaaaagaatttacttgggagtcaaagctagttgaccctaacatctcagaaataaaactccaatttgtttatccatttaacctaccatgagtctgtgatttggcaacttgtgaaaagcaacaacaaaaaaacccactaaaatataactggtcactggaaaccctctttctggtctgtactatctaaatgccagctgtcatgtcaggcaaaaagtaatttgtagagcagccttgtggtccactgtattatgtaggaaagacaatgtactggaagagcgaggactcaatcatttcgtgtctactactgagaaactaaattctgtagagaacatgaggctaaacggaggctctggtcagctcaataaagatacgttggaagaatcaatggggagtttacacaagagtaaaatgaagagttccaagctctctcattgctaaccgtacactctccatggctgttgcaagtggttttgcaggtcatccaagcactaatcttttcttagcccgaacacatttaaagagggaaggggcagagatcattcacactgtgaatgtttctctctgaacttcctgaagtcaactgggcggaggccctaccggttcaggcacctgcaatttccgcctttctccttccccttcttccgggctcccgtcccggctcatcacccggcctgtggcccactcccaccgccagctggaaccctggggactacgacgtccctcaaaccttgcttctaggagataaaaaggtaatgatcgtcatgtgcagtatgaggtcttcacgtgaaagctttatttgggtaggaaaacctagcctacgagaaacgggtccgtgcggtcacgcctgactgcctgtctccgggtcaaggctgccaggaccagctccagccctccgcccgagaaggctgtcctttcccctcggaactctggcttccctaaagcggccgcgcctccttccaggcctcacctcctgccggctccgcccggcccggcccacctcgcccccacctcggcgcccacccattgtcccctcgcgcagtcaccgagcgcagatcccgcgctctcgattggaacgcctccccatcactcagccacactcaggggctggacgcctcactcccgtttccgagccataaaaggtctaggaccgcttcccccgagccagcaggtaaagccgcggcggcgggagggaggccgggaggggccgcgcgccccggtcggcccagccggggaaggggagcggcgggcggggcggggggcagcgcaccacacacaaccctcccttgccgtgcgaccgcgccctgcccccgccccggggcccccgccccgcaagtcctgatcacaatgccggagccgccgagccacccttgtcatcctgcccggggacggccctggggcagttactaccgcgaagcacggagggtggggcgggccgggcctcggggaggggtggggggatgtgaaaggtcccggatgttgctgaacgggagccccttccagagggagtgactggggcaagcgcagacgggctgagcgaaagctaaggtgggggtagggagagaacgccttcccgccggctgagaggaagagtgggccggcagaggctgcaggggagagggagagagagggcgttggggacccaaagggaaggcgaggagtgggggatttgcgttggggaggaaaaggaaaaaagcagcctcctgccctaggtgcactcgggacaagcgtagaggagctggaagccgagcggggtgggaggagtggcggctgcgggcgaggacgcgcgcgcctccgctcgccctccagcgcgggcgggcaggacgagcgccggggagcggcggttacgcggggccccgatcgctgtgggcaccaatcaacggttgccatagcagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacaggtgaggaacccggccgccgccgcgcctcgcttcctgtcccaggccagccttccgaacgcgtgggagccgtcctcgctccgtcccctcatccccactcgccccgcggtggcggcgccgggctgaggcggagtctcctcagcggacacgggcggcggctcctcttccgctgggctcgggagggcggctagcggccgcctccggctccttgcttccgcatcgacgccccggcgccgatcggtgctcgctcccccgtcctgcccccgggggtgggtagggcgcccacacgcgagatccctggggatctccctgtcgccggctcccgaaggtggacgaggcatggccggggcgccgccggccgcgatccatccccacccttgtctctgcgggcttccaccccctccctcgccgcccttctcgcttccgcccgagataatgactcggcggcggcggcggcgggcatcgcagtggcgcaggtgaggccgccccctcccctctccctcggccgccccctcctttccctccccctcgcgcagcctccgcgctgggcgctgcggcggcgggacccggccctcccccaccccgggaggcggtggcgcggcggggaggggccgggggcctcggggacccaagcgcgagggaaaggcctggccgagagcgggccggagcccaggcctggcgcggcggcgcccgccaggtagaccggggcgaggctgcgcgccggcgggaggggagtccactgcggggtgaggttttggggtggggctcgcctgggacctagagctgaatttcctgggctccgcggtgggaggaaggacttgaattttcctggtgggggtgggggatgggtctgactttttttgctccttgtgaacgggcgggggaggtgtggacgggggctgcaagtccaggtcggggtagagaacagggtggtgagcccgcagtcggctcccgtgcttgatggactagaactggagggtccctgcgctcggtttggggacgcatatcctgctttgggggcgggtgagcctgagcatagccgctggtggcccgctcggctgggtgtggctctcgtcccctcccccacctgcagctgtcggtcccttagagacgctgtacacggtcaccggcgctgatcggtggcggggaaggcgctgggtgggagagcggggtgtgtccgcggcggggctggtagtggttccgcttctgcgggctgctgtggcgtctctgccccggggtcgggcggcttcgctccccacctcccccccccccccaacggcttgggcgggggcgcgggctgctcctccctctggctccggtcggggggaggaattaacactctgcagtaggttgggctccctgacacagatccgccatgacaaaggaggagagtcggggacttgagccgtggctccgacttgggcggagcctggaggggggtggttgcgatacgcggaccggagaatttgcactttaaagtccgggtctgcccgttttcgtttcacagtaaccgacgtctcaagtcaggtaagggttaaatgggtgcggtgagtcctgcccgcagtgtagaggcgaggccttggagcactcgttactgtgtgagaaaccttatccacttcctcttgtaccgaagtgattggggagagaatcctttgtactggcttaaatcattttttgttagaagcagaaataaccagagagcgtttctgagatcctaagggaaaaatcagtaatttagagacctgacgaaaataatgccgtcataaaggttaaatagtttacgtattgagccagtaccttgcatccaaagtggttaattatttgtttaaaatgtggcgacctgttctctcatttggttaaaaaaatattgtgggatttccctgggaaggtaaaagatgattaatattcgggagccagctgccaaggtggactcttctgttcaccttctaacttaaaagtgcacttcattcagggtgtgtattttcctctgaagtcatttattctgtggtgtcactgtgtggattagtatctttgtgctgttcggcaacttgcaaaagggtatctttccagaaaaatgtagctgaggtaaatcgaaaaggtccaggaaactaaaatgcgagggaaagagaattagatgggtagtcatggtaaaggacagcttgagtggtaacatccaattacattatgatggctagaagcaaaatgcagcacttctgcatttcaactggagcgatgacattggaaacacttgtaaattaagtacttccaatgtgatatattctagtactcacagtaagagttgaagtgtcatgacttgcggatatttttaaagcatgtggacatataacaagataaagagttgagacattagggtcagatattgatcctttgtggtggatttatactcaaaatatctgaaaacaaacagttggtcattcccccccaaattgttatgctattattggctggcagttgttgcagagatctagtaggtttggggtaggggtaacactaaagctaaaatgtaatcactcttgacaagagtattatgaaagtaaaaagacgtgagttacattaaactgatatgaattatgattctggaaatatgatagaaatccagatgttctctgtaaacaatgcttttactaaaggaagaaaagctgcttaattttggatcacttagtggtattggaaatgagttgagattttgatcaggtaagattaggggtagtttttgaggcagcttttggaagtaattttgacatgtgaaatttgggtcttctgaacaaattttaagttttgctacactgatgtgttaatggctgtaagtttacctctgatgctgagtatgctaaatttttttcccttttttgactatccttttgtgaggctgcattttaattcctcatgtgaacagtctttcacaggcagttaggtttcaggtttaaaaaactcatttaccacaggtataattttgagtctgtttattttgatgggaaaaattttaaatactccttttttcccccctgcagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactggtgagaatcaattcagtctggcttcattatactgtagggtccctatgagtatcagttacattactcttaactttttgtttggtttttcttttccttctaaacattgtgtgttccaaatttaaaagtcttcatggtgtcatgactaaaaagatgttaagacaattatagatacgtgtatgtaaaataattgcaacaatgattatgaaacagttcagttttgttaaaaataacagactttagtattgtattttatattaattgaaaatataaactaattgtgttactgttttacttatggttagaatatttgtagtagctctatagctggttatcttaaatgtacatctgtggataaaggaattttacatactttaggtaagagagatgtaataggatactcattgtagaaatagtactcttctcaggattagccgctataatgttaatgtaatgagtcaaccatgcagaaaactctggcgtcacaactatgaaacctcttcctgcattgaattcttgaaggtaaattttgaacactcacaaccatgatgaaaggttatgaacaactcaagcttgattttccagtttgaatcgagtattttaagtattcagtacttactgtgttgaagcactgcgcttaaaagaattaaactacattttggttaattttaatctgtcatataaagtagggctttttgatcaagaatagtttaaatttgaggataaaccagtagagaatccaaccaagctggcagtttttggaataatatttaaagtggttttactaaatggttacacttaaccagtatggaagggctctgatatacaaagaggggcagcatctcgatttttctggacagattactgaatctggaactcagtatggaaatccaggtttgttacttactatatgaaccttgtttatggaagaagtgctataatgagcaataggataatgtctgatgtggttgtgggtttggggtttttgttaaagttgtgatgatactatcatttctttacatttgtatttactaatggaatagcatcagttcctaaactgtaattttctcaaatgatacttacttgacactgtctttttaaagaatagtgattttttaaacatgcttatttgggttcacagccacaaactcaatgaggcatctgtcttggggcatttttttgttctttgcttattgaaacctttagaatgatagctactatttgtatctaagttgaaaaaaggaatatcttgcttttattggggccaagtgacaaatgtctgttttgtgattttgctaaggtaataagaatatttaaattttgttttttgtttttttttttttttgagacggagtcttgctctgttgcccaggctggagtgcagtggcgcgatctcggctcactgcaagctccgcctcccgggttcacgccattctcctgcctcagcctcccgaatagctgagactacaggcgcctgccactgcgcccggctaatttttttgtatttttagtagagacggggtttcaccatgttagccaggatggtctcgatctcctgacctcgtgatccgccctcctcagcctcccaaagtgctgggattacaggcttgagccaccgcgcccggccaaatatttaaattttgaaaatgtgattttttttttctataataaaaaatgtattgggtttttttgttttttttgttttttttttttgctcaccttactaactaatatctgtgtatgtgtaattcagttttgttcagtctggagtgtttttcccaattattacacctgatcgaaaagtttttattttggcttcaaagggtgtgttacacattaacatttcccttaagacaaaagtcaattttaggaataaaaaggaatgtaacatttaccttttactaacacgcttatttgcaataccaggtaggtatgtgcatgttttccatatacaaagtataaaagttcctgtcattgtgagtcttttccaaggaaaagacttgtagcaggtttgttttttgtgtatgtttgtttgtttgtttgttttgagactgagttttgctcttgtcacccaggctggagtgcaatggcaccatctcagctcactgcaacttccgcctcccgtgttcaagcaattcttctgccttgacctcccgagtagctgggattactgggcgtgcaccagcacgcccagctaatttttgtacttttagtaaagatggggtttcaccttgtcggccaggctggtgaccaggtcaggtctaactcttgacctcaggtgatccactcgccttggcctcccaaagtgctgggattacaggagtgagccaccacgtccagcccaacttgtagcagttttgactatgcttccctttagtttccttatgaagaaaatttgtttgcatagaaccagtagatgaggataacaagataatctcttcatataaatagtttcttcttgttatgattattaaggaagttcactctggtccctacccacatcgttaccctccagaatagcactggcttcccaaaaagttttaatggtatttacactttgaaagtttggataaatgagagtttaatttctttactatacaaatggctttgaagagaattctaaacaagcttttgcttccagccttggtcttttcaggagtaagacttagtgatctttgcatactcaacgtgtaatagatgctcaaatatttgttaaacaagcagaaaggcttctttagagaaagagcatagaattaggtcagcagcactgcaaaatttccctagctttttctttttctgcttgggaaaatttgatatttaccgataataggcttctttttcctaccatctttttcaaataggtcacatcgactctggaaacatattgcataaaattccttctgccctttctgtgagatggaagaataaaatgtagcagaactgatatttctactagaaaaagttattgaatcattattaatgattagtaaaaatattttaaattatatttttaagatcttacatgataaaaaatcaattataattttttattactccagccttttctgggctttgatatatatattttttaatttgagaaaaataagcaggtgtccctttgcagaaataatagtattggcttgtggcattagtgataaccagattttttatattgagcacctattttataatagctatgaaaataaactttcttcctacaaaaagcagctaatctccaaagttctgagtttttctgaagagctctttagtaacccattctggttatatgtatttatctattgtttaaccatttaataagcaaagagcttggaccatgttgcatattacaagagtaaatagagcattatggcgggaagtggtcactggcatgctcttcacaatgtggactttgcattatgtaaaagaacttgggtttcttctcttccacgtgttaatttcaaactgcaatatgtgaactaatgcaatctgcctttcctgccagatgcttagacaaaagctctcttggtagttggggagggactcaacactagtacctctttaaacctgaaagatggcagccaaaaattgggtagtttttatcttgcacatgatgaaatgaataccaaggaaatacagtctaggaagcctctttcaaactcaaagaagtatgtcgaggtgaataatggagctcaagatactgagtcaaactagttttaccatttaatagatgcatggcctgaggaaatcactcagtccctctgagaaaactaagctcaattaaataggaataatactcatcccacagggttgtggggaatgagagtcaggtaaagcaccttgactaccttctgtgtcctgtttatcttagcttttcagttctatttaaaagtgtgagcctgcctataatagtgcaggggtctcttaacttacagtccatgaatggaatttcgaagattgaagaagcctttaaaattgtgtatttttgtggggcagaaggtccatgccaaccatcaaattttcaaaggtttcattttaaaatttaaaatccactgctgtaggcagagaatgactttatataggaggtctccgagaggaagcagtgtaaaattgtgtgtctaacatttataacagttggcaactgcagttgagtaatcttaatagtgattctgttaatttgactgagttctattttattgctgctctacgtttttatttgctcagggcaattttaagttgtggttatgggtcactgatttttatctccagcccacagaactaccattaaacagaaataagaaagcaagcggctttgggtccgttttagtctgaatatattattacgtgccttgggctttaaaaactgctatgtagagttagcagtttttaagatgaaaatcactagacagctcattggaataagggcttctccaaagaactctgtagggttatatctattgttactatttcattttattaagatatactgtatatttacatgtcttcatggttttggtatgtttcaaagtataaataatcccagttctgtggtctcaggaaggaaaaaattggacagtgtcttttttttctttttttctttttttttttttttttttgagacggagtcttgctctgtcgcctaggctggagtgcaatggaacgatctcggctcactgcaagctctgccttccgggctcacgccattctcctgcctcagcctcccgagtagctgggactacaggtgcccgccaccacacccagctaattgtattgtatttttagtagagatggggtttcaccgtgttagccaagatggtcttggtctcctgacctcgtgatccacctgcctcggcctcccaaagtgctgggattacaggcgtgagccaccgcgcccggcctggacagtgtctttggtaataaagttcagttttttttaatgtaaagtgccacacccaatgacatattttgtacaaatacaaaaagtctgaggtatatgaagtggaaatgatgaaaataaaggaaagggaatggaaaggtgtagaggcctttgctgtttgatgggaagggaaactagctctgtctttataatactgaattaaatgtcattggacttttggattaatttctcaaatttttgattccaaaataagttactcttggcatatttatattgaatgtgtgtgtgagaatttttaagtcagaatgacaggtgttctgatatcaagtaagttttaaaagttagcatatagtttattgaaattctaataagtttcttagaattttttgtagaattcctggttccctattgtgatttcattctagttcccatagcttttgctttactcttgacagttccacatagagaataaacaccgctcaaggttttaggggacttagaactgctgtcagtttcaatatactcaaagccagcattccttttccttttgaaactgcctgttctttataactacccaattttagcatgttttctagacttaatcacacgacatgttggactcaactttgacttaattttcagattacaagctgttgatgtttcccatatcattggttccctatcctttacattcacgctgaattgtatagttcccaggattatactcagaaaagtgcacattgccaaataggaaaatgatactgtatggataaacttgatgtgcttttaatggacaaaagctaaattataaacatctttttactgctgcttgtggtcattcacttggacttgttactcttatttttcctttttcagttctatgttgcatgtatttcttattctaatctttctaaaatgctgatttcattccatctatttgcttgatccttgccagaattccctgcaagaggcttttagctttagtttggtcgtctcactatccctgatacaaactgttgctaattaccatctttatggcctgagggtttctgcttcattactcgatttaggacttattttaatcttgattatctgtctttcagcatcagaagattggctctgttcttttctccttgaaaacatttgtgtatttgtaaagtacactgaaggagtatatgctttgatatttagatggcacaaatgtaaattttggtgtgggaagaacggtcgtatcagcagttctctcttttttattatgtgtatttctatgtaaccgatcattcacttgttctctagtcagtaattccatttaattatgaaaagcttgtatatgtgaaagttactgtgcaatagcagttgtcattgatttagttttgttttctggtaaggtataatgtgatagaagtagtagtgtagtgtaggatagagttttacatattggcagatttcactagtttttttttctattgccattcaggcaccaaagccatgtggatgaatatagctgacttgatatcagtaagatcattttgtgtgacacctgcccttttgtttacattggataggttattaaaaagtttcagcatgtaagctcttgtggatttcttttgacaggatttgttgtgagccttccttccccaaataaaaatgtgcttacagtggtaacaacaggtaaaagaatataaggatagtttcagccaagtattaatctataaagttaagcggaccaacataagatttgcttaatgggttggcctgtatgcatgtgttgaattttaaaatctaagaaggattattgcattaaatttgcagggactgcccaatttttgttgtattagtattttattttaatcgtttaatgagttgggaagttagagatttttttttttttttgtcgttttttgttttgtttttttctgagatagcagtctcaccttgtcgtccaggctggagtgcagtggcacaatctcgcctcactgcagcctccaccttccgggttcaagcgattctccctcctcagcctcccaggtagctgggactacaggcgcccaccaccatgcctggctaatttttgtatttttagtagagacggggtttcgccatgttggccgggctggtcttgaactcctgacctcaggtgatccacccaccccggcctcccaaagtgctgggattacagtcgtgagccaccatacccggcctagaaatgttttttagtggcagttaatttctaacttgcaaacaatttttgggatctagagtttttaaaaattagcgttataccaaggaacccactggtatgcggaatgtttctcatctaagtgattaattacaaacgcttttctgagacagacctatttgttgatccaagacttatgaacactcagcttataatttttttgctccttaaacgtaataaacattgtccagtttagaatgacatacttggaccacattcaaccaagagacacttgatgaaaatattatgcaaaatacctacttaaaatgtgattctgtggaattgacagttgaaggtagtattatataggcaagctgtagttcttgcctagaacaggcaagttctcaattcaacaatttgatgagtcctttagcattgtgttaggaagatgtttagaaataagacaactcaagcaatctgctttttgtaagagtaacgacttttccttcccagttgccctttgattgttgccatctaatggaggactagcatcaggctctttttctttaattggagcagagataaaactttaagcatatccctgtgtaacatttctaaaaataaaggatactaaagtgtatactaccttactttaagagaggtgataaaacttagcatgagccatgcagtctttttgaatttttgattcattgtgtgatttggggcaagttttactgcatttgtctgtgactctgtttccacatcttcaaaatgggaataatactatctacctctaggatgttttgaggaaattgttgaattaacacacccctgtggtggtgttaaatagcaaatacactgctttaccttttgtacctctgtgatatcactttattgtggtttcatttataaattttggattaaatttaagagaactttagaaagctgaaattttttatttaatatttgacaacttgctattttataagccctgggctattacaaaaataaatgtaaaagcccctgctcttcagtctggagagggaaatagacgtgcacaaataatacaagtcaaagagggaaaagtactgcaaattcattgaacatagaaaagctggtctttagccttttttaaaaaggggctgataaaatatagtcccccatgtagtttatccataatacatagcgtgccacttacaagctaaaaagccctatgaaaaatgaggcgttttaactaccaccaccaacaacaacaaaaagcatcgtgagggaaatactggtaaattgggccttggtttgtgagaaacttcagcgcaggcctagatcctgggggaggggagaagaggaacgccttcagtgagtgtcaataatttttaagtttatacttaactactcattaagttctttttgatataagttctttttgatacttgttagtgtttcactttttttttttttttttttgagacggagtctcgctctgtcccccaggctggagtgcagtggcgcggagtctcgctctgtcccccaggctggagtgcagtggcgcgatctcggctcactgcaagctccgccttccaggttcacaccattctcctgtctcagcctccctagtagctgggactacaggtggccgccaccacgcccggctaattcttttgtattttttagtagagatgaggtttcaccaggttagccaggttggtctcgatctcctaacctcgtgatccgcctgcctcggcctcccaaagtgctgagattacaggcatgagccactgcacctggcctagtatttcacttttaatctttaggaacaacatttcaaaatttgttttcagatgttcctttttttatttttattttttttgagatggagtttcactcttgttgcccaggctggagtgcaatggcgtgatcttggctcaccacatcctccgtctcctgggttcaagcgattctcctgcctcggcctcctgagtagctgggattacaggcatgcaccaccacgcccagctgatttttgtattttagtagagatggggtttctccatgttggtaaggctggtcttgaactcctgacctcagatgatccacccgcctcggcctccaaagtgggattgattacaggtgtgagccaccgtgcccagcgttagatgttcttaaaacactgattccttctaggattattttgctagcattcatgattcggagggagacaattctctgaacctgatttaatttggcagtttttattctcacttcctgctagccctttcacccagttgattaaaaaaaaaaagttttagaacagaacagatggggctttctatcagcattgtttagtgtaggtatcttttgttttggggtaaatatcagggagcagctactcttttaacaggaattatattaataaagttttaggctggctttaacagttcttgaacatcaggaacatcttgctttgccagatttcttgttgattaaaagtgcagatttgccatctattaatggaaaatgcgttaagtgattaggcacaagcctgcttatagatgaccttatttatagaacatatgttcacagcttaaaatcttattctgttaggccacattgcatagaaaggtaataatttaaagtcaaaatgtctaaaagacttaataaattagttcttgacacctcctaatcattagcatttctggtggagcacttttctaattggttgaaagcaagtgaggaaattgcaaatcaaagaatggaagccactccggccacaagggggagtaagagattaaatctatgggcccctaatgtgtgacagattatgggcttcttgcatgatttctttttaaaattttaagagatctaggatttatacaaggcccagtgtctctacagaataaaaattataggaaaattatctctgcataagagaattgtacaagaccagaaatttgaactacactatgctgaagagttggaattaaatctattaatgaggatgttattaaaatgacatttgtggggtatttttgtgagtttttaaattgaataatataaactgggagttttacataatttatagatttgtagaaatatgtttaagtatacagaaatttcattgagtcattgaattttagggttaaagggacatctgatctagcctttttattttaacagatcaagacactgcagctcaggggttcagctatttacatgaggtcatacagtaagcattaatatttgtagtctcttaatgtagtatcatcttattgtagattgaaacatgacatttaatctgctatcaagatactgggtttgtagggggggatgaggagttgtcagaataacaaaataagtggctttaattttattgaaaacagtggggtttttttgttgtttgagatggagtttgactcttgttgcccaggctggagtacaatggcatgatcttggctcaccgcaacctctgcctcccgggttcaagtgattctcccgcctcagcttcctggatagctgggattacaggcatgcgccaccacgcccagctaattctgtatttttagtagagatgggatttctccatgttggtcaggctggtctcgaactcctgacctcaggtcatcctcctgcctcggcctcccaaagtgctgggattaccggcatgagtcactgcacccggccgatttttgtttcagactataattagggtgctgtacttactgagaatcacttttgagggctcttatgcctcagttacttgctacctcaaccttttaacttctggtgtgtgtatgctttgtatgaaagcaggcatgtctgtgtcctaatgtctctctcttcatttgttgttttggaagagagccatgacagtacaatctaaaacagaagaatgggttatggaggcttgatctttctcccactcacatatttggtgaggtcatgtcaaagttagcccagctgtattcgcaaatttcaattcataaatgtctcaatagaggttgattgttttgctttgatattctggggggatttgctatttgctaatgacactcgatgtctaattatctttgtgcgaattaaatttaatattaggaccagttggtgaaatactgttttaagacaagatgagaactttctctccaccccacatatttttctttacaaatgtatcattgtttttgtaccatttctgtgttaaatacaaaagtagtatcagccacataaggaaatttgaaaaaaaaaaagcatataaagggtatgaaaaagggtatctttcagaaataaagacaattaaaagggacttctttaaaatgtattaacttttcattttgaaataatttcagatttagaaagaggttggaaaaatatgaagagtttttcatatattttgccagattgtccacatgttaataactacagtataattattaaaatcaggaaaatgattaaagtaaatgataaactattatgtaacctataatcttaattaaatttagcaaattgttttactgtaatttcctgtttctgctccagaattccatccagaattacactttgcattttgcttacatgtctccttactctcctttaatgtggatcagtcttgttttagtctttgcctctaatgattttggaacttttttcaagagtactggctggttattttgtagaatgtctctcagtttcgatttgtctggtgatcctttttgtttgtttgtttgttttgagatggagtctcactctgtcccccaggctggacttcagtggcgagctatcctggctcactttgcaacctctgcctcccaggttcaagcgattcacctgcctcagcctccccagtagctggaattacaggcacccgccaccatgcctggctaatttttgtgtttttagtagaggtggggtttcaccatgttggccaggctgatctcaaactcctgacctcaagtgatttggccgccttagcctcccaaggagtgagccaccgtgcccggcctgtctggtgattcttcatgattaaatttaggttgccagtttttggtgagaactcctggaagtgatatggtgtcctcctcagtgcattatattaggaggcatgtggtgttgtcctgttacttaaccaattatatttagatagtgcattatgctgttaggacttctgaaaacacaccccatggtgcaaaatacccattgaatcttttttaaggtatatgccttaagattatgattactttgtcaaaggttacaaactaaattattttgccaaagtgctttttaaataagctgcctctgtttatactgaataggttgcttcttcaaaggggaaaataggatcccagctctgtaacttgtaattttttttcgaatttattttcattagttggcttcttgtgttctagttggcaagcccaaatctcagcacatagcacggtggtttgagtgtatagtggcaggttggctattcttcaggactgaggtgaatgtacaaatacttaatgattgagttcttgttcataattttggggtttggtctaaggacccttagtttataaattctctgattactttttaagaaaaaaagtgatcttgaatttaaagaaatgtaagggatagtggtggggtgggaaattcattatgttagaggagatttcctggcattggaagggagattttgaaattaatgctgtagtgaaacacaagaagattaaggtgaggaggaggctggtcatagttttgtatttgaaatgcctgtcttgcctcttagttagtagaattagtaccataatctaggacccttgacttcttaacaagtttactctgccttgcaacctcacactctcttccagttctctctgcaggatttttcttaggttcttctttgttcattacatagaaacctggagcttatccatattaggaggtgcttagcctgcccctttgctgctgtttctgaatatatgtgtttagttcagcactcacatattttaaatgagcaatctcttaggttttcagagaagtagaacattgttgtgtctcttacagcagaatattcattattgaatgtagtgtcaacctgaatttctatcaggttttgtcttaactatttaggaatttggtaaggtaatacactcttgatgatgaagactttctgaaaaatagtttttaggatgttgagctattaaaatatcctccaagatagttttaaaatgttttatttaaatgaagctattacagttatgcgtatattattcagtcagggagtttaatatttttgagtgcttaaaatgtgtagaacgtgcctttaatagagcctatgagtaggttaagagtatatatgtgtgtgaaaagttaaaggtgcaaaaccataattgtttgttttatttgagatggagtctaactcattggagtgcagtggcacaatctcggctcactgcaacctctgcctcccgggttcattcaagcaattctcctggctcagcctcccgagtagctgggattacagtcgtgtgccaccacatccaatttttttttttttcccagtagagacggggtgtcacccaggctggtaatctttattttaaattgtacttgctcctaagaatttaggtgttaagagcatagcatgtagaaggaaaaaataaagctgctgtaacctcatcctgccttcttggaggtaatctctgttagtcctttgtgtatcctgggaatttatgtgcaaagtaaacaattctgtccttgaagaataaggatcatatacttagtttggtaaattgtacaaaactacacactttgatgtatatcttatgtttcattttgacaggtacctccttactcttttgttttttggagacagtctcgccctatcgcccaggttggagtgcagatggcacaacctctgcctcctgggttcaagtgattcttctgtctcagtctcctgagtagctgggattacaggcgcctgccaccacacccagctaatttttgtatttttagtagagacggagtttcgccatgttagccaggctggtctcgaactcctgacctcaggtgatccacccaccttggcctcctaaagtgtgggattacaggcgtgagccaccacaaccagcccgtacctcctcactcttaatgtctgtatagtattctattatttgggtatgtagcaacttacttagccagaccctccttttaaaaaaaaaaaaaaaaagatagggtctccctctgtcccccatgctggagtgcagtggtgcactcactgcagccatgacatcctgtgctcaagtgatcctcccatctcagcctttggagtagctgggagtgcaagtgcacactacactaggctaatttttttttttttttttttttttttttttgagacaagtctagctttgttgcccaggctggagtgctttggcacgatctcagctcactgcaacctccgcctccagggttcaagtgagtctcctgcctcaagcctgccaagtagctgggattacaggtgtgcaccaccatgcccacctcattttttgtatttttagtagagatggggtttcaacatgatggccaagctggttttgaactcctgacctcaagtgatccacccacctcggcctcccaaagtgctgggattacaggcgttagccaccgcgcctggccacgctaggctaagtttttaaattatttttagtagagatggggtcttgctatattgcttaggctggtcactaactcctggcctccagcaatcctcccagctcagccttccaaagtgattgtgattaaaggtataagccaccacacctggccgttagtcctttattgacagaaattaggatatttcccttttttctcttcagttaaaaagctctacactacacactatctgtacagacaatgtagatgaagctgaatagctttgaataattagctttagggagaacatagcattagagctaggtatggagaggtatttagcacagattcttttcattttatttttccagctttattgaggtacgattggcaaaaaaaatatatatttaaggtgtacaacatagcagaggttactttaaatcagttgttaaaagtgatatgccgaccactgggagtcctttggggaggtgtctattacatcacaaaaagtcacaactattttcttcctttttttttttttgagacggaggctcactctgttacccaggctggagtgcagtggcacaatctcggctcactgcaacatccacctcccaggttcaagtgattcttctgtctcagcctcccgagtagctgggattataggcacacaccaccatgcccagctaatttttgtatttttagtagagacaggctttcaccatcttggccaggctggtcttgagctcctgacctcatgatccacccacctcggcctcccaaagtgctggagttacaggtgtgagccactgcgccgagccaggtcacaactattttcatggcaaatactgttaatactgattcttatcactttgttgacatttagcactggtgcaaacccaagggttgctcaaacttactggttccttatcgctaatcaaggcagtgatactatactgtactagtgattattgtatttctttaccattatgcactcactgtttcttttaaaaagaaaaaagactttttttttaatgtccttgaatctgaaacattattttattaatagcccttaaatagacatctttcagtgaggcaaaatgggaagtccagtggttgtctctaagaaaaacacttgcagttatttgaattgtgagataaactagctgcttttctttttttatggaacacttttttcttcaaagaactgcaggcagataagctgtgggtattcagacctaggtattcgacaaatatcttaaatgaattgagcctctcactttaagggaaaatgatatttttgacagataaaattgaagctttggagcaaaaatgagaactttggaaaataattactaccaccatgatcttagttttctacttttttatgactgtaaaagtgtcttgagacaaacttttaagccataaatttgaagtattgttaccgtttagggttttttcctagaaaatgtacctatttatagaggtagtatatatgtaccatggttgggagaaataaggtaatattacttaaatattaggaaattatttcacataagagggagttctgagctaaggtggtttttgggtgggtgagtgggtgggttaagatcagttactgcagtacaaacagtacttgaagtctaatgtggttgacactagactttcaccttccaaaaggatggcagcacttctttgttgcttactatttgccagactctgctaaatgcttattatatgttaattcatttaatccttacaacaaccttgtgcattatgtctactactaatatttgccttttacagatgagaatctgagacccaggaagatttcagagttttgtcaaggtgacagagtttgaatttaggcagtaagcagtctgtctccatagtttgtgttcctaacaagtctgttgtttaaaaagagaaaataaatactaaaggaaatgttctttttttcttttgttcttttttcttttgttctttgatatgtcttaatcctgtgtttttgaatgaaaacttttttgcatcctacttcaccatttttcctagttatacaaattttagattaccaaagccaaaatgatgtacttaagagtacaagagcactaaagcagatttttgaatgtcagaatctccatactttattttcacataactgagcaaccagtgagtagaatgcctactctcggttgggagctgtgaatggtgccctcctgtttatatgttcatttagacctcataacagccttttgatgtggattttcatatagatgagaaaataaagattagctattgtgtaaattctcaaaattaatgggttagggtggaatttcaagtctgcctggttttagagtttatacgatttgcattacatcaagcttttcttctaacaagtgttgaatgcccgaaaggttaaagtcttgccaccagctcaggcagcagttttggtggtttaggggtaatcatactgaaagaccagtgagaaaggcatatcactagagatagattctcagttcattaacttttcattaggaatatttgactacaggcaggagtgagtgtttataaaattcatattagtgggatcaggttgagtctatgccaagaagggatcagaaacagatgacctgtcaatttatgtggttccttaattttaatagacttaattttaaagacaaaacatcattgtaaatatagactatctttggattaaggcatcttttggaaactggcttgggaggaaaaatgttatttgaaccccatctcttggaagtgttttcacaatctaagaggttaattatactacggtgcagtagagagaaaaatctcttttatctctaaaatctcaaatttcatgtaatttacctgttggttaggttaaggattagtgtcctctcttcagagcccatatcacatatttaactctggattaggagctgtttaccaaagagtattagataccggcttcttgtggcattttgctgctgagtaaatgatttcttatcccacttaatattattagggtgaatgctgtataaatgcattaactctaattcagcaaattaatcttgggtattttctaaaatgttggccatgatatctttaaaagacagtggctgtcatgaaaaaacatatttaaaagttaatgggagcagggcaagctatgatggggccactgcattccagcctgtgtgacagagcaagacctcatctctaaataaaaattaaaaaaattaatgggagggaaaaaagtaaaacttacatccacattttgaagtaaactgaggaaatactgtggatttctaaatgagattatatttcaggaagattcaacagattaacatttagccttgatttagcttgagtgtaggatgtgcttgaattttgtttgacctcaaaaccatttagatttggtttaaaaacttaaggtactgtgataattgaaaaattttacaagttgaaccttcagtcaacctagcccttgttttacagttggagttggctgggcgcggtggctcacacctgtaatcccagcactttgggaggctgaggcaggtggatcatgaggtcaggagttcaagactagcctggccaatgcagtgaaaccctgtctctactaaaaatacaaaaattagctgggtgtgatggcatgtgcctgcagtcccggctactcgggagactgaggcagaagaatcacttgaaccggggaggctgaggttgcagtgagccaagatcacaccactgaactccagcctgggcgacagagcgagacttcgttctaaatacggttgaaattgtgacacttagtgtatacttccttatattatggtgtgcccactccctcccctttttacttcagactttatttcagtcatgattgctttcattgtactattgtaggtgaacgaaatttaggaggtttatttctgtgttgagcaggatattctctgaagttattgcatattttgaaagtagctatcagccctttcctcccttccattctctacttggtgcacctccatgtttttttctgctttgttgtaactgctgcttcctttttcttttgttcttttattcatttttttctattcttcctacattgggttttatcttctggcttccaaatctggaaaacttggatttgttattcttcggtcagtttgacaaagcaacatacttaattgcctcttttatgttaccattaaattaattctgtgaactctgacttcccttagaattgaaaaagaccacgtgtacaaaaatccggttagatagtagaaataagttctagtattcaatagtacagtagggaaattatagttaacatttatttattctaccaaagtagctagaagaattgcagtgctcctaacacaaatagaagatcaatgtttgaggccaggtgcagtggctttacgcctgtattcccagcactttgggaggctgaggcaggtggatcacctgaagtcagaagttcaagaccagcctggccaacatggcgaaaccccattggtactaaagatacaaaagttagctgggtatggtggcacatgcctgtaatcccagctactcaggaggccaaggcaggagaaacgcttgaactcaggaggaggaggttgcagtgagccgacattgcgccactgcaccccagcctgggtgccagagcaagactgtctcaaaaaaaaaaaaaaaaaatcaatgtttgaggtgatggatatcccagttactctgatttgatcattatatattgtatgcatgtatcaatatcacatgcacccccaaaatatttacaactattttgtcaattaaaatttttttaaaagaaacagatgacatcttctttatgaatctcctctacaaaatacctaagttaccctctttagtttcctgttttacctttatgtgaaaagagggaattcactgagcaggttccagtactggaccactcataagttttctcatactgaacagaaatcttccctcttgctaaatttaattggtcttgtctcttggagccattcatgtcctgttctttccattatcctgacagtttctagtatactcgccataactttgattcctgattgtggaataacgtcctttctagtaggtatatcaccccattgaggctgagaatatgttcctttttttttttttctttttaagacggagtttcactcttgttgcccaggctggagtgcaatggcgcaatctcagctcactgcaacctctgcctcccgggttcaagtgattctcctgcctcagcctcctgagtacctgggattccaggcgtgtgccaccacgcctggctaattttttgtatttttggtagagacgaggttttaccgtgttggccaggctggtctcgaactcctgacctcaggtgatccacccgcctcagcctcccaaagtgctgggattataggcatgaaccaccacacctggcagaaaatgttcttttatagttagctttttttgagctacagtgttagcccctttaaatttaatctttaatccagtcttgcttggttttgggtttttaaatcttaattagcttatgtcattggacgatttattagaagtaggccatttatgcctttctcaactctttttttttgagacggagtctcactctgttgcccaggctggagtgcagtggcactatctcagctcactgcaagctccgcctcccgggttcacgctgttctcctgcctcagtctcccgagtagctgggactacaggcgcccgccaccacacctggctaattttttctttttgtagtagagaccggggtttcaccttgttagccaggatggcctcgatctcctgacctcgtgatccgcccacctcagcctcccaaagtgttgggattacaggcgtgagccaccatgcccagccacctttctcaactcttatggtcagcatctcaccagaaacacttgccacttgtttggttcttttggtctatcattaggccagtaagcagcctgactgctgtttacccagccctcctgttacttgtgggttctaacaaatagctttaaagttgttttatggttaattcagtgttcagctttggggaaagaagtgcttaactgccattttaattcccagggaactgcttagttcagcatattacccaggtagaaagttactacctacaaaagatagattactacttttagtagcatttatcaacacctttcctaaaaaaatttaagtttttagtacagctttaaaattttacatcttaagtgactggttcactcttaagtaactgcatgtgtttatggccttcatctctgcatacatagagggggttaaagttaccgaaaagtgaaagacgtgattaggcagtgttactctttttgagacagcctcactgtcaccctgtcctagagtacagtggtataattcaattacagatcactgcagcctcaaactcctggactcagatgatcctcctgtctcagccttccaagtagctgggactataggggtgtgccaccacacctggttaacttttaaatttttttgtagaggcaggatctcatgttcaccggggtggtctcaaactcctggactcaagaagtgatcctcccacctcagcctcccaaagtgttgggattacaggagtgagccaccgtgccctgcaattcttgtaaagtgtattgtaatggaaggaatgatagccttgtctctacagctagattatgaattaccagaatattgtgcttccagcttctagcatggtgtctggtgttattgtgataatagaaataaacatttaagtgcttactcctaagtgcttacctgtattttttctcaataatcttagaggtctctgccttacaggtgagataactgaatcattgagattaagtagttcacacggtgtatagtgctgtaattcaaaaccagactcaccccaaagccacttatgtttataccatctcccatagttgaatgaataatacaatttgtgtaacaatgaaacttttgaaaatcctggtcatttgtttcttaaaaccattgtttttaagtggaaagactcacttgactattttaaatgcaagtgtcttccactgtttgaggcagatctccacagagcaaccataggtggtaaaaagcattgtattcaaaggacaaaacacttttgcagctaagagaactttgaatatgaaagtatgaatgtggtgtaagacagaggttgctatcctaaccaaaacgttcttctgatttccggccagtaattttattttatttttatttattttgagatggagtcttgctctgtcatccaggctgcagtgcagtggtgcaacctcggctcactgcagcctctatctctcgggctcaagcagttctcctgcctcagctgggattacaggcgcccgtcaccacgcctggctaatttttgtatttttagtagagacagggtttcaccatgttgacgaggctcacctcaagtgatcctgccaccctagcctcccagagtgctgggattactggcatgagccactgtgcccggcctcaggccagtatttttaaatatcggttaataattgcaggaaacatcatttcaggttgacttttctcacctttaacctctttatatagcacagtgcaatctggccctactgccacttcatctgggttatctgtagcttgagttgtaaaaaaaaaaaaaaaaaaaattgggggaagaagttgggttaaaactgttcacctacccagcattggaacataatgggtaaacaaaaagttggagttaccatttaaaagcatttttcaaatttatattttatatataagtaggtgctatataaactaatactttttttttgtaagaatggatttggaatttagctcagctgaaaattgacttcaccttgattctcagagtgtacttgaactttaaaggaagtggggtagtgagaatgggtggttggggtttttttgctttaatgtttacctaattctactactagaattatttttctcccccttaactggaaagaaaaaaattacacatttattgagacttcttcccatccccaacacaatgatctaatctttttgctttaaaatcagttaaagagtgtaatttttaaaatcctaatcaaatgactcagattgtaatagtagttttagacagaattttataggatgatgttttaattttatctgttgtctgggatgatctgtaatcgtgtatcttactagccgaaaatgacttcaatgagattaaaggtctgctctttaaaatctgtaagtctcctaccactgtctttaggaaaaataaaacttttgaacggtttttttatctgttgtgaggtttgcttgaattgtgttgttataaatgaagtttattttgttcctccttctctggcatggactccttaagtgtcttacattattggtttctgctttagtcatttctccagagtcccaaaaggttcatcccgtatgttctttctattttcatgtcatgaccacatgaaacttcagatggaaagcttgccagctcattagaaaatgttcctaaatgtgaacggtcatgccccacattcatgaagtcagcatgtaaatagataacattgtcagggaccaatgttcaattttattgtcctcaaataataaactgaacactaacttcaaacttaaaatattgctgcccaaagcattctgctttaaaccacaaattcatgtgccagctgcattcacaattgtattgacagtgactgggcgttaaagttttataacttaggctatagtttgttctttaagaaatgcaagttctttcagttttgtaaatgttttattctcactatgtctgtttcttttcttcttaagtctcttttggaaaagttcttgatccccaatgcttcacaagcagagagcaaagtcttctatttgaaaatgaaaggagattactaccgttacttggctgaggttgccgctggtgatgacaagaaaggtatgctgtttttaaacctgttggttgaacttgtataagataacatagtgaggaagagtctctgaagcgtacataatgtcttgttttgaattgcttagagtgccgaataaggagtagcagtgctctttgtgttctgagaatacacatctactgcctcatactgctattctaaaataaatgctttctgaaaagccaatattgtgtacagggatgttttttcaagattttaagaaaagtgaccagcctgagcaacatctctctctacaaaaaatattttgaaaattagctgggcatggtggtgcaagcctttggtcccagctaatctggaggctgaggtgggaggattgcttgggtctgggatgtcaaaactcgtcaattttttaaaaacataacaataatgagattataaagttgttttatcttgacattgatcaatggctagtgtgtaccaggagaaagctccctttaaaaaaaaaaaaggaccttgttcaattaacaaatattaagctgttacaggttagtatttcaaaggatatgtgagatattaaaggtttggtttgaggggtgaagatataatgcacactttatctcagtacgttttggtgtgtcttatccagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagtatgtattttacctgttacgtagaaatttagcagtctttattatttgagcactgaaatgtaatgtactatttttaaatcgtaggcttttgatgaagccattgctgaacttgatacattaagtgaagagtcatacaaagacagcacgctaataatgcaattactgagagacaacttgacagtaagtacataacagcatcattagtgatgaatgtggttgaagaggttatgttttactctagggaatttttttttttattaaatacatcttttaaaattttttctcaacacatttcataggctctcataaatatatctcagctactattaaagtcctatgaaggaaaattacagaaactgaaatattagactgagaactaaaaaatacacacattgatgagttacctgtcttgttaaaatttgttagtatcaaaagtgtgctgagactctacatgttttagttcctttaagaatgattttcttgcccatcaagttgcctccatattggtaaagataatggtagggaattaataacttgagttacaaaatctcaggtatctacagaatccaagtggaagtctattttgcctagcttcttattttaaatgacttaatatgaaaggtcgtgattgtccttgggatactgcagatgtataaaaagaaacagtgtcactatcacaccaggaacatcaacataattccctaataatgtttgaatatctaaataatacttgaattccaattatctctctttttttaagttatttgaattgggattcaaattcagtccacaatgcagttgatttgtatgtctcgtttgtttcttaggtcttctcattcttctccttcagataaatactagatttgaaattttgaggcttaggtgaaaaaattatcaagcatttgctgtgtgtcaggtaaagaggtaggaattgcagatcataatctaggtattactgtttttttgttagacttctagggccatttctcttggggactatgtaatctcattttatacatttctcttccaactttattctagtccactgccattttctataaaccagttctatatgctagtgctgaaaatcttgaagagttttttgaatagtattgtatacttgtttattaaacctaaaattactttattagcacaatttggagctatctataaacttttctgatacttgagtcaagataacaagccacagtaaagaatgaaagaatcttatatatcaaacataagaagcactttgttaactaactttagtattaaggatttttcttttctagtttgaagtgatgacatttttaaagtgatgacctgagacctagatactgtgttttgttcacatcactttttgagaggccctgatctactgtctgcttccaactgaattttgctatcagtatagcatgaagagcgcatattgcaataagaaaaccagggttggccgggcgtggtggctcacgcctgtaatcccagcactttgggaggccgaggcgggcggatcaccaggtcaggagttcaggaacagcttggccaagatggtgaaaccccatctctactaaaaatacaaaaattagctgggcatagtggtgggcacctgtaatcccagctactcgggaggctgaggaagagaattgcttgaacccgggaggcagaggttgcagtgagctgagatcacaccgctacactccagcctgggcaaaagagcgagactctgtctcaaaaaaaaaaaaaagaaaagaaaaaaccagggttttgattctaattctgtcactacttgtatgtcttctctgagccttattagtgtcagctgtcaccattataggttgattggaacatttatctgtcaagaaaagaaattatcccaaaacttaatatttcattctgaatttggttgaccaagactgtcaacacattactctagaaaaagaaatattttgtatcaaatttgcatgtttatacagaaaattcaagaatccttgaaagttagaacaggaaagagacattagaaacaatttcatcttgcaattacaaaaccccttgtttgacaggaggagcacacagtttccaagaggtcatttggctatctgtatgaccttggaagtagtctcctttccaggccagagatatatttgcttagtagataaatgaagctaatggatgatttggggaatataaaaataataattagtgtattttccccttcccctccattttcatgtgtaagtcatatataaaatttaagattgtcttgaatccttttgtaattacctctgaaaatcactagagagtggttaagacttcaacatttttaacattggagcaggtggaatagagttcataaccctgccacctatgggacaactttcatttttacctgttaaaagatttggttctggtttttgtccagcatttattttgaatcatatgatagggtagtgcaaaagtaattgagggttttgccatttaaagtaatggcaagagctgcgattacttttgcaccaacctgataaataaaggtttgtttttctaagcttaaagtgttagaaaagctagatttgtagtttagctcagagttgaggctggttcttgaatttcatggagtataggattctgtttggagtgtgagtcactttaagatctaccagtggagagtagtcaaccctagctccttcagcatgggccaaattagatgcttctggtatagttgcactcaccttggacgtccatctttcatattggggctctttaggttctgacacctattgatgcttagtttttaaaaaataatttagggcctgggcacagtggctcacacctgtaatctcaccactttgggaggccgaggtgggtggatcacgagatcagatcaagaccatcttggccaacatagtgaaaccccgtctctcctaaaaatacaaaaattagatgggtgtggtggcacatgcctgtagtcccagctactcaggaggctgaggcaggagaatcgcttgaacctgggaggcggagggttcattgagccaagatcacgccactgcactccagcctggtgacagagcgagactccatctcaaaaaaaaagtattatttcttgtaatttctcttcaccttctgtggataaccaaaactttcctgtatttgaaggttatttgaaggcaactctgtggtgtacttaacctgcttatatagtggttacaaaaaaagtaaatttgtatattgagatgtttttgtatcttgaagctaagtgatgctgctatctttttaagaatgctttccaactaaaacattcaggtatcttggcacttatatgaaaacgcccccccccccccatcccactgaaacttgctgaaaaatctttccttcttttaccagttgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaccttggggtctttatttccaggagaaaagataccttctgcatctagggcaacaatccttttccctcgcagctctttcttttacctcacttactgatttctcctgacccccaagccaaggaggtaaaataattatatatatatatatatatatatatatatatatataaagtaattatattttatagctagactgaagaggtgggaatttttttgttgttttttttttttttggagacaagagtcttgctctgtcacccaggcttgagtgcagtggtgcgatctcggctgagtgcaacctccgcctgctgggttcaagcgattctcctgcctcagcctcccaagtagctgggattacaggtgcccgccaccacacctggctaatttttgtgtttttagtagagacagggtttcaccatgttgtccaggctggtcttgaattcccgacctcaggcaatccgcccatctcaccctcccaaagtgctgggattacaggcataagccaccgcgcccagtagagatgtgatattattcaagtaaataaaacctgaaacttggcacatttgcctatttaatgtgcatcagtcatctgaactaggttgatcctggaataatgaaaacacttcactagtattaactaatgttttctacatagtagttcccaatagattaaggaaaatttccaacctgagattctttgttttggaatttgaataatgtgtttgtaactattccttgattgtcccaaatccaggctttacgtctgcttttgtcaatgtaacatcctagtgccaggaaattggaaaatccaatgactttttgtgtgtaaagtactggaatttttttgttcgtttgtttttaagacggagtgtcaactctcgcccaggctggggtgcagtggcctgatctcggctcactgcaaccttctcctcccaggctgaagtgattctcctgcctcagcctcgcaagtagctgggactgcaggcatgtgccaccactcctggctaattatttgtatttttagtagagagagggtttcaccgtgttagccatgatggtctcattctcctgaccttgtgatccgcccacctcggcctcccaaagtgctgggattacaggcgtgagccactgtgcccaccctggtatgttttttttaaattggccacttaagagttgtccttcagaaagtggagcagcagtgtgattagtaaaaacgatgggctttcctgcagctctggcttatggtctttgtttttccagttaacagctgttacttcatgctgttatagggggtggggggagaaagagaaagaatatgtctagtggcttaattttggggctcaatttgtttattatgtttttcctgcaaaagagtcaccagtcttgtcatggctcaatgcatattttaaaatgagtcaaagccaatttggaagctgctatcttaggttatttgtagtcaggcttcaaatggagagtgaaactttgactttgaaaactggtgctctatgctcaatgatggtcttacacattcctctagggaaaggtcaagaaataaatttggcttgattgtattctctcatttaccatataggaaatactatggtagaactgaaaatatgtacaatagtaaagtggtggctgagactgggcacttggaaaatagacttggattctaagtgtgaaactaattaaatacttttatgtgactggtagtagtcacagtctccttgattgattctagttccttttcaaagtggagagacctgaatatagattgtaacaggatgtccaaccttgccagacaagcaggcatatatgtctctgggatgcagaagcagttacaagttaatatatttaagcataatgttagccaatcctaggtgataccagagatgtgaatatttgatcatatttgagttcattccttgaaagtccaaacctaactggtcttaattgattacttcttagtattccgaattttagaatttaaaaccctatgaat

SEQ ID NO: 14933 - DNA, 34328 bp, Human
agcatagccgctggtggcccgctcggctgggtgtggctctcgtcccctcccccacctgcagctgtcggtcccttagagacgctgtacacggtcaccggcgctgatcggtggcggggaaggcgctgggtgggagagcggggtgtgtccgcggcggggctggtagtggttccgcttctgcgggctgctgtggcgtctctgccccggggtcgggcggcttcgctccccacctcccccccccccccaacggcttgggcgggggcgcgggctgctcctccctctggctccggtcggggggaggaattaacactctgcagtaggttgggctccctgacacagatccgccatgacaaaggaggagagtcggggacttgagccgtggctccgacttgggcggagcctggaggggggtggttgcgatacgcggaccggagaatttgcactttaaagtccgggtctgcccgttttcgtttcacagtaaccgacgtctcaagtcaggtaagggttaaatgggtgcggtgagtcctgcccgcagtgtagaggcgaggccttggagcactcgttactgtgtgagaaaccttatccacttcctcttgtaccgaagtgattggggagagaatcctttgtactggcttaaatcattttttgttagaagcagaaataaccagagagcgtttctgagatcctaagggaaaaatcagtaatttagagacctgacgaaaataatgccgtcataaaggttaaatagtttacgtattgagccagtaccttgcatccaaagtggttaattatttgtttaaaatgtggcgacctgttctctcatttggttaaaaaaatattgtgggatttccctgggaaggtaaaagatgattaatattcgggagccagctgccaaggtggactcttctgttcaccttctaacttaaaagtgcacttcattcagggtgtgtattttcctctgaagtcatttattctgtggtgtcactgtgtggattagtatctttgtgctgttcggcaacttgcaaaagggtatctttccagaaaaatgtagctgaggtaaatcgaaaaggtccaggaaactaaaatgcgagggaaagagaattagatgggtagtcatggtaaaggacagcttgagtggtaacatccaattacattatgatggctagaagcaaaatgcagcacttctgcatttcaactggagcgatgacattggaaacacttgtaaattaagtacttccaatgtgatatattctagtactcacagtaagagttgaagtgtcatgacttgcggatatttttaaagcatgtggacatataacaagataaagagttgagacattagggtcagatattgatcctttgtggtggatttatactcaaaatatctgaaaacaaacagttggtcattcccccccaaattgttatgctattattggctggcagttgttgcagagatctagtaggtttggggtaggggtaacactaaagctaaaatgtaatcactcttgacaagagtattatgaaagtaaaaagacgtgagttacattaaactgatatgaattatgattctggaaatatgatagaaatccagatgttctctgtaaacaatgcttttactaaaggaagaaaagctgcttaattttggatcacttagtggtattggaaatgagttgagattttgatcaggtaagattaggggtagtttttgaggcagcttttggaagtaattttgacatgtgaaatttgggtcttctgaacaaattttaagttttgctacactgatgtgttaatggctgtaagtttacctctgatgctgagtatgctaaatttttttcccttttttgactatccttttgtgaggctgcattttaattcctcatgtgaacagtctttcacaggcagttaggtttcaggtttaaaaaactcatttaccacaggtataattttgagtctgtttattttgatgggaaaaattttaaatactccttttttcccccctgcagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactggtgagaatcaattcagtctggcttcattatactgtagggtccctatgagtatcagttacattactcttaactttttgtttggtttttcttttccttctaaacattgtgtgttccaaatttaaaagtcttcatggtgtcatgactaaaaagatgttaagacaattatagatacgtgtatgtaaaataattgcaacaatgattatgaaacagttcagttttgttaaaaataacagactttagtattgtattttatattaattgaaaatataaactaattgtgttactgttttacttatggttagaatatttgtagtagctctatagctggttatcttaaatgtacatctgtggataaaggaattttacatactttaggtaagagagatgtaataggatactcattgtagaaatagtactcttctcaggattagccgctataatgttaatgtaatgagtcaaccatgcagaaaactctggcgtcacaactatgaaacctcttcctgcattgaattcttgaaggtaaattttgaacactcacaaccatgatgaaaggttatgaacaactcaagcttgattttccagtttgaatcgagtattttaagtattcagtacttactgtgttgaagcactgcgcttaaaagaattaaactacattttggttaattttaatctgtcatataaagtagggctttttgatcaagaatagtttaaatttgaggataaaccagtagagaatccaaccaagctggcagtttttggaataatatttaaagtggttttactaaatggttacacttaaccagtatggaagggctctgatatacaaagaggggcagcatctcgatttttctggacagattactgaatctggaactcagtatggaaatccaggtttgttacttactatatgaaccttgtttatggaagaagtgctataatgagcaataggataatgtctgatgtggttgtgggtttggggtttttgttaaagttgtgatgatactatcatttctttacatttgtatttactaatggaatagcatcagttcctaaactgtaattttctcaaatgatacttacttgacactgtctttttaaagaatagtgattttttaaacatgcttatttgggttcacagccacaaactcaatgaggcatctgtcttggggcatttttttgttctttgcttattgaaacctttagaatgatagctactatttgtatctaagttgaaaaaaggaatatcttgcttttattggggccaagtgacaaatgtctgttttgtgattttgctaaggtaataagaatatttaaattttgttttttgtttttttttttttttgagacggagtcttgctctgttgcccaggctggagtgcagtggcgcgatctcggctcactgcaagctccgcctcccgggttcacgccattctcctgcctcagcctcccgaatagctgagactacaggcgcctgccactgcgcccggctaatttttttgtatttttagtagagacggggtttcaccatgttagccaggatggtctcgatctcctgacctcgtgatccgccctcctcagcctcccaaagtgctgggattacaggcttgagccaccgcgcccggccaaatatttaaattttgaaaatgtgattttttttttctataataaaaaatgtattgggtttttttgttttttttgttttttttttttgctcaccttactaactaatatctgtgtatgtgtaattcagttttgttcagtctggagtgtttttcccaattattacacctgatcgaaaagtttttattttggcttcaaagggtgtgttacacattaacatttcccttaagacaaaagtcaattttaggaataaaaaggaatgtaacatttaccttttactaacacgcttatttgcaataccaggtaggtatgtgcatgttttccatatacaaagtataaaagttcctgtcattgtgagtcttttccaaggaaaagacttgtagcaggtttgttttttgtgtatgtttgtttgtttgtttgttttgagactgagttttgctcttgtcacccaggctggagtgcaatggcaccatctcagctcactgcaacttccgcctcccgtgttcaagcaattcttctgccttgacctcccgagtagctgggattactgggcgtgcaccagcacgcccagctaatttttgtacttttagtaaagatggggtttcaccttgtcggccaggctggtgaccaggtcaggtctaactcttgacctcaggtgatccactcgccttggcctcccaaagtgctgggattacaggagtgagccaccacgtccagcccaacttgtagcagttttgactatgcttccctttagtttccttatgaagaaaatttgtttgcatagaaccagtagatgaggataacaagataatctcttcatataaatagtttcttcttgttatgattattaaggaagttcactctggtccctacccacatcgttaccctccagaatagcactggcttcccaaaaagttttaatggtatttacactttgaaagtttggataaatgagagtttaatttctttactatacaaatggctttgaagagaattctaaacaagcttttgcttccagccttggtcttttcaggagtaagacttagtgatctttgcatactcaacgtgtaatagatgctcaaatatttgttaaacaagcagaaaggcttctttagagaaagagcatagaattaggtcagcagcactgcaaaatttccctagctttttctttttctgcttgggaaaatttgatatttaccgataataggcttctttttcctaccatctttttcaaataggtcacatcgactctggaaacatattgcataaaattccttctgccctttctgtgagatggaagaataaaatgtagcagaactgatatttctactagaaaaagttattgaatcattattaatgattagtaaaaatattttaaattatatttttaagatcttacatgataaaaaatcaattataattttttattactccagccttttctgggctttgatatatatattttttaatttgagaaaaataagcaggtgtccctttgcagaaataatagtattggcttgtggcattagtgataaccagattttttatattgagcacctattttataatagctatgaaaataaactttcttcctacaaaaagcagctaatctccaaagttctgagtttttctgaagagctctttagtaacccattctggttatatgtatttatctattgtttaaccatttaataagcaaagagcttggaccatgttgcatattacaagagtaaatagagcattatggcgggaagtggtcactggcatgctcttcacaatgtggactttgcattatgtaaaagaacttgggtttcttctcttccacgtgttaatttcaaactgcaatatgtgaactaatgcaatctgcctttcctgccagatgcttagacaaaagctctcttggtagttggggagggactcaacactagtacctctttaaacctgaaagatggcagccaaaaattgggtagtttttatcttgcacatgatgaaatgaataccaaggaaatacagtctaggaagcctctttcaaactcaaagaagtatgtcgaggtgaataatggagctcaagatactgagtcaaactagttttaccatttaatagatgcatggcctgaggaaatcactcagtccctctgagaaaactaagctcaattaaataggaataatactcatcccacagggttgtggggaatgagagtcaggtaaagcaccttgactaccttctgtgtcctgtttatcttagcttttcagttctatttaaaagtgtgagcctgcctataatagtgcaggggtctcttaacttacagtccatgaatggaatttcgaagattgaagaagcctttaaaattgtgtatttttgtggggcagaaggtccatgccaaccatcaaattttcaaaggtttcattttaaaatttaaaatccactgctgtaggcagagaatgactttatataggaggtctccgagaggaagcagtgtaaaattgtgtgtctaacatttataacagttggcaactgcagttgagtaatcttaatagtgattctgttaatttgactgagttctattttattgctgctctacgtttttatttgctcagggcaattttaagttgtggttatgggtcactgatttttatctccagcccacagaactaccattaaacagaaataagaaagcaagcggctttgggtccgttttagtctgaatatattattacgtgccttgggctttaaaaactgctatgtagagttagcagtttttaagatgaaaatcactagacagctcattggaataagggcttctccaaagaactctgtagggttatatctattgttactatttcattttattaagatatactgtatatttacatgtcttcatggttttggtatgtttcaaagtataaataatcccagttctgtggtctcaggaaggaaaaaattggacagtgtcttttttttctttttttctttttttttttttttttttgagacggagtcttgctctgtcgcctaggctggagtgcaatggaacgatctcggctcactgcaagctctgccttccgggctcacgccattctcctgcctcagcctcccgagtagctgggactacaggtgcccgccaccacacccagctaattgtattgtatttttagtagagatggggtttcaccgtgttagccaagatggtcttggtctcctgacctcgtgatccacctgcctcggcctcccaaagtgctgggattacaggcgtgagccaccgcgcccggcctggacagtgtctttggtaataaagttcagttttttttaatgtaaagtgccacacccaatgacatattttgtacaaatacaaaaagtctgaggtatatgaagtggaaatgatgaaaataaaggaaagggaatggaaaggtgtagaggcctttgctgtttgatgggaagggaaactagctctgtctttataatactgaattaaatgtcattggacttttggattaatttctcaaatttttgattccaaaataagttactcttggcatatttatattgaatgtgtgtgtgagaatttttaagtcagaatgacaggtgttctgatatcaagtaagttttaaaagttagcatatagtttattgaaattctaataagtttcttagaattttttgtagaattcctggttccctattgtgatttcattctagttcccatagcttttgctttactcttgacagttccacatagagaataaacaccgctcaaggttttaggggacttagaactgctgtcagtttcaatatactcaaagccagcattccttttccttttgaaactgcctgttctttataactacccaattttagcatgttttctagacttaatcacacgacatgttggactcaactttgacttaattttcagattacaagctgttgatgtttcccatatcattggttccctatcctttacattcacgctgaattgtatagttcccaggattatactcagaaaagtgcacattgccaaataggaaaatgatactgtatggataaacttgatgtgcttttaatggacaaaagctaaattataaacatctttttactgctgcttgtggtcattcacttggacttgttactcttatttttcctttttcagttctatgttgcatgtatttcttattctaatctttctaaaatgctgatttcattccatctatttgcttgatccttgccagaattccctgcaagaggcttttagctttagtttggtcgtctcactatccctgatacaaactgttgctaattaccatctttatggcctgagggtttctgcttcattactcgatttaggacttattttaatcttgattatctgtctttcagcatcagaagattggctctgttcttttctccttgaaaacatttgtgtatttgtaaagtacactgaaggagtatatgctttgatatttagatggcacaaatgtaaattttggtgtgggaagaacggtcgtatcagcagttctctcttttttattatgtgtatttctatgtaaccgatcattcacttgttctctagtcagtaattccatttaattatgaaaagcttgtatatgtgaaagttactgtgcaatagcagttgtcattgatttagttttgttttctggtaaggtataatgtgatagaagtagtagtgtagtgtaggatagagttttacatattggcagatttcactagtttttttttctattgccattcaggcaccaaagccatgtggatgaatatagctgacttgatatcagtaagatcattttgtgtgacacctgcccttttgtttacattggataggttattaaaaagtttcagcatgtaagctcttgtggatttcttttgacaggatttgttgtgagccttccttccccaaataaaaatgtgcttacagtggtaacaacaggtaaaagaatataaggatagtttcagccaagtattaatctataaagttaagcggaccaacataagatttgcttaatgggttggcctgtatgcatgtgttgaattttaaaatctaagaaggattattgcattaaatttgcagggactgcccaatttttgttgtattagtattttattttaatcgtttaatgagttgggaagttagagatttttttttttttttgtcgttttttgttttgtttttttctgagatagcagtctcaccttgtcgtccaggctggagtgcagtggcacaatctcgcctcactgcagcctccaccttccgggttcaagcgattctccctcctcagcctcccaggtagctgggactacaggcgcccaccaccatgcctggctaatttttgtatttttagtagagacggggtttcgccatgttggccgggctggtcttgaactcctgacctcaggtgatccacccaccccggcctcccaaagtgctgggattacagtcgtgagccaccatacccggcctagaaatgttttttagtggcagttaatttctaacttgcaaacaatttttgggatctagagtttttaaaaattagcgttataccaaggaacccactggtatgcggaatgtttctcatctaagtgattaattacaaacgcttttctgagacagacctatttgttgatccaagacttatgaacactcagcttataatttttttgctccttaaacgtaataaacattgtccagtttagaatgacatacttggaccacattcaaccaagagacacttgatgaaaatattatgcaaaatacctacttaaaatgtgattctgtggaattgacagttgaaggtagtattatataggcaagctgtagttcttgcctagaacaggcaagttctcaattcaacaatttgatgagtcctttagcattgtgttaggaagatgtttagaaataagacaactcaagcaatctgctttttgtaagagtaacgacttttccttcccagttgccctttgattgttgccatctaatggaggactagcatcaggctctttttctttaattggagcagagataaaactttaagcatatccctgtgtaacatttctaaaaataaaggatactaaagtgtatactaccttactttaagagaggtgataaaacttagcatgagccatgcagtctttttgaatttttgattcattgtgtgatttggggcaagttttactgcatttgtctgtgactctgtttccacatcttcaaaatgggaataatactatctacctctaggatgttttgaggaaattgttgaattaacacacccctgtggtggtgttaaatagcaaatacactgctttaccttttgtacctctgtgatatcactttattgtggtttcatttataaattttggattaaatttaagagaactttagaaagctgaaattttttatttaatatttgacaacttgctattttataagccctgggctattacaaaaataaatgtaaaagcccctgctcttcagtctggagagggaaatagacgtgcacaaataatacaagtcaaagagggaaaagtactgcaaattcattgaacatagaaaagctggtctttagccttttttaaaaaggggctgataaaatatagtcccccatgtagtttatccataatacatagcgtgccacttacaagctaaaaagccctatgaaaaatgaggcgttttaactaccaccaccaacaacaacaaaaagcatcgtgagggaaatactggtaaattgggccttggtttgtgagaaacttcagcgcaggcctagatcctgggggaggggagaagaggaacgccttcagtgagtgtcaataatttttaagtttatacttaactactcattaagttctttttgatataagttctttttgatacttgttagtgtttcactttttttttttttttttttgagacggagtctcgctctgtcccccaggctggagtgcagtggcgcggagtctcgctctgtcccccaggctggagtgcagtggcgcgatctcggctcactgcaagctccgccttccaggttcacaccattctcctgtctcagcctccctagtagctgggactacaggtggccgccaccacgcccggctaattcttttgtattttttagtagagatgaggtttcaccaggttagccaggttggtctcgatctcctaacctcgtgatccgcctgcctcggcctcccaaagtgctgagattacaggcatgagccactgcacctggcctagtatttcacttttaatctttaggaacaacatttcaaaatttgttttcagatgttcctttttttatttttattttttttgagatggagtttcactcttgttgcccaggctggagtgcaatggcgtgatcttggctcaccacatcctccgtctcctgggttcaagcgattctcctgcctcggcctcctgagtagctgggattacaggcatgcaccaccacgcccagctgatttttgtattttagtagagatggggtttctccatgttggtaaggctggtcttgaactcctgacctcagatgatccacccgcctcggcctccaaagtgggattgattacaggtgtgagccaccgtgcccagcgttagatgttcttaaaacactgattccttctaggattattttgctagcattcatgattcggagggagacaattctctgaacctgatttaatttggcagtttttattctcacttcctgctagccctttcacccagttgattaaaaaaaaaaagttttagaacagaacagatggggctttctatcagcattgtttagtgtaggtatcttttgttttggggtaaatatcagggagcagctactcttttaacaggaattatattaataaagttttaggctggctttaacagttcttgaacatcaggaacatcttgctttgccagatttcttgttgattaaaagtgcagatttgccatctattaatggaaaatgcgttaagtgattaggcacaagcctgcttatagatgaccttatttatagaacatatgttcacagcttaaaatcttattctgttaggccacattgcatagaaaggtaataatttaaagtcaaaatgtctaaaagacttaataaattagttcttgacacctcctaatcattagcatttctggtggagcacttttctaattggttgaaagcaagtgaggaaattgcaaatcaaagaatggaagccactccggccacaagggggagtaagagattaaatctatgggcccctaatgtgtgacagattatgggcttcttgcatgatttctttttaaaattttaagagatctaggatttatacaaggcccagtgtctctacagaataaaaattataggaaaattatctctgcataagagaattgtacaagaccagaaatttgaactacactatgctgaagagttggaattaaatctattaatgaggatgttattaaaatgacatttgtggggtatttttgtgagtttttaaattgaataatataaactgggagttttacataatttatagatttgtagaaatatgtttaagtatacagaaatttcattgagtcattgaattttagggttaaagggacatctgatctagcctttttattttaacagatcaagacactgcagctcaggggttcagctatttacatgaggtcatacagtaagcattaatatttgtagtctcttaatgtagtatcatcttattgtagattgaaacatgacatttaatctgctatcaagatactgggtttgtagggggggatgaggagttgtcagaataacaaaataagtggctttaattttattgaaaacagtggggtttttttgttgtttgagatggagtttgactcttgttgcccaggctggagtacaatggcatgatcttggctcaccgcaacctctgcctcccgggttcaagtgattctcccgcctcagcttcctggatagctgggattacaggcatgcgccaccacgcccagctaattctgtatttttagtagagatgggatttctccatgttggtcaggctggtctcgaactcctgacctcaggtcatcctcctgcctcggcctcccaaagtgctgggattaccggcatgagtcactgcacccggccgatttttgtttcagactataattagggtgctgtacttactgagaatcacttttgagggctcttatgcctcagttacttgctacctcaaccttttaacttctggtgtgtgtatgctttgtatgaaagcaggcatgtctgtgtcctaatgtctctctcttcatttgttgttttggaagagagccatgacagtacaatctaaaacagaagaatgggttatggaggcttgatctttctcccactcacatatttggtgaggtcatgtcaaagttagcccagctgtattcgcaaatttcaattcataaatgtctcaatagaggttgattgttttgctttgatattctggggggatttgctatttgctaatgacactcgatgtctaattatctttgtgcgaattaaatttaatattaggaccagttggtgaaatactgttttaagacaagatgagaactttctctccaccccacatatttttctttacaaatgtatcattgtttttgtaccatttctgtgttaaatacaaaagtagtatcagccacataaggaaatttgaaaaaaaaaaagcatataaagggtatgaaaaagggtatctttcagaaataaagacaattaaaagggacttctttaaaatgtattaacttttcattttgaaataatttcagatttagaaagaggttggaaaaatatgaagagtttttcatatattttgccagattgtccacatgttaataactacagtataattattaaaatcaggaaaatgattaaagtaaatgataaactattatgtaacctataatcttaattaaatttagcaaattgttttactgtaatttcctgtttctgctccagaattccatccagaattacactttgcattttgcttacatgtctccttactctcctttaatgtggatcagtcttgttttagtctttgcctctaatgattttggaacttttttcaagagtactggctggttattttgtagaatgtctctcagtttcgatttgtctggtgatcctttttgtttgtttgtttgttttgagatggagtctcactctgtcccccaggctggacttcagtggcgagctatcctggctcactttgcaacctctgcctcccaggttcaagcgattcacctgcctcagcctccccagtagctggaattacaggcacccgccaccatgcctggctaatttttgtgtttttagtagaggtggggtttcaccatgttggccaggctgatctcaaactcctgacctcaagtgatttggccgccttagcctcccaaggagtgagccaccgtgcccggcctgtctggtgattcttcatgattaaatttaggttgccagtttttggtgagaactcctggaagtgatatggtgtcctcctcagtgcattatattaggaggcatgtggtgttgtcctgttacttaaccaattatatttagatagtgcattatgctgttaggacttctgaaaacacaccccatggtgcaaaatacccattgaatcttttttaaggtatatgccttaagattatgattactttgtcaaaggttacaaactaaattattttgccaaagtgctttttaaataagctgcctctgtttatactgaataggttgcttcttcaaaggggaaaataggatcccagctctgtaacttgtaattttttttcgaatttattttcattagttggcttcttgtgttctagttggcaagcccaaatctcagcacatagcacggtggtttgagtgtatagtggcaggttggctattcttcaggactgaggtgaatgtacaaatacttaatgattgagttcttgttcataattttggggtttggtctaaggacccttagtttataaattctctgattactttttaagaaaaaaagtgatcttgaatttaaagaaatgtaagggatagtggtggggtgggaaattcattatgttagaggagatttcctggcattggaagggagattttgaaattaatgctgtagtgaaacacaagaagattaaggtgaggaggaggctggtcatagttttgtatttgaaatgcctgtcttgcctcttagttagtagaattagtaccataatctaggacccttgacttcttaacaagtttactctgccttgcaacctcacactctcttccagttctctctgcaggatttttcttaggttcttctttgttcattacatagaaacctggagcttatccatattaggaggtgcttagcctgcccctttgctgctgtttctgaatatatgtgtttagttcagcactcacatattttaaatgagcaatctcttaggttttcagagaagtagaacattgttgtgtctcttacagcagaatattcattattgaatgtagtgtcaacctgaatttctatcaggttttgtcttaactatttaggaatttggtaaggtaatacactcttgatgatgaagactttctgaaaaatagtttttaggatgttgagctattaaaatatcctccaagatagttttaaaatgttttatttaaatgaagctattacagttatgcgtatattattcagtcagggagtttaatatttttgagtgcttaaaatgtgtagaacgtgcctttaatagagcctatgagtaggttaagagtatatatgtgtgtgaaaagttaaaggtgcaaaaccataattgtttgttttatttgagatggagtctaactcattggagtgcagtggcacaatctcggctcactgcaacctctgcctcccgggttcattcaagcaattctcctggctcagcctcccgagtagctgggattacagtcgtgtgccaccacatccaatttttttttttttcccagtagagacggggtgtcacccaggctggtaatctttattttaaattgtacttgctcctaagaatttaggtgttaagagcatagcatgtagaaggaaaaaataaagctgctgtaacctcatcctgccttcttggaggtaatctctgttagtcctttgtgtatcctgggaatttatgtgcaaagtaaacaattctgtccttgaagaataaggatcatatacttagtttggtaaattgtacaaaactacacactttgatgtatatcttatgtttcattttgacaggtacctccttactcttttgttttttggagacagtctcgccctatcgcccaggttggagtgcagatggcacaacctctgcctcctgggttcaagtgattcttctgtctcagtctcctgagtagctgggattacaggcgcctgccaccacacccagctaatttttgtatttttagtagagacggagtttcgccatgttagccaggctggtctcgaactcctgacctcaggtgatccacccaccttggcctcctaaagtgtgggattacaggcgtgagccaccacaaccagcccgtacctcctcactcttaatgtctgtatagtattctattatttgggtatgtagcaacttacttagccagaccctccttttaaaaaaaaaaaaaaaaagatagggtctccctctgtcccccatgctggagtgcagtggtgcactcactgcagccatgacatcctgtgctcaagtgatcctcccatctcagcctttggagtagctgggagtgcaagtgcacactacactaggctaatttttttttttttttttttttttttttttgagacaagtctagctttgttgcccaggctggagtgctttggcacgatctcagctcactgcaacctccgcctccagggttcaagtgagtctcctgcctcaagcctgccaagtagctgggattacaggtgtgcaccaccatgcccacctcattttttgtatttttagtagagatggggtttcaacatgatggccaagctggttttgaactcctgacctcaagtgatccacccacctcggcctcccaaagtgctgggattacaggcgttagccaccgcgcctggccacgctaggctaagtttttaaattatttttagtagagatggggtcttgctatattgcttaggctggtcactaactcctggcctccagcaatcctcccagctcagccttccaaagtgattgtgattaaaggtataagccaccacacctggccgttagtcctttattgacagaaattaggatatttcccttttttctcttcagttaaaaagctctacactacacactatctgtacagacaatgtagatgaagctgaatagctttgaataattagctttagggagaacatagcattagagctaggtatggagaggtatttagcacagattcttttcattttatttttccagctttattgaggtacgattggcaaaaaaaatatatatttaaggtgtacaacatagcagaggttactttaaatcagttgttaaaagtgatatgccgaccactgggagtcctttggggaggtgtctattacatcacaaaaagtcacaactattttcttcctttttttttttttgagacggaggctcactctgttacccaggctggagtgcagtggcacaatctcggctcactgcaacatccacctcccaggttcaagtgattcttctgtctcagcctcccgagtagctgggattataggcacacaccaccatgcccagctaatttttgtatttttagtagagacaggctttcaccatcttggccaggctggtcttgagctcctgacctcatgatccacccacctcggcctcccaaagtgctggagttacaggtgtgagccactgcgccgagccaggtcacaactattttcatggcaaatactgttaatactgattcttatcactttgttgacatttagcactggtgcaaacccaagggttgctcaaacttactggttccttatcgctaatcaaggcagtgatactatactgtactagtgattattgtatttctttaccattatgcactcactgtttcttttaaaaagaaaaaagactttttttttaatgtccttgaatctgaaacattattttattaatagcccttaaatagacatctttcagtgaggcaaaatgggaagtccagtggttgtctctaagaaaaacacttgcagttatttgaattgtgagataaactagctgcttttctttttttatggaacacttttttcttcaaagaactgcaggcagataagctgtgggtattcagacctaggtattcgacaaatatcttaaatgaattgagcctctcactttaagggaaaatgatatttttgacagataaaattgaagctttggagcaaaaatgagaactttggaaaataattactaccaccatgatcttagttttctacttttttatgactgtaaaagtgtcttgagacaaacttttaagccataaatttgaagtattgttaccgtttagggttttttcctagaaaatgtacctatttatagaggtagtatatatgtaccatggttgggagaaataaggtaatattacttaaatattaggaaattatttcacataagagggagttctgagctaaggtggtttttgggtgggtgagtgggtgggttaagatcagttactgcagtacaaacagtacttgaagtctaatgtggttgacactagactttcaccttccaaaaggatggcagcacttctttgttgcttactatttgccagactctgctaaatgcttattatatgttaattcatttaatccttacaacaaccttgtgcattatgtctactactaatatttgccttttacagatgagaatctgagacccaggaagatttcagagttttgtcaaggtgacagagtttgaatttaggcagtaagcagtctgtctccatagtttgtgttcctaacaagtctgttgtttaaaaagagaaaataaatactaaaggaaatgttctttttttcttttgttcttttttcttttgttctttgatatgtcttaatcctgtgtttttgaatgaaaacttttttgcatcctacttcaccatttttcctagttatacaaattttagattaccaaagccaaaatgatgtacttaagagtacaagagcactaaagcagatttttgaatgtcagaatctccatactttattttcacataactgagcaaccagtgagtagaatgcctactctcggttgggagctgtgaatggtgccctcctgtttatatgttcatttagacctcataacagccttttgatgtggattttcatatagatgagaaaataaagattagctattgtgtaaattctcaaaattaatgggttagggtggaatttcaagtctgcctggttttagagtttatacgatttgcattacatcaagcttttcttctaacaagtgttgaatgcccgaaaggttaaagtcttgccaccagctcaggcagcagttttggtggtttaggggtaatcatactgaaagaccagtgagaaaggcatatcactagagatagattctcagttcattaacttttcattaggaatatttgactacaggcaggagtgagtgtttataaaattcatattagtgggatcaggttgagtctatgccaagaagggatcagaaacagatgacctgtcaatttatgtggttccttaattttaatagacttaattttaaagacaaaacatcattgtaaatatagactatctttggattaaggcatcttttggaaactggcttgggaggaaaaatgttatttgaaccccatctcttggaagtgttttcacaatctaagaggttaattatactacggtgcagtagagagaaaaatctcttttatctctaaaatctcaaatttcatgtaatttacctgttggttaggttaaggattagtgtcctctcttcagagcccatatcacatatttaactctggattaggagctgtttaccaaagagtattagataccggcttcttgtggcattttgctgctgagtaaatgatttcttatcccacttaatattattagggtgaatgctgtataaatgcattaactctaattcagcaaattaatcttgggtattttctaaaatgttggccatgatatctttaaaagacagtggctgtcatgaaaaaacatatttaaaagttaatgggagcagggcaagctatgatggggccactgcattccagcctgtgtgacagagcaagacctcatctctaaataaaaattaaaaaaattaatgggagggaaaaaagtaaaacttacatccacattttgaagtaaactgaggaaatactgtggatttctaaatgagattatatttcaggaagattcaacagattaacatttagccttgatttagcttgagtgtaggatgtgcttgaattttgtttgacctcaaaaccatttagatttggtttaaaaacttaaggtactgtgataattgaaaaattttacaagttgaaccttcagtcaacctagcccttgttttacagttggagttggctgggcgcggtggctcacacctgtaatcccagcactttgggaggctgaggcaggtggatcatgaggtcaggagttcaagactagcctggccaatgcagtgaaaccctgtctctactaaaaatacaaaaattagctgggtgtgatggcatgtgcctgcagtcccggctactcgggagactgaggcagaagaatcacttgaaccggggaggctgaggttgcagtgagccaagatcacaccactgaactccagcctgggcgacagagcgagacttcgttctaaatacggttgaaattgtgacacttagtgtatacttccttatattatggtgtgcccactccctcccctttttacttcagactttatttcagtcatgattgctttcattgtactattgtaggtgaacgaaatttaggaggtttatttctgtgttgagcaggatattctctgaagttattgcatattttgaaagtagctatcagccctttcctcccttccattctctacttggtgcacctccatgtttttttctgctttgttgtaactgctgcttcctttttcttttgttcttttattcatttttttctattcttcctacattgggttttatcttctggcttccaaatctggaaaacttggatttgttattcttcggtcagtttgacaaagcaacatacttaattgcctcttttatgttaccattaaattaattctgtgaactctgacttcccttagaattgaaaaagaccacgtgtacaaaaatccggttagatagtagaaataagttctagtattcaatagtacagtagggaaattatagttaacatttatttattctaccaaagtagctagaagaattgcagtgctcctaacacaaatagaagatcaatgtttgaggccaggtgcagtggctttacgcctgtattcccagcactttgggaggctgaggcaggtggatcacctgaagtcagaagttcaagaccagcctggccaacatggcgaaaccccattggtactaaagatacaaaagttagctgggtatggtggcacatgcctgtaatcccagctactcaggaggccaaggcaggagaaacgcttgaactcaggaggaggaggttgcagtgagccgacattgcgccactgcaccccagcctgggtgccagagcaagactgtctcaaaaaaaaaaaaaaaaaatcaatgtttgaggtgatggatatcccagttactctgatttgatcattatatattgtatgcatgtatcaatatcacatgcacccccaaaatatttacaactattttgtcaattaaaatttttttaaaagaaacagatgacatcttctttatgaatctcctctacaaaatacctaagttaccctctttagtttcctgttttacctttatgtgaaaagagggaattcactgagcaggttccagtactggaccactcataagttttctcatactgaacagaaatcttccctcttgctaaatttaattggtcttgtctcttggagccattcatgtcctgttctttccattatcctgacagtttctagtatactcgccataactttgattcctgattgtggaataacgtcctttctagtaggtatatcaccccattgaggctgagaatatgttcctttttttttttttctttttaagacggagtttcactcttgttgcccaggctggagtgcaatggcgcaatctcagctcactgcaacctctgcctcccgggttcaagtgattctcctgcctcagcctcctgagtacctgggattccaggcgtgtgccaccacgcctggctaattttttgtatttttggtagagacgaggttttaccgtgttggccaggctggtctcgaactcctgacctcaggtgatccacccgcctcagcctcccaaagtgctgggattataggcatgaaccaccacacctggcagaaaatgttcttttatagttagctttttttgagctacagtgttagcccctttaaatttaatctttaatccagtcttgcttggttttgggtttttaaatcttaattagcttatgtcattggacgatttattagaagtaggccatttatgcctttctcaactctttttttttgagacggagtctcactctgttgcccaggctggagtgcagtggcactatctcagctcactgcaagctccgcctcccgggttcacgctgttctcctgcctcagtctcccgagtagctgggactacaggcgcccgccaccacacctggctaattttttctttttgtagtagagaccggggtttcaccttgttagccaggatggcctcgatctcctgacctcgtgatccgcccacctcagcctcccaaagtgttgggattacaggcgtgagccaccatgcccagccacctttctcaactcttatggtcagcatctcaccagaaacacttgccacttgtttggttcttttggtctatcattaggccagtaagcagcctgactgctgtttacccagccctcctgttacttgtgggttctaacaaatagctttaaagttgttttatggttaattcagtgttcagctttggggaaagaagtgcttaactgccattttaattcccagggaactgcttagttcagcatattacccaggtagaaagttactacctacaaaagatagattactacttttagtagcatttatcaacacctttcctaaaaaaatttaagtttttagtacagctttaaaattttacatcttaagtgactggttcactcttaagtaactgcatgtgtttatggccttcatctctgcatacatagagggggttaaagttaccgaaaagtgaaagacgtgattaggcagtgttactctttttgagacagcctcactgtcaccctgtcctagagtacagtggtataattcaattacagatcactgcagcctcaaactcctggactcagatgatcctcctgtctcagccttccaagtagctgggactataggggtgtgccaccacacctggttaacttttaaatttttttgtagaggcaggatctcatgttcaccggggtggtctcaaactcctggactcaagaagtgatcctcccacctcagcctcccaaagtgttgggattacaggagtgagccaccgtgccctgcaattcttgtaaagtgtattgtaatggaaggaatgatagccttgtctctacagctagattatgaattaccagaatattgtgcttccagcttctagcatggtgtctggtgttattgtgataatagaaataaacatttaagtgcttactcctaagtgcttacctgtattttttctcaataatcttagaggtctctgccttacaggtgagataactgaatcattgagattaagtagttcacacggtgtatagtgctgtaattcaaaaccagactcaccccaaagccacttatgtttataccatctcccatagttgaatgaataatacaatttgtgtaacaatgaaacttttgaaaatcctggtcatttgtttcttaaaaccattgtttttaagtggaaagactcacttgactattttaaatgcaagtgtcttccactgtttgaggcagatctccacagagcaaccataggtggtaaaaagcattgtattcaaaggacaaaacacttttgcagctaagagaactttgaatatgaaagtatgaatgtggtgtaagacagaggttgctatcctaaccaaaacgttcttctgatttccggccagtaattttattttatttttatttattttgagatggagtcttgctctgtcatccaggctgcagtgcagtggtgcaacctcggctcactgcagcctctatctctcgggctcaagcagttctcctgcctcagctgggattacaggcgcccgtcaccacgcctggctaatttttgtatttttagtagagacagggtttcaccatgttgacgaggctcacctcaagtgatcctgccaccctagcctcccagagtgctgggattactggcatgagccactgtgcccggcctcaggccagtatttttaaatatcggttaataattgcaggaaacatcatttcaggttgacttttctcacctttaacctctttatatagcacagtgcaatctggccctactgccacttcatctgggttatctgtagcttgagttgtaaaaaaaaaaaaaaaaaaaattgggggaagaagttgggttaaaactgttcacctacccagcattggaacataatgggtaaacaaaaagttggagttaccatttaaaagcatttttcaaatttatattttatatataagtaggtgctatataaactaatactttttttttgtaagaatggatttggaatttagctcagctgaaaattgacttcaccttgattctcagagtgtacttgaactttaaaggaagtggggtagtgagaatgggtggttggggtttttttgctttaatgtttacctaattctactactagaattatttttctcccccttaactggaaagaaaaaaattacacatttattgagacttcttcccatccccaacacaatgatctaatctttttgctttaaaatcagttaaagagtgtaatttttaaaatcctaatcaaatgactcagattgtaatagtagttttagacagaattttataggatgatgttttaattttatctgttgtctgggatgatctgtaatcgtgtatcttactagccgaaaatgacttcaatgagattaaaggtctgctctttaaaatctgtaagtctcctaccactgtctttaggaaaaataaaacttttgaacggtttttttatctgttgtgaggtttgcttgaattgtgttgttataaatgaagtttattttgttcctccttctctggcatggactccttaagtgtcttacattattggtttctgctttagtcatttctccagagtcccaaaaggttcatcccgtatgttctttctattttcatgtcatgaccacatgaaacttcagatggaaagcttgccagctcattagaaaatgttcctaaatgtgaacggtcatgccccacattcatgaagtcagcatgtaaatagataacattgtcagggaccaatgttcaattttattgtcctcaaataataaactgaacactaacttcaaacttaaaatattgctgcccaaagcattctgctttaaaccacaaattcatgtgccagctgcattcacaattgtattgacagtgactgggcgttaaagttttataacttaggctatagtttgttctttaagaaatgcaagttctttcagttttgtaaatgttttattctcactatgtctgtttcttttcttcttaagtctcttttggaaaagttcttgatccccaatgcttcacaagcagagagcaaagtcttctatttgaaaatgaaaggagattactaccgttacttggctgaggttgccgctggtgatgacaagaaaggtatgctgtttttaaacctgttggttgaacttgtataagataacatagtgaggaagagtctctgaagcgtacataatgtcttgttttgaattgcttagagtgccgaataaggagtagcagtgctctttgtgttctgagaatacacatctactgcctcatactgctattctaaaataaatgctttctgaaaagccaatattgtgtacagggatgttttttcaagattttaagaaaagtgaccagcctgagcaacatctctctctacaaaaaatattttgaaaattagctgggcatggtggtgcaagcctttggtcccagctaatctggaggctgaggtgggaggattgcttgggtctgggatgtcaaaactcgtcaattttttaaaaacataacaataatgagattataaagttgttttatcttgacattgatcaatggctagtgtgtaccaggagaaagctccctttaaaaaaaaaaaaggaccttgttcaattaacaaatattaagctgttacaggttagtatttcaaaggatatgtgagatattaaaggtttggtttgaggggtgaagatataatgcacactttatctcagtacgttttggtgtgtcttatccagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagtatgtattttacctgttacgtagaaatttagcagtctttattatttgagcactgaaatgtaatgtactatttttaaatcgtaggcttttgatgaagccattgctgaacttgatacattaagtgaagagtcatacaaagacagcacgctaataatgcaattactgagagacaacttgacagtaagtacataacagcatcattagtgatgaatgtggttgaagaggttatgttttactctagggaatttttttttttattaaatacatcttttaaaattttttctcaacacatttcataggctctcataaatatatctcagctactattaaagtcctatgaaggaaaattacagaaactgaaatattagactgagaactaaaaaatacacacattgatgagttacctgtcttgttaaaatttgttagtatcaaaagtgtgctgagactctacatgttttagttcctttaagaatgattttcttgcccatcaagttgcctccatattggtaaagataatggtagggaattaataacttgagttacaaaatctcaggtatctacagaatccaagtggaagtctattttgcctagcttcttattttaaatgacttaatatgaaaggtcgtgattgtccttgggatactgcagatgtataaaaagaaacagtgtcactatcacaccaggaacatcaacataattccctaataatgtttgaatatctaaataatacttgaattccaattatctctctttttttaagttatttgaattgggattcaaattcagtccacaatgcagttgatttgtatgtctcgtttgtttcttaggtcttctcattcttctccttcagataaatactagatttgaaattttgaggcttaggtgaaaaaattatcaagcatttgctgtgtgtcaggtaaagaggtaggaattgcagatcataatctaggtattactgtttttttgttagacttctagggccatttctcttggggactatgtaatctcattttatacatttctcttccaactttattctagtccactgccattttctataaaccagttctatatgctagtgctgaaaatcttgaagagttttttgaatagtattgtatacttgtttattaaacctaaaattactttattagcacaatttggagctatctataaacttttctgatacttgagtcaagataacaagccacagtaaagaatgaaagaatcttatatatcaaacataagaagcactttgttaactaactttagtattaaggatttttcttttctagtttgaagtgatgacatttttaaagtgatgacctgagacctagatactgtgttttgttcacatcactttttgagaggccctgatctactgtctgcttccaactgaattttgctatcagtatagcatgaagagcgcatattgcaataagaaaaccagggttggccgggcgtggtggctcacgcctgtaatcccagcactttgggaggccgaggcgggcggatcaccaggtcaggagttcaggaacagcttggccaagatggtgaaaccccatctctactaaaaatacaaaaattagctgggcatagtggtgggcacctgtaatcccagctactcgggaggctgaggaagagaattgcttgaacccgggaggcagaggttgcagtgagctgagatcacaccgctacactccagcctgggcaaaagagcgagactctgtctcaaaaaaaaaaaaaagaaaagaaaaaaccagggttttgattctaattctgtcactacttgtatgtcttctctgagccttattagtgtcagctgtcaccattataggttgattggaacatttatctgtcaagaaaagaaattatcccaaaacttaatatttcattctgaatttggttgaccaagactgtcaacacattactctagaaaaagaaatattttgtatcaaatttgcatgtttatacagaaaattcaagaatccttgaaagttagaacaggaaagagacattagaaacaatttcatcttgcaattacaaaaccccttgtttgacaggaggagcacacagtttccaagaggtcatttggctatctgtatgaccttggaagtagtctcctttccaggccagagatatatttgcttagtagataaatgaagctaatggatgatttggggaatataaaaataataattagtgtattttccccttcccctccattttcatgtgtaagtcatatataaaatttaagattgtcttgaatccttttgtaattacctctgaaaatcactagagagtggttaagacttcaacatttttaacattggagcaggtggaatagagttcataaccctgccacctatgggacaactttcatttttacctgttaaaagatttggttctggtttttgtccagcatttattttgaatcatatgatagggtagtgcaaaagtaattgagggttttgccatttaaagtaatggcaagagctgcgattacttttgcaccaacctgataaataaaggtttgtttttctaagcttaaagtgttagaaaagctagatttgtagtttagctcagagttgaggctggttcttgaatttcatggagtataggattctgtttggagtgtgagtcactttaagatctaccagtggagagtagtcaaccctagctccttcagcatgggccaaattagatgcttctggtatagttgcactcaccttggacgtccatctttcatattggggctctttaggttctgacacctattgatgcttagtttttaaaaaataatttagggcctgggcacagtggctcacacctgtaatctcaccactttgggaggccgaggtgggtggatcacgagatcagatcaagaccatcttggccaacatagtgaaaccccgtctctcctaaaaatacaaaaattagatgggtgtggtggcacatgcctgtagtcccagctactcaggaggctgaggcaggagaatcgcttgaacctgggaggcggagggttcattgagccaagatcacgccactgcactccagcctggtgacagagcgagactccatctcaaaaaaaaagtattatttcttgtaatttctcttcaccttctgtggataaccaaaactttcctgtatttgaaggttatttgaaggcaactctgtggtgtacttaacctgcttatatagtggttacaaaaaaagtaaatttgtatattgagatgtttttgtatcttgaagctaagtgatgctgctatctttttaagaatgctttccaactaaaacattcaggtatcttggcacttatatgaaaacgcccccccccccccatcccactgaaacttgctgaaaaatctttccttcttttaccagttgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaccttggggtctttatttccaggagaaaagataccttctgcatctagggcaacaatccttttccctcgcagctctttcttttacctcacttactgatttctcctgacccccaagccaaggaggtaaaataattatatatatatatatatatatatatatatatatataaagtaattatattttatagctagactgaagaggtgggaatttttttgttgttttttttttttttggagacaagagtcttgctctgtcacccaggcttgagtgcagtggtgcgatctcggctgagtgcaacctccgcctgctgggttcaagcgattctcctgcctcagcctcccaagtagctgggattacaggtgcccgccaccacacctggctaatttttgtgtttttagtagagacagggtttcaccatgttgtccaggctggtcttgaattcccgacctcaggcaatccgcccatctcaccctcccaaagtgctgggattacaggcataagccaccgcgcccagtagagatgtgatattattcaagtaaataaaacctgaaacttggcacatttgcctatttaatgtgcatcagtcatctgaactaggttgatcctggaataatgaaaacacttcactagtattaactaatgttttctacatagtagttcccaatagattaaggaaaatttccaacctgagattctttgttttggaatttgaataatgtgtttgtaactattccttgattgtcccaaatccaggctttacgtctgcttttgtcaatgtaacatcctagtgccaggaaattggaaaatccaatgactttttgtgtgtaaagtactggaatttttttgttcgtttgtttttaagacggagtgtcaactctcgcccaggctggggtgcagtggcctgatctcggctcactgcaaccttctcctcccaggctgaagtgattctcctgcctcagcctcgcaagtagctgggactgcaggcatgtgccaccactcctggctaattatttgtatttttagtagagagagggtttcaccgtgttagccatgatggtctcattctcctgaccttgtgatccgcccacctcggcctcccaaagtgctgggattacaggcgtgagccactgtgcccaccctggtatgttttttttaaattggccacttaagagttgtccttcagaaagtggagcagcagtgtgattagtaaaaacgatgggctttcctgcagctctggcttatggtctttgtttttccagttaacagctgttacttcatgctgttatagggggtggggggagaaagagaaagaatatgtctagtggcttaattttggggctcaatttgtttattatgtttttcctgcaaaagagtcaccagtcttgtcatggctcaatgcatattttaaaatgagtcaaagccaatttggaagctgctatcttaggttatttgtagtcaggcttcaaatggagagtgaaactttgactttgaaaactggtgctctatgctcaatgatggtcttacacattcctctagggaaaggtcaagaaataaatttggcttgattgtattctctcatttaccatataggaaatactatggtagaactgaaaatatgtacaatagtaaagtggtggctgagactgggcacttggaaaatagacttggattctaagtgtgaaactaattaaatacttttatgtgactggtagtagtcacagtctccttgattgattctagttccttttcaaagtggagagacctgaatatagattgtaacaggatgtccaaccttgccagacaagcaggcatatatgtctctgggatgcagaagcagttacaagttaatatatttaagcataatgttagccaatcctaggtgataccagagatgtgaatatttgatcatatttgagttcattccttgaaagtccaaacctaactggtcttaattgattacttcttagtattccgaattttagaatttaaaaccctatgaatt

SEQ ID NO: 14934 - DNA, 26769 bp, Human
  misc_feature (1)...(26769): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgttttatttttaacacattagaacattgccctcagctagagtcacaattttgggcttccctgaaaaaacggaagattttgttctccttaattaataatggtaattaatgatgatttttaactgaataaaattgcaggactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaaggtgagtgttgtgcttgttgcccattagatactgttgtcagtaatactcccagttccttatttagggggcagttgggaagtttcgcagatcttgaataatttagttattttggtgatggcatcctagatgtcctttattagttgtattccagacaagatattattaaggctgctgtacattgtgactttattatgaagatcgacactccgccgggcacagtggctcatgcctgtaatcccaatactttgggaggctgaggcaggcagatcaccaggtcaggagttcaagaccagcctggccaacatggcgaaaccccatctctactaaaaatacaaaaattagctgggcatggtggcgcatgcctgtaatcccagctactcaggaggctgaggcaggagaattgcttgaacggggaactgggaggcagaggttgcagtgagccaagattgtgccactctactcctgccatggctacagagcgagactccatctaaaaaaaaaaattaaaaaaaaaaaaaagaaaattgacatcttggattcacattatgaataaaaagagcttgattaatcaagttttcagcactgttgttgaatagtgtactttatatccatatactctaaacagttgtattttatgtcaatttcatcattaccagtataaataaaatgttctgagtctttttatggcacttatctaggctataaaaggacttgaggatttaggtaatggtgtcagtgtacaaagtagcttaaaccactattcaggccttattacccagtccttagaaaatatctgtcttagaggccaggtgcgttggctcatgcctgtaatcccagcactttgggaggctgatgcaggcagatcacgaggtcaggagattgagaccattctggctaacatggtgaaaccctgtgtctactaaaaatacaaaaaattagccggccgtggtggtggcgggcgcctgtagtcccacctactctggaggctgaggcaggagaatggcctgaacccgggaggcggagcttgccgtgagccgagattgcaccactgcactccagcctgggtgacagagtgagactctgcctcaaaaaaaaaaaaaaaaaaaaggaaaatatctgttttaggatgttgaatatgttaaatgttatattgaattttaaaatgattttttaaaagtcagtataggatgttaaaactcttcagtatgtttcatgggactagatggccagaaaagaataaagacagctgttttttaaaaaggtttccagaaacattagttgtaaagaattttggcattacccattttccttacattggtttcagttggttacagtaatgggaatctcaaaaagtgatgctagcaaaatttgtgacctggggttatttgggatgtagcataataaaatctcatattttgaattaatggattgagggttaaaaaagattttgaatgccagattgactgattattgagggaatagcagttggttcgtattactatttagaataaatttaacaagactacctctttgaattacatcttgtatgcattgttgcagttgttgagtatctggtacctcaatatagcttgagattggatgcacttaatttattcttaaattcatgtctcagtggtttccttaaaaaaaaaaggctaaaacattgaatggagttgtactttaaagtaaggggtacagctgggcacagtggctcacacctgtaacccagcacattgggaggctgaggcaggaggatcacttgcccaggaattcgaaaccagcctgggcaacatggtgaaaccctatctctacaaaatatacaaaaaatgagatcggtgaggtggtgcgtgcctctagtcccagctacacagagcgctgaggtggaagaatcacccgaacttgggaggtgaaggctgcagtgagctgtgatcacacactgcagtccagcctgggcatcagagtaagaccctgtctccaaaaaaaaaaataaataaataaaataaattcatggatctttttgtttctgttggacatactcttctctgtctcagccgtaatctaggaagacctctacagacctcaagaactctctttatgcgtgcaattccatcctttctggttttctgccttgcaacttgaaaccaccttggcttccaggaaagaccctgggctctgtttgagctctccctctctgcactgaggcttagaaactgtctctgagcagtaagctggagcagtcacaggactcatctcatttgtttcccttcccgcagggatcacaggcttgcactgcctcttggtcgatgtcttaaaatgtgttgcttcatccctgtctggtttcctagttgtttaaagcaggagggtaaatgtggtccctgatacaccactgtggtataagtggttgtctgcctttacttttaaattagaattccaaggttctatgtatttttttttagagaaaatggattatatttattgtttctagaggggagcatattttaaagattttatctccctgttttagagagtgagaattgtacttctcttattttaaatgcagaatgttactttggatcgcctctgtgtataagtataactgctaggcttttaccagatggcattataaacccttggcatttacataatatattttttcacaattcacagcatattaaaagttctgagaaatctgatagaggaactcatttatttgcttaatccagttctttacaagttcatttgactatggaatccccttgtcatctatacctgttaacatcatacagtatgctttgaaaaatagtcctaagagttaacctttttttccccatggtcttctttaccattttaatggctgcatagtgcagttttacattaagggtgtgaactatagaaccatttcctaattgggatttttttttacttttttttgagacgaagactcactcttgtcccccaggctggagtgcaatggcgtgatcttggctcactgcaacctctgcctcccgggttcaagcgattctcctgcctcagcctcccgagtagctgagattacaggcgcctgccaccacgcccagctaatttttgtattttttagtagagatggggtttcaccatgttagccaggctggtctcgaactcctgacctcaggtgatccactagcctcagcctcccaaagtgctcggattacaggtgtgagccactgcgcccggccctaattgggatttttaagccattccaacattgccactattgagtactacagcaatgttcagttaatacatgtagccttttctgtatatcaaactattactatgttagtattgtatattatagtaaaatatagtaatatatcgtactatatatctatatgttaaattataatatctataatcttattatagatttctaaaggtgggattattgggccaaaaggataaaatgttttatggctgttaatattacctaattgatgttttaaagaaatcttttaattttttatcactgataatccaaaactatcagatttgggtacaccagtattatttttggctgctttattaaggggaaaaaagtgtgtcattgttgataacatcagttggttgatggatggagaagctgcatgaatctttttctcatagtcttaccagacttcacacttctatccactaaacttttcaaataagttaatggttctcaatgtagtagattaattaattaatatctcggattgagacttcacatactttggtagaaatttattactcttatatcctttgtcaattttgacttttttgaatacctttttttttaagttataactttgcctattataactccttacctccatttttaaacagtgtgactatgaaaatgttccaaccactgtatttactcctttggaatatggtgcttgtggcctttctgaggagaaagctgtggagaagtttggggaagaaaatattgaggtaagttcttttcctcttttctcctatgttatatcactacttttttttcttcagaatttaaaatatatagaagacttaaaaaatagtacaaagcattttcatatacccgttatccagattcatatattactaacattgtgccaatttattttatacatttttagtagtctctcattctgtgtgtgtgtgtgtgtgtgtttctgtgaatcatttgagagtaagttgaattctcctttacccctaaatactttattgtgtatttctatgaacgagggcattttcttatatagccgtagtgtagttaccactttcaggaaatttggtattggtgtaatatttttatctgatttaattttcattttctaattctgtcagttgacccaatcgtatttccttttactttttaaaatcacatttattgatttctctgggttaattataggaaaatgaaaagaaaaaataaaaatttttcactgctcctaccattagtactacttgtttctagcattactctctaatttgtactaacttttctgctcacattttatcatggagtcaaagaaaatgcacatgaaatacactgtttctgtatacacaaataatgccacccaaaaggactgctgttttaaatcattttagggaaaatttccaataaaaccttttgaaagaccaaatttgtgaataagtcaatttttaaaaataaaaagcctattttaaatctcttaataatctttttctttattacatgcactggtagtagcatgtaatatgttggtctattagtaacacattattaacctttttttctgattataagaatagtatatctggctggcatggtggctcatgcctgtaatctcagcactttgggaggccgaggtgggtggatcacctgaggccaggagtttgagaccagcctgaccaacgtggagaaaccccatctctactaaaaatacgaaattagccaggagtggtggtgcatgcctgtaatcccagctacttgggaagctgaggcaggagaatcgcttgaacccgggaggcggaggttgcagtgagccaagattgcgccattgcactccagcctgggcaacaagagagaaactccgtctcaaaaaaaaaaaaaaaaaaaaagaatagtatatctttattataggaagtttcaaaattaggaaaatatcaaaaaggaaattttaattcatgaagagataactgctattaatatttttgtgtatttccttccagtttctttttctctaaatattttgatgcgtttttatattttatgtatatatatatgtgtgtgtgattttgtgtgagtatgtatgtcttaatgtttttcaaagtttgatgaagttacagttttaggtccaagcttaatattaatgttatgtcatgaacatttcctgtctttaattctctaaaatctccatttaaaaaaaatgtgtaattcttcttttaaggggtgctatactgtaatttgttaagccattctttgattaggttgtttacagtttttcattattataaatagaattgacatcttcataattcattgtttctcagtttattttttgaagatagatttcctgtgtgagtgtgtatatacatgacatacatatataattaaaatttgaaatttttaatatatatttcatatttcttgatagacaatatttaagttttttaaaatttgctttgttattatagaagtataacgtgtttgagttgaagaaactttgaaaaatgtaagggaaagaggaaacaattacttatggagttagagctgtaacagcaattgttagcaatttggggtgattcctttaatttttttcctatataattgtgatactatgatactgtacattaaattttgtaacccatgtttatttttaaaattatattatttatcacaacatcgaagaacacttgttatgtcttcataatcagtttgctcgtaaaaggtagcgaatcatgttttgaactgaggctagcagctggaggaaaaaaaaaatccatttagtcaaccagcaattaaattagtaaggatgctgtcgttccacccttccttcctcctttccttccctatctccttccttctttccttccctatctccttccttcattgcttttagtgaataatgccaaaggaggaaatgtcttttggaagcatttagcaagagaactagataattaccttaattgatcctggcaccttatttgtttcttgcccaagttgtcattcacagtggataacaagatagtattgagtttgggtgtgtgtgtgttttcaatgtatgacagcaggtaattaaatggcttatttctctcattcccttgctcttttttgttattagttagggtgtactattttgaggtagagatatacataattaagggatgagcttatagcaaaagtgcctgacagcaaggagttgaaagtcatttaccttttgaccagattcctatttattccatgaattttattatttaatgaaagtctacttattaaagagtctctactgtctttcaccatatatgtttgacagacttaatgtttaaaataatgggtctaaattttgcttttgtatcttcttaggtttaccatagttacttttggccattggaatggacgattccgtcaagagataacaacaaatgttatgcaaaaataatctgtaatactaaagacaatgtaagtttaattctcaatcctttccagtaattttatttagttgttgttttttgttgttgttttttttttagatggagtcttgctctgttgcccaggctggagtgcagtggcgctatctctgctcactgcaacctccgcctcccgggttcaagtgattctcctgcctcagcctcccaactaactgggattacagacttgcgccaccacactggctaatttttgtagacgggggtttcaccatgttggccaggctggtcttgaacacctgacctcgtaatctgcctgtctcggcctcccaaggtgctggaatgtacaggcgtgagccaccatacccggctttagtttttaatatatagcttagttggtcacatggtgcagatggcattccttcagtatttcgcgtgccagttgtctcagctaatagatatcagcagctggcaaggaccttggctgcactgcctgctgccccctcatcttcactggcacagggccctacacttagtcaacaggcagccaaaacttactgagtgaaggaaccaaaggcacaacttgagaactgtctatgtttgtgtttatagaagaggaacaataaagtcatcgactatctaaatataatgaataacaaaaaagaacaggagcaatgcacgtttgatcctcagcagctggcactactaagaaagagctcttaattgagttctaagatttcattgcctgatgctacatgtaatgctagtctggtgttattacgtgtaaatctaatgtattttaagtgctttttagtagtcctcccacagatatactttattcataccataaacccccaactgtccaggtgaataagagtacaatatgcaatatattacagtcctttttttttttttttttgagacggagtcttgctctgttgcccaggctggagtgcagtggcgtgatcttggttcactgcaaccttcgcctcccaggttcaagtgattttcctgcctcagcctcccaagtagctgggattacaggcacccaccaccatgcccagctattctgtatttttagtagagacggggtttcaccatgttggccaggctggtctcgaactcctgacctcaggtgatccgtctgccttggtctcccaaagtgctgggattacaggtgtgagccactgcgcccggcctattacagtacttttttagcagaaacctgtgaaagcctgtgagcaaactctatacctcacagggtttttttccatatatatgaaatgagggattggataattcatattttttaaagttttttgactgtgggacactggtatattcatatacacacactctctttaatattgactcttaagaaaactgatctttttaacttagctaacactttttaaagaaacgacctcagtaaaaatataaatgatgttaaagaatctgtatgttaaaagcctagtaaactgataatgttttaatcttgaaatttgaatataattaagccatgtatcctatttggaaactactgctttaggcagtaggacagttacaggttggttttttggtaaaaccaagggttttagaaaacattttcttgaatcctctgcaaaaaagattcaaatgaatatactaggataacccataatgagctacacagctaacataaataacaattgtatatatagttgtctttttctttttaggcaaattttctcaaaagtttatttatatgagtatacattagatatcacttttactgcagacaaaaggagaaaatgtcagccattctcactggcagtatattaactgcccctgtctcactgagagagacttcaattgctcatagcagtcagtgaaaccttgaaggtttccttcctaccaagcaaatccattttaaccatatgtattttgctcttttttcaatgttacatttgttcaaatggcattgctagaataatgtggaaaataattttcctaccaataaacctgtcagtagttgaggtcataagtagggtgacagtgttttcggttattttcatagataaagatagtaatagagaagatgaatatctgttactgctcttttgtcatgagtaatctgaggtaaaagcttgtagaacttcactatccctggggcgtgctttattcattttgaatcagtcacttgacttcagtgtctaaatgtccttgattctaaattgtacttacaatgtttattatctgctggcttttgttctctgctattttatttttttttacataaaatatttgtaataaagatgaagaaggtactcaccatccaaagtcaaggaatgttaacatttttgctgtatttgtttcagggcttttttcttataagagataaaccatcatatatgcagtttataacagcttatatttattgagcacttactgtgtaccaggcactatagagctctacaggtattaacttatttaatccttacacagtcctgtgaggtatatatgctattgtttccccctttttatagatgaggaaactgaagcacatggaagttaagtaactgtgctcaaatcatttacctagggaagggcagatctgtacatttattctcacacaatgtagataccatgctattaactattatcttatgcctatgcagtcttctgtcttccttcacttcaaaaggtaaaactttgaagtcgaagggtctcatgcttacgttcttatgtttgccacctatttatgaatgcatacacattatacagtgttcgtggtttaattgcaggtggcatcctcattatgtagagctctgcaactttttaataatctcttgttttttgagaccctttccacattattacatggaaatctattttaagtgctttttaatagttcctcctatggatacgctttattcataccataaacccggaatcgtcagggcgaatatgtgtaagagtaccatatgcaatatattacagtccttttgtcaacagaacaacctcctgattgtttccagggagtgatggaaccttagacaagctctgcaccccacagcctgagttgcctcatctgttatgacgagattgcactagatagtctagtcagagtctgcgctgaaaatctatcagctcaacagtagagtgcatcagatttctctgcttttggcagaggtagccagagtttgagatttcaaatttatccaaaataatttctacacaggtattttagagtgccagacatttttcttttgctttcaaaaatgttttcagactttgctgggcacagtggctcacgcctgtaatcccagcactttgggaggccgaggtgggtgaactgcttaagctcacaagttcgggaccagcctagacaacatggcaaaaccccatgtctattaaaaacaaaacaaaacaaaaatgttttcagactttaatggtcttgcactatttatcctcaaaaccttatttaaaattacttttaaaattttatttgtattttattttttagagacagggtcttactttatcacccaggatagagtgcagtggtgtgatcatagctcactgcagcctcgacctcctgggctcaagcattcctcccacctcagcctcccaagtagctgggactacagatgtgagccactgtgcccagctaatttttttttttttttttttttcctgtagggacagagtctccctatgttgccaggctggtcttgaatgcctggcctcaggtgattctcctgcctcagcctcccaaagtgctgggattacaggcttgagctatgatgcccagtcaaaattttaatttgaatgactactcttaagggtcccagctattacagatagcctctgtggagctgagatgatcaaatacaggacgtgaggacaccctgccctttgataatattttccagaacattttggtgattaaagacttgtaggcatctttgccttttgtattttttctcataaaattgagtaaacacttgtagctgtcccttgtctctttgttcctgtttgaagtgaacatcatactctatgttttggttcatgttggggagtctttagcctaagtagctgttagcagcagtcattaaagtctctggccatttttccaggtgcggtggctcacacctgtaatcccagcactttgggaggccgaggtgcgtggatcacctgagatcaggcattcgagaccagcctggccaacatggcgaaaccccgtgctctactaaaaatacaaaaaaattagccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggagtctcgctctgtcgtctaggctggagtgcagtggcacgatctcggctcactgcaagctctgcctcctgggttcacgccattctcctgcctcagcctctcaagtagctggaactacaggcacccgccaccacgcccggctaattttttgtatttttagtagagacggggtttcaccgtgttaaccaggatggtctcgacctcctgacctcgtgatccacctgcctcggcctcccaaagtgctgggattacaggcgtgagccactgcgcccggccagtctctggtcatttttgagttggatttttaagaaacagactggagaaatgctctaagctgtgtaggaagaggaggggagaaaaatcagcttaattgcattattgtatttttttttgccttaggaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtgggtcatctacacttatacagtttaaaatgtttaaaatgtgccacatagaagcacaccacccagcttatacatggcagatgtaggaccctgagtttgatgatgattcctcagaagagggctttgtctctaaaaattagtttttgtctttcaatactgattgctcatggtatgaactggaggcttccgtcatgtcgttaagtggtaaaaattatgagagtgatttatagagctgtgccttaaatattttatttatcatatcttctaaattattttcatggcaatcagttaatgatggaagagcttcaatcttagttattccacagctatcttgaggctaattgatactgtctgcctcttcagcttatggtatcagtgaatgagatttgaaaatgatgctttcaaaagatcaaatgacagtagaactagaaattgaccaatctaggcctctgggtgtcagtgtttcttcgctaccagtgatcatccaagagttgaatattgtaatacttaactgcataggaatggtaagccaaaaatgtgtttatattggagaacttgggaaggtgtgggaggaggcacgtcatactataccagcttatatatggagttgaaaattgcagtgattatctgttgtagccagtggcttccaaggtgtacattgcacttgcaaacacgcacacacacacatatgcacattgttgccagatttcatccagcagctccatgactggttgttctgtctgttcatggttgcttttgtacaactgaactcattgctgagtatgtggaatgtcagctttaagacctggaaaaacattttagctttcttttgctttgtcttctctgtgatcgagaatcctcctctattaataggcacctggctgggatataagcctaaaatattaacatgttgagagattagggcatcatttatttctttcatttatagaaagctgctgtttttgtgacggaaatagaattaagcttcaaaaaaatataaaaactgaagtcttgattaatgcctttaatgtgcaatagatcttttattcagtgtaatgactcaaactgcctgtgttgggaaggagccaattaactttgctttcttgagtacattagtttcccagggctattgtaacaaagtaccacaaactgggtggcttaaaaatagcagatatttcctccctctcagttctggaggcaaaaaagtccaaactcaagatgtcagcagggccaagctccctccaaaggcactagggaagaatcctcccttgcctcttcttctgtcttctagtagcaatggcaatccttggcgttccttggcttgcagatgtatcactttaatctctgcccccctcttcacatggcctcatcccttgtgtgtctgtgtccaaatttccctcctctttcttataaagaaactccagtcattggattagggcccactctaatccaacatgatctcattttcacttgattacatctgcaaataccctatttccaaattcacaaatactgggggttacgacttgatcatgccttttagggttatggggacacaattcaacccacaatagtgagtatatttaaaaatgtagatgccatttcaagatactcacaagcttcaataaccatttttgatagggacgaaggaaaagacgattttattgtcttttgtatatgagtgtctaattttttgtctgaattcagctctcagtgggcttgttgaaagactgctgtgtgctggcctctgaccccctcaggaggctattgtgctgtgatccagcagcagcgtacatggcagcatctggcagggtgactgccagctgagcagaaggatgcagtgaggacacaggacgtctcctgaagcccatggctgtggggaggtcagccaaaggcctgttctccttggtatgcctggcacatttgaggctgtgcatctccatctgttggtcctcttatgatgttgaagctcagaggctgaatgttctggtgctttgataggactctgatactttgttttccccaagctgttggctgattaagaagataaaaaaaattgggtgaaatcgcactctgtgaacacacttctcaagctgtgtacacagtgccgtgctggacactggggacacagcagggatttgagataagcttaggaggagaggaggcagctaggtgatgtgccagttaacaattctgcctgacgggtcctaggatcagggtagatataaagtgctggaggcactggggtgccacatttgtggtctttgcctcagggattcttgtgatctgtttttttactcacagagcacttctgaccccagatttgtgggggttttgctcacacgaccaattctccagctttctagacaccagctgggtgtctagaaacaaccaattgtctagaacaaccaattctccagctttctagacaccagctgggtgacctctaatgtaactcaattctgataccagctgcctggagttagcatcagatcctgcaagggctcattcccataagactgcctccactgcagaggccagtgtcaagcccaggcctcctgtacttctgacctaccagctataaagtcaaggggttcccatgataaattgctagcatggctcacagaactcaggaataaactttacttatatttacttgtttattataaaggttgcaactcaggaacagccaaatggaagagatacacagggcaaggtggttgtggggaggcgggggacaacagagcttccatgtcctctctaggtgtggcatcttcccagcaccttgatattcaccaacctggaagttctccaaaccccttatttaggggtgtttatagaggtcccattatgtaggcatgattgattaatcattgaccattggtaattacccaatctcctgctccctccccagatgtaggggaccagaactggggctaaaaattctacctctgatgacatggttggttcctctggcaaccagctgccatcttgaagctatctagggccccaccaagagtcacatcattagcataagctcaggtgtggttgaaaggggctcattatgaatagcaaaagatgctcatctcactagtgtcactcgggaaattccaagggttttagaagctcccttgccaggaaccagggacaggatggaagaccaaatacatatttcttctcatttcacaatatcgtaggatgttggggcaggatgattctggagggagttcttacctaagactagaacaatgtgtgagtgttagctagtgagagaacactgtacaaaaggcctgggtgggaaagcggatggctcattcaaggaactgaagaagaccctcaatattggcatagcttaaagagcttagagagttaaaaatatatatttattttttatttttttgtatatatatgctggagaaacaggtgggtaagtgatggtcttgtaaactaaggaagggtattttgactgcctttggggcattgtgattcagccaaaaggtctaaagcagggagtaatatgatcaggtacattgttcagaaacattcctccagctgcaccgtggaagcgggactgagcgagcaagtgaagtggcagatccagttatgtggctggtgaggtgcatgagaggagatgatagtggccggaggtgtggcagtggaaatggagtgacacggttatatttgagggcagagttgatagtacttggcagctggctgggaatgggaagagggagagctgaagaccactcaggtttgtgtcctgcagcaggaagtaatagcaagagcagactcgaggtgacagcgaggacgaaaccactgatgtgtgtgagggcctgctgtgtgctgggtactgtgtccctgcctgttgactaacttagtcgttgtgagcaccccatgcggtggatgcggtagtatatctatttgacagacgaggaaaccaaggacaaagaggttgagtaacttgcccatggtaacccagcctggtcatggccgagctgggattcaaacccaggcagcccagaccccaaagcaccacattgtgcagctgatacttcatctccacagactgtcctaccatatttggcatagaatttaaaaatggaaatgattcttggtagcaacacgaatgtagtggagacacacagacctgggttgtaatctcactcagccaattcctctcagtgagacctggccataccacccaggttttcagaagcttagtttccacattaaataaagtaagaggccaggcgtggtggctcactcctataatcccagcactttgggagcctgaggcgagtggatcacttgaagcccggagtttgagaccagcctggccacatagcaaaaccccatctctaccaaaaataacaaaaaattaactgtgcattgtggcatatgcctgtaatcccagctatgttggagaccgaggcacaagaatcacttgaacccaggaggcagaggttgtactgagccaagatcacgccactgcactccagcctgggcgacagtgagaccctgtctcaaaaaaaaaaataaaacaaaatggcctggctcagtggctcacgcctgtaatcccagcactttaggaggccaaggtgggcagatcatctgaggtcaggagttcaagaccagcctggccaacatggcaaaaccttgtctctactaaaaatacgaaaatggcctgatgtggtggtgcatacctgtagtcccagctactcaggaggctgaggcatgagaattgcttgaatctgggaggtggaggtttcagtgagccgagatcacgacactgcactccagcctggagcgagactctatctcaaataaaaaaaaaagtaaaataaaataagggaatatctaactgtagggttgattaaaatgcaacctgtaaagtgtgtaggagagttcctggcatttaatagatgccgaatagctgcacctgttagctgttttttccccaggatattatagatgtggctgtggcttgggaggggagacgatgtggctggactgaaaggtcatcatgccagtatttttaatgggggttggagagagatacatattgtgaaaaagctccagtgattttttttttttttaaaccctggttgtgaactacttgcgttgatactggattttgaaaaaccaaaggctttaaactcctggttatggacattttaaaaaattatttttaattgacacaataattgtacatatttatggggtgcatagtgatgttttgaaacacagagtttatagtgatcagattagggtaattagcctatcaatcatctcaaacattgaccatttctttgtgttgagaacattccatatccttctagctatttgaaagtatgcattattgtttaactgtagttatcctaaggtgctatagaacatattcctcctatctagctgtagttttatatcctttaacaaatctctccctatctccttctcccaacccttaccagcctctagtaatctctgttctactttttacttctgtgagtaagctagcacagccactgtggtcaacagtatggaggttcctcaaaaatctgcaaatagagctaccatatgatccagcaatcccactacttaactgggcatttatcccaaggaagtcttttaggggttcataggaggaactcttttctctgccaaatgctgggttctgacttggatagtatttggatttgctactggacccactgtttttatcgtccagacatattctgtggggaatgtgatattctgtggggaatgcggttcagaagtggtccacagaatgtttgttattagtccataatgatagaaggctagaaacgaagaagaaagtttagaaattttaacaataatttgacagtgactgatctagtaataaacaatggtgttttaattttacatgccttttaaaatttcatttccccagtacattgtcagtgaatttcacaagtgttagtccagtggatgaattagaaataataataatttttaaaccagtcctgagtactactttaaactgagtgctcaaaaatagctgcagctccagagccagctgtggtaggctggcacagtgactcactttggtaaaaatcctgggcaattgagagcagtctttgactctgaggagtaattacttacaaaagttgacaaattccttagcaaagtaatttccaaagggaattactagaattctagaattgctgtaagaggagaggctactcttgtttgtcctgtgtgagagggattctcagcgcctggggcattagcaatgcatttgccgtattcagtgtgagatggggttggtggtcatttattctgaacacctgagccgcagtcattgagtaggaaacggattacacatagttatgagtagtaatttcaactaatcaagttcacttgtagaggagaaaaacaatagttcaagaggaaagcatttgaaaatacttccttgtaatgtcttaaatgaattttagtgccaaatattaaaagtttttgtgttttttgtttgtttttaatttaatagtcaatataatcccactctaaagtgagggagccttctgcggctggaagtggtggggacagataagagtatgtgaggtggaaagcctccagcagctcctgacccttgtacgagtcctgtgtgttgggatggaagggcatggaggctgccccttctgctcattttttaaaaatacatgtttttataaaaattctaaaacagttgtgtacgaatgaaatctgtcaattgacccaagcagtttttttcatttatttgagatagggttcctgtcacccaggctggagtgcagtggtgtgatctcagttcactgcagccttgacctttcaagctcaagcgatgttcctgcctcagtctcctgagtagctgggaccacaggtacatgccactgtttccagctaatatatatatatatatttgagacagggtcgcattatgttgcccaggctggtctcaaactcctgggctcaagcaatcctcccgccttggcttcccaaagtgctgggattgcaggcgtgagccacggtgcctggccagttttttatttagactgatcaacgatggcagtttggcttcctccatctttttaacataagaacaacatcaatatgagaaaaaacagataagagctcattttggtggatttagttttgtatccacatctcctacaagttctatttctaaatcagtttctgagaaatagaacccaggcttgcaaattgataagcctggaatttgtttaaatgtattctttggctctttatttttttcctcattataaaaatggaaaagaaagcatgtttgaattgcccttaatacccctttctaacacagttatttttattatcatgtattgtttccccgtcctcatctgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtcccagcattgcatataagagtgctaattaaaatgttgcaaaattcagtgtcaatgttttttctataatgagtataaaaaggataactattggccaggcacagtggctcatgcctgtaatctaagcactttgggaggccgaggcaggtgggtcacctgaggtcaggagtttgagacaagcctggtcaacgtggtgaaaccctgtctctactaaaaatccaaaaattatccgagcatggtggcaggtgcctgtaatcccacctactcgggaggctgaggcaggagaatcgcttgaacctaggaggcagaggttgcagtgagccaagattgtgccgctgcactccagcctgggtgacagagtgagactgtctcaaaaataaaaataataataaaataacgatttcaaggattttagcatatctttgctaacaatgatgagcctctttcttcttataatgatttttttttttggatatgaattatccatattttctaatgcatttgtattttaaaactttttaagatactggccattagtatttggtctggatttttttgagaagtaaaggctttgtcaccctctgaggctaaaacagactaaagacttttctcagtattgttcctcccttacacaaaactgttttcccccttattcacaagtatttttgtttttacgtacaggcaatcttgagcagtagcaagtaaagattgtctaaaactgtcaagtccacaaccatcaaatgtttgcaaggatatgaaacaaggagaacttgttagtcactgcaaatgagagtataggttggttcaggtaccttgaaaatctagtcaagccaaagtttcacctgccctctgactcagcagttgtactccagctctgtgtgcaaggagatgtgctggaatgtcacagcatcgtattgcaaagagcatattggcaacagcttggatggccagcagaaggagcccaaatgtgtgattcatattcactagtcgaataattgaatactacaatatacaccatatatactagactgtatgtgttgttctatactatagtgattgactcgaactccattcagtgaaaaaaatggaagaattagctatttgtatccatatgggatacaaaaaagcagggtaacaaaagaatctacatcatcttgccatttgcaggtaaagcttcttaaaaaaacaagagaaatgcaggaagaaatgcctaggaatgataagaccaactcggtggagggaaaggaggaaaaggccaatggggtggcacacacagggctaactgggcactttatacccttctttatatccaaaatattttatggtgaatttcttttagagggttgacaagcacctgtgggtacctgatctgttttaatcatcctcatgctaacaaaattcttcagtagatataacctaaattttttttctctttcatcttggttttaaaatgtcttcccccttttattctctggagaaatagaagatatccttgatcatactacttctctgttttattcattttggtagtcgcctaagatggttttaatgcatatggcattatctgaactgttccctgttacctcatttgctcaggcatctgaagatgttgtgctttctcttcccctgcaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataatatccacgtgtgccttcttactgaatgatggtcttgggagtctttgcaagagtattgagtagatctctgatattgtgttgaaaagctagctgctgagtaggctccaatgatgctatgctgatttaagtatagaagaactaatcagttcattgccatttcccatcttctggcagtatcaggcacatagatggtcaataaatgtttccagaaatgttgattaccatgttcagattatgcattcacatgcacttaatcttcttaggtatcactttttaagcagaaactcctcttttatgtaatctttaccaaaaaccttcccagtttgtacttgtttttgtggtaagtacttgcagggtgctagtaataacaacagctaaatgagtgtttactgcaacacgtgcaggcactgtgcttgacacaccctggctgatgtgatccttacaacaatcctattagagaaggtgcttttgtacccatttatagatggagaaacaggctcagaagtgtaagtcactttcttaggattacacagccagttaatgcatcacgtttttgaggccagagttgggtctgtgacctcaaaggcgctacctcttagttacctcgcagtgcagcctcccattcatctctgacaaatggaagcttttaggtctgctgcatcaattcctgggacttcacattttcacatgccgtcaagcaatgctgtctacacgcttaataaataccttgtcttgagatgttctaacactttcctaactggactttccaccgccagtttacttcccactagagccaggctcttattgcctgaacttccctgtctcaagcctttgaggttttcccaaggcctgtaactagacccacagtcccctgccagaccctgaacctgttatctgcagctctagcctgcgctttcccttgcctgttctggctacacctgctctatgtccccatataactactagcctccctcaaaggtcacctgctctgcgtaacttccagctggttctctacctctactcccagggtactctgtattgtctctagagctctttgaattactctgcatggagtgtagtgtgtgtttctgtcaccaccactagataatgagggttctttacctctgtgtgccccacagcttctagcacaaggtctggcactacagaagcacttagaacattggtgtaattggattgacaggtagagccataactatcagagatggccatataggaagccttttaatttcttcctgttatgtcaggagccattgatttaaatgttaatgaaagtagaaagggcctaaacagaaaaaaagtcagcctcactagtgagggggaatgcaaattaaattgcagtgaaatgcaaatcaagctgaagtgagataccattttatacccactgtgagtggctactttttttttttctttgagacagggtcttgttctgtttcccaggctggagtgcagtggtgcgaacacagctcgctgcagcctctgaccttctgggctcaagccatcctcctacctcagcctcccaagtagctgggactacaggcatgcaccaccatgcccagctaattttttaagtttttgtggagattgggttttttgctctattgcccaggctggtcttgaactcctgggctcaagtgatcaccctgccttggcttcccaaagtgctaggattacaggcatgagccactgtcctagcctggatggttaattttatgtgtcaacttgactgggctaagggatgcccagagagctggtaaaatattcctggatgtttctgtgagggtgtttctgaaagagattaacactgattcgaatcaggagacagtaaagagggtcaccctcaccaatgtgggtaggcattgtctaatccttgaggcccaaatcaaacaaaaggcagaaaggtgaatttactctttgcccttgagcttggagatccatcttctcctgccctcagaccttgctgctctggttcttgggactttaga

SEQ ID NO: 14935 - DNA, 10061 bp, Human; identical to SEQ ID NO: 12092
  misc_feature (1)...(10061): n = A,T,C or G

SEQ ID NO: 14936 - DNA, 16429 bp, Human
tatccaaagaaaatgaaatcagtatgtcaaagagatatctgcatcaccatgctcattgcagcattattcataatagccaaagtatggaatcacctaagagtgaactgatggataaagaaaacgtgaaatgtaaaaatgtggtatatgtatgtatatttatatatataatgaatactatgcagcctttaaaaagaagaaaatcctgtcatttgtgacaacatgggtgaatttatgctaagggaaataagctaggcacagaaacacaaatacttcatgatcccacttatatgtagagtcaaaaaaagtggaactcatagaatgagagcagaataatggcgggatcttggctcactgcaacctctgcctcccaggctcaagtgatcctcccatctcagcctctcaagtagctgggactacaagtgccactgtgcctggctaatttttttatttttttgtagagatggggtctcactatgttgcctaggctggactccaactcctgggctcaagggatctgcccgcctcggcctcccaaagagctgggattacaggcctgagccacgacacctggccgaccttaaatattcttagcacaaaataaacatatacacacaagcacacacgactatgtgaggtgatgggtatgttatcatttcacaacatatacaactatgaaaacatcacatggtacactgtaaatatatacaatttttatttaaagctagaaaaattcttttaaaataaactaaaaaggcagtccataagcttctgttgaatggatgaaaatctctaccataaataaaaacataatatgcaaaggtattaataagatttggaagaaaacctaagagagtattaacagtagtgactactggggatcaccgagatacagggtattagggatggaaggtttacttttctctttttttttttgagacggagtgtcgctctgtcgcccaggctggagtgcagtggcacgatctcgactcactgcaacttctgcctcctgagttcaagtgattctcctgcctcagcctcctgagtagctgggactacaggcgcccgccaccacgcctggtgaattttctgtatttttagtagagacggggtttcaccgtgttagccacgatggtctcgatctcctgacctcgtgatccgcccgcctcggcctcccaaagtgctgggattacaggcgtgagccaccgcgcccggccggaaggttcacttttcaatggatctttgggaagtttcaaaacatacatgctcaacctttaaaaatttctctaggggaaatcccttctccacatcctataggtgtgcttccttcttcctctccacacacttcactatcaaaacctacattacttccaacagtcgaccctcgagggaataagtccctggtccccacgatcgggaccagccagtccacactgccgacccctgaaaggcggtctcagctgctcggtcagcgagaaaaaaagccggcgaggtcctcgtcctgcaggccacagcgaagacaaaaacctctggttactggcctcaggtgcaaggctgctccgcattggcagcgcggtaccattcctattattattacgtagtcttgtttctttctgggagaaagcacctagggagagttgggctggccccgcagggcgctccgggacacgcgtcctctgcaacgccgcagcctgcgccagcgttcgaccgggacgactcatcgaggcccgactcgcattttcagttgtcagattcgccactttttggtgtcagaatttaaaacaaaaattccaatttctctatttcagaagctctttctgtccagaaaaacacaagcaggagagacttcaggtttttgaattattcgtctcttctggcctccacggtatctacatccagtgagcggggaccgtgagtcgaaagcgacgacgcggatgctcaggccaccgttcccggcgcgcagtcgcagctgaccctcgctcccgcccccgcctggagtccgacgtggaagttgctggctgactgggcttgcgaggaaaccgcctcggagctgcagccgaaggccaaggaatcactgaagatcggcgagggaggacagggggttcatcatgggtgaggggttcgagaagggcacctgggcgcgctcgagggagccgcggccgagggctggggtgcagaggaggagaggggccggccaggataccctagagtagccagctcctcagggggcgggtcgcggaggacttgactcactttggatcttcatctgtaggggtggatccggcctctcgcgttctcctccgtcctctctcggttccccttgattcctgcggggtccagggacccggacagcttggggacgtccgcagagcctgggttcgagttctttacccttatcatgaagttttccctcatccccagctccacttgctgggcagagttgttcttgcggaggctggcaacgcgtcagtcgcaggttcgccgaggtttcttggtgaaagatgagctgcggccccagagtggaagcttaatcattctctttaccaggggcgctgggacggcgtcagtttgaaaaacctgagagcaggtgttgcttatgttgttttatggccagtttggcatttgtctgctaatctgctgtagcgtttcatgtaataatacgggtatttctagtcggcaaatgaaactttattcttggttcttggcccgctgattgagggaactgcattctcacaagcatcaggtaacaccctcgccccgctagaacccaagtgagggtgcacattctttaactcgtttctcaccctccaaatgaaggtgcagattctttggcttggttaaatccctccacagttttctggggagcatacttcttgctcccaagcatcacaggcgctgtcctgtcttccataaccgccttcagttttgttccgcctctcttctacctgtaaatggtagaaaggactttgtcaagtcacacctattctgttgaactttcccaaggttctctagcccatggtgttgttcatttttcaactcgcagctcttagttatgccatgtctttgccaaataacagtgtggcatcacttctgatgttaactatttttttttgtattaatgtaacttgtttttaatcttctctaatggctctggatgggaaaaggactgtgctttttatcctacacaatacttggtgtacaggaagctttctgggaatattttgtgatgcattggatagagctttattatttttaaaagtgggttttttgtcaaaaatagttattgttttcagcttttttctcaatttcttgtactagctatattgcttcgtggagaactctgattgaagttggttatagtggtactgctgctgtacagtacttttcctgtgcgaggattacattgtcccactatcctccttactggccccttggtttttaggggtagtgaggggatcatgctaaaatattcctattctgctgattagaaaatgagattcccaaaggccgcggccatatttctcttattatttggtttatcttctgtgcctgcatgacacaatagtaacataactaaggacatagtaacataactaattacttgtttgatattgaataatatatttcattgggaggaaaaatatgcacctacgcatccaggaaattataatatttaatttggtatttagctctcaaaggacaaggttagatgttttgtatacctagttcacaaaatgacattgtgtatgttttttcttttattattttttaggtggctttttctcaagtatattttccagtctgtttggaactcgggaaatgagaattttaattttgggattagatggagcaggaaaaaccacaattttgtacagattacaagtgggagaagttgttactactatacctagtaagtgttggtatgatgagctaattgtagggactttctggtctccatccaacataactatttctttctttcttttttgtttgttttagtagagatcaggtatcatcactatgttgtccaagctggtcttagactcttggcctcaagtgatcctcctgccttggcctcccaaagtgctgggattacaggcatgagccactatgccaggcctatttctgaataaattaattcatataataaagtatttgataaagtttgtaaactgctagtatgaacataacattgataacactttttccatcaactaagaggcagcttagtgtaatttaaggacccttgttctggtttacggccgggttgggctgtttataggtttaagttactaaatcttactgagagccagtatctttactaataaaatacataagataacaaatacccactggttttcagggggaaataaacaaagtaggtaaaagtaccttttaaatctgtgtaaagaattatataaatgttaagtgatgttacatgtgaagtgcctttttttcctgtatttgttactattttaattaagattagtttatcttaggtaattatattgattacttttaaagatctgagttgcagagactgagtgttgaagtaatttggtaccttaaaaatatcaagagaaggccgggcacaggagctcacgcctgtaatggcagcactttgggaggccaaggcgggtggatcacctgaggtcgggagttggagaccagcccaaccaacatggagaaaccccatctctactaaaaatacaaaattagccaggcgtggtggtgcatgcctgtaatcccaactactcggaaggctgaggcaggagaatcgcttgaacctgggaggcagaggttgtggcaggccaagattgcaccattgcactccagcctgggcaacaagagcaaaactaggtctcaaaatatatatgtgtatatgtatatatttattaagagaagaaatacctcaattttaatcaattattactgtcttacaaaaatattctccaacagtcttactgactatatgagaatactgttgttatttatacttttttcatttgttgccttgaatttacttagagaagagtagtacatttaaattaaagagttcatacagtttgctcaagattttttaaattatgcctctaatgttagtctgtcactcagggtatttctatattgttactgtttaaatttatggactaaaacgaaagaggctagcctctaagaaagaagagcgttttgaaccctgtaatgtctgttattcctttttgctaccttcagtaaattttagtgcccttagtttttgcttctcaaaatcacccatctctgtctgggcatctcctgcagtgcacagagcagcacagtggatagtttggagtttcagtgagtgctgctttacaccacactctttgttgagacagtgtcttgcttttttgcccaggctggagtgcagtggcacattcatagctcactgcagcgtctacctctacctctacctcctgggctcaagcgatcttcccacctcagcctcccaaagtgttgggattacaggcatgagccactgcacccagtctacaccattctcttgtcttgcacatataaacgatgttttttactgttggtgaacattgtgattacactcctacctaattctaagggagacatcatgaacttgcattttagttttttgctcaaatttgtcatagtattgttattttttaattgtaatagacatacttgccaaatactcaaaggtatcacttaccactgcagacttaaatataaaacaaaagctaattgtccagttatacctggaagttattttttatttatttatttttttgagacagagtctcactctattgcccaggctgaagtgcagtggcaagatctcggctcactgcaacctgtgcctcccaggttcaagcgattctcatgcatcagcctccagagtggctgggattacaggcatgtgccaccacacccggctaatttttgtatttttagaagagatggggtttcacagtgttggctaggctggtctcgaactcctgacctcaggtgatccacccgccttggcctcccaaagtgctgggattacaggtgtgagccaccgcacccagccatggaagttattttttacctatttttcacctaagaaggatggcagagaaaagggatgggacacctgccctttgaccacccagccatgaccttattacaagtgagttctggaggatgtctgcagatgggctgtgagattgaaagctgcagccatggctgtgtccatgctgtagtttagaactgaagtttagctttttttcttttggtctgtttatttgctgccagccaaaattctgctttttatagtacatccacaactgtactttctaaatacagctttcgaacacttttaactactctattatgaggggagtttaatataataggatttccattgagctaaaaattatgttttcctttttatttcttttttaaattctttttttaatttatttgagctaaaattatatactttatttgcagaactgctggcttttaaaaaatatcctgaagatggtattgatcttgctaattgatgttttgtgcacacacctgcacatgtgtgggggagcagagcatactatttcgtcttaaatggtataaaatctcaaccaataatgtgattcaacaattaccatttctttttaactcgaatcctaagacaaattatatatatatatattttaaactctaataacagttaccattaattgctgtaactcaattagataggatattttgaaggtggaatgtattagtctacacataccactgatttgatttctcttccagccattggatttaatgtagagacggtgacgtacaaaaaccttaaattccaagtctgggatttaggaggacagacaagtatcaggtatggtacaaagaccaggttatttggtagtatttgacatttattgattcttttaagggttaaaatcagtaaacccgaatatgtgttctattgtaatttaaatggagccacctagtttaaaatgaggtaaaattgggaactatttccttagagcatccattgagttaaaacttaaggaagcccagttttccagatacctgtttaatgaaaatcttttcacgaaaatctcaagaccttattacttcagctattctcaattagaaaggaccctccatttagttcttgtcagtctctcctctctgaaacacattgttttggaattcattaaagtaccttgcaggcataccatttagggctaatataaaaataaatgccattggccgggcatggtagctcacgcctgtaatcccagcactttgggaggccgaggtgggcggatcatcaggtcaggagttggagaccagcctgaccaacatggtgaaacctcgtctctactaaaaatacaaaaattagctgggcatggtggtgcgtgcctataattccagctacctgggaggctgaggcaggagaattgcttgtaccaggacttgggagctggaggttgcagtgagctgagatcgcgcaactgcactccagcctgggctacagagcaagactctgtctcaaaaaaaataaatgaataaataaaaaataaatgccttctgaagttcaggtcttctgcttagcattttgggcttgacatggcaacagtgaatgtttgatgaccgtcagtagttggtcacgatagtaccatcttaaaagattagtaatgcattctccaaacattctgacttcttttaactcatttcttgaatcacgtttctttttttttaaattgtgcagcctcccaagccagagtaggctcagagagactccattgaatcacttttgagtttatttataattttagccatttctactgcttgatgtcagtgattaatttcatgactgttaaataaaatcacgtttaaaaagtttattcctcttaaggggtgcctagttaaagatttgtttaagaagatgtaatgatcaggtctgtgtacaacttttctatcagtatatttagtgatttcatagattataaataaattttgtcagcctgaagtctgaatgaattcatttggaaactccctggtcctgtgagtcaatgtttatcaacattcttttttttttttttttttttttttttgagacagagtttcactcttgttgcccaggctggagtgcaatggcaccatctcagctcactggaacctctgccttcctggttgaagtgattttcctgcctcagcctcccgagtagctgggattacaggcacctgccaccatgtccagctaattttgtatttttagtagagatggggtttctccatgttggtcaggctggtctcgaactcccgacctcagttgatctgccctcctcagcctcctaaaatgctgggattacagatgtgagccaccgtgcccagccaatgtttatcaacattcttttgactccatcacatctgagggatatggtacatatatccaccagaaacagtgaatcattaaggcattgattctaacatgtgtgggacagaattggcaattgatatgtcagtttcttccttaaaacaataacaatatgttctccccttttaaattttctctaggccatactggagatgttactattcaaacacagatgcagtcatttatgtagtagacagttgtgaccgagaccgaattggcatttccaaatcagagttagttgccatgttggaggtaagaaaacgtaaccactttaaaatgtggggcagtcatttacatattattacattgaagaataattaaaaagaatgcaggggttgttccctccatccttttaaaattattttcttttatggaaatgattttctattccaaaaatacagttgaggagggttggagacaaaacaacaacaaaaattaacctcgtaacttcctcttcaagccagattgcttgattttccaggaggttcagaagagctcacttaaacaaaagcatctattctaagtcacttctttgatgtgacttttaaaatatgtctttttatttttagctgttttagaaggattcaagttcagagaaatatgtatttctgggttactggcacaatgctggcctcacgtttatcgttttttatccttcccagtgtttacagtgcttttgaccttctttctgttctttggacacgagcttgcacacctggctcagggccttttgcacttgctgatccgtctgcttggaatactattctccagcatctttgcatggctgccttcctgacgtgtttcttcccacatctcttccccagaaagaagtcttatttattctctaatcctttacccttctttattctttataccgatattgtttcttttttttctttttctttttcttttttttttctttttttttgtagagacggggtctacctatggtgcccaggctggtcccaaactcctgtcctcaagtgatcctcctgcctcggcctcctagtgttgggattacaggtgtgagccattgcaccccacttactgtttttttacattatttttaaatgtatttgttggctgggcgtggtggctcacgcctgtaatcccagcactttgggaggccgaggcgggcaggtcaccagagatcatcaggagtttgagaccagcctgtccaacatggtgaaacctcatctctactgaaaatacaagaaaattaaccgggcatggtggtgtgtgcctgtagtcccagctacttgggaggctaaggcaggagagtcacttgaacccaggaggcagaggttgcagtgagccgagatcgtgcccctgcactacagcctgggtgacaagagtgagactctgtctcaaaaaataaaaattaaaaaaaaatatatttgtttacttatgtatctctccctctaaaatgtaagttctttgagtttaccctgataggaggaacaatgtatagtacttaattaagaattcaatacatcttattcactgaagttaataagatcatatattggctaactgatcaaattcagaggatgcattaaataatccatttttaaaaaatgaaaaaataatcaaatgtactatgataataataaaattgcccttgctctggaaaattagatggataagtttctttctcttgtcaaaaactggattctgaattgtttaatcaagggatgtttaaatataagttctaggccagttgatacctaggtaaaagcatcctcagacgaggggactatgtacttttgaattcttttttttttttttttttttttttttttttagacagagtcttgctctgtcgcccaggctggagtgagtggcgtgatctccactcactacaattttcgcctcctgggttcaagcgattcttctgtttcagccttctgagtagctgggactataggcttctgccaccacacccggcttatttttgtatttgtagcagagatggggtttcaccatgttggccaggctggtctcgaactcctgacctcagcagtttgcccgcctcctgatctgccagccttggcctcccaaagtactgggattacaggcatgagccaccgcgctcagcccaggacttttgatttcttgaactactgacttaatggcttccaagttataaattgcagacttaatagttttaaacatttggttaatttttttttttttacatcatagcattatatttattataagagcttcttagaccaaatttaaatgtaaggataaggtttaattgccttgggtataataggttttttaaagaacagttttatttaggtataattcacatgatatagtgtatttttatcatataaagtattgcttaaaaggaatggattattgacttcagtttacaatttttgagttgtgcaggattgttgttacttgcagtgttaggatttgacttataaagtcttacagagaaagaagtaaaagttggattctttctttaggaagtcacttttaattcatcaataaatatcatgttatgttaagtatgggccaagtacgagtcaggactgttaatgttaaaacatatagacacaggccaggtgtggtggctcacgcctgtaatcccagcactttgggaggccgaggcaggtggatcacttcaggtcaggagtttgagaccagcctggccacccatatctactaaaaatacaaaaatgagccgggtgtagtagcgcacgcctgtaatcccagctacacgggaggctgaggcaggagagtcacttgaacccaggaggcggaggttgcagtgagctgagatagtgccactgcactccaacctgagtgatggagtgagactccatctcaaaacaaacaaacaaaaaatatatagtatagacacaaaagcagtttaggtttcaactttttttttttttttgagacggagtttcactattgttgcccaggctggagtgcagtggtgcaatctcggctcactgcagcctccacctgccaggttcaagcaattctcctgcctcagcctcctgagtagctgggattgcaagcgcacaccaccacacccggctaatttttgtaattttagtagagacggggtttcaccatgttggtcaggctggtcttgaactcctgacctggtgatccacccacctcagcctcccaaagtgctgggattacagatgtgagccaccgtgcctggcctttcaactttcctatacacaaaaatgaattctaaatgggtaaataattaaatgtaaaaaatgaaaattataagaacatataaggaattcaaaagatgagatttaattatattaatgtaaacaaaactcccccaaagctcagatatggcaaatataaacaagattaagataagaaaccaggcctaaccagaagccaatgactaaggattagtgatctgaatcatagcaagatcttttgcaaaatgagcaaaaggcaattcgtaggggaaaaacattgctaataacatttgcatttgtttttaaagagacagggtcagcagggcgcggtggcttatgcctgtaatcccagcactttgggaggccgaggcgggtggatcatgaggtcaggagttcgagaccagtctgagtgaccaacatggtgaaacctcatctctactaaaaatacaaaaattagctgggcgtggcagcgggcacctgtagtcccagctactcaggaggctgaggcaggagaatcacttgaacccaggatgcagaggctgcagtgagccaagattgcacgactgcaacttcagcctgagcaacagagcgagacactgtcttaaaaaaagaaaaaaaaaaaagagacagggtctccctctgtcccctaggctggagtgcagtggcacaaccaaagcttgttataaccttgagctcctctctctgcttccttttttgtttgttttttaaaaaaatttttgtagagacccctgtgttgctcaggctggtctccaactcctggacttaagcgatcctcctgcctcagcccatgtgcatttcgaataccctagtaatatataatgagatgctatgtttggaaaagtaaataattcccaactctacaaaggctgcattgaagatggagacttttatacactgttggtagggtaacctttctggaaagctgttcatgcatgtattcagtttatcaaagcctgaaaaaaactgttcatactttgactccatttttagaatattgtgttaaggaaacagatttaaacagaaatttttgtataaagaccctgtcacttgggtttatctaatagtctagtggaaagactctaataagagtcagatactagaaaatagttaacacagtttatggtgcatgcatccatagtgtagagcatatttagccatttttttattttgaaaaagttgttgtagtttggagaaacatgattttaatttttaggcagggtatggaactatatataaatgtgatcttaaatgtgtaaatgtatttactaaataaactctgaagtatctgcaaaacaaagtactagtagaaaacacctaaaatgttaacagtgatcatatttgggaggtaggattatgagtgaagcttcttttctttatacttctctatataatttctatataatttcataatgtgtaatatattaattataaaatacacgtttaaaatgtatttttggacattttctaaactcgagagagcacattagttaaaagaaattaaatattttcaatttcatttaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggcaagtatcatgcttccagaagccatctgtgcatttgtgtgtgcttgcagctatgcacgtccacgtgtaatttttctcccgtgttgaggatgaaactttgatttacttagcagcttatttcataagttcctcaagcgttttctctcactggtcttcaggtgcatctgtcttctcaaccacacctacctgattacagttacttagataagcaaattctttgccaatttttagccttttccctgcctcacctcaccctccaattccttatccttcaggaattagcttaagactctcttctgaagagcttttcctaatgtatctctattcctactgcctaatcactcacttaaagttagatgcccttgtcacagattagtgacatagtacttgttttgctgtcttgtaagtttgatttgttcatctactcattagataatcacctccttgaggattgagactagtttcacctctgagtcatccatatgtagcccagaagtagtagtagcctggaaaataggtatttggtcttttttgaatttttcattcaaatcatagacaaattcaaagcttagaggaaccttatggatatctagtgcataacctcatctgtgttagctgtcatcattttaagtactttggaatccacctccaatacaaagtttattatagatgatcatgctttatacctgaaaattaattttataaaacagttcattttctctttacaggttagttgaaacattaaaaagcagacagtaattcagtccattcttctcccctgaaatgaagactacatcacctctctccctttggaaacagtcaagtgtacttcacactactagatgttaaaactatatgattattggcatatactgactgactgcaatatttgtagtaaatagggaaaataagtatttagttggagggataatttgatcgaatcacctgaatgttctatgtaatgtaaaatattcttttcttgctttcttgtgttaaggtatatattctatttgtatggaattcttattcaaatacagttctattaaagagtatactcctattggatgaaaaaaacctatttttgaatagtagttgcagcttgtttgtataaatactaaaaaatatcttaacagatttttttccccttaaaatgaattatctttccaaagattagactcagtatgagagtaggtgaggaacatagtttgtgtaatataatctttatttgcttacctgaccactttttattaagctgttttgtttaaaagcttttggttataggcatgaatattgttttgatggttaacttcactgacttatctgtaagtgtcattttatagtactttacagttgtcaaaaaaaatcttacatatattgatctagttgatcggtagaggaagcttgtgaagtaggtaggacaggttatgatgtcttcactgtatggacgtgaacccagggttctaataggttggcttgcccaaggtcacctgctagcttgtaaggtaggaatagggctcaaagtaaaacttttggttcagaagcttgactcataaactatactatatattcccaaaaatgtcagtattgacaacacagtctaactcttaaataaaattatgctaattagttacattcaaaataatgtttataaatttatttgtctatactagtagaagtgatcagtgacatactataaataatcctaaatggttatatttgatagaattcataacacattaaagagaaaatttcacattaaaggaaggtttaaaaatctattttcagattataaaaggtgtctttactggttttcattccttttatctacatgtaattggacatgtaaacttgttaaaaatcaaaatcttactgattgtacagggagaaattaagcattctgttttaaaaattaggcttattgctagactgtaagtttaaaaacaattcatgttcaaaggagcttttcaaattacccagtccaccacagaatcagctaatgtgacagaagtaaatatagtgcgtcataattgctaaaaacagggtgaatttctttcacttaagttggaaaaccagcctctaaaaaattaggtgctggtaatgagagcttaataccatggttccctgcaggtctcagaaacattagtagttcctttcttggccctcactgtccttccagtgttggcctctggcctcttcccctcacatttatgttcattctccgggcttatattcattctctgctgctttctcccttcacccgtgggactctcacccttcttgctcattctccagcacccattcctactttagtctctttgaaatcttttttggagattttccttcagctacaaatgttccagtacaaccaatattactcctgaggggcaaagactttttcatatttatgtccctagtatctggtatggcgcctggcatatggcatttcagaatatgttcatagttgaaacagtaggatagatatttgtcatcttgacaagtagccctttgcaatttatacttgagttcactcctggtcaatggcacatggctggaaaatgcagaaagcaagttcacttacagcctgaggcttataaagcttgtacagctgcctcccggcagtccaggaaaactgcaaaaaatgggaagtaaggtcctggcaggcagacccggcatgtagccgctggccatcttgaatcctagggcatgaagttgccccaaagttcagcacttggttaagcctgatccctctggtttatcacaaagaataggatgggataaagaaagtggacacttaaataagctataaattatatggtccttgtctagcaggagacaactgcacaggtatactaccagcgtttggatattgatatatacatggcaaatctgaatattgttttatgagaggcctggcaatgggtaaaacaccaaacttgaaatcagaacataggtgcaaatggccactcctgtagtttcttttctgtaaaatgggatctggacgaatgataccaaacgtttctttctaacattgtattttataactctggcctatgattgtgttgtgtcttgcattaaaa

SEQ ID NO: 14937 - DNA, 19353 bp, Human
catcagcaatttttgtagctccgtaacaaaaataggtattttaattgagatgatgttaaatgcattaacttagggagaactgatgctgctgcagtgatgtttggtcttgctagctaagaacatgctatgtctttatatttgcttaagccatgttttgtgtctttctggagtgctttcatggtttactcttgtagatactggatgttaccaattttaagtttatgcttaggtattttctgtatttttagacaattacgaaatattttataattgtaaatattttttacattatcttattctataattatggttttgtgtttgtacatatgaacactgatttttatctgttgattttataatgtgccctttactaactatcttatagtttttccagatgtattcttgtatcatctgtaaattgagatagatatttgctctttttggccaactatctgtagggtccctagtttctctatctctctatctctctcttaagtcaaaaatggttgctggctttaggcatttgattgcaaaatgtcaacatttgtttttttttttaaatcaaattaattgatatataactcatacatgcagaaaatttatgcttttaaggtttacagtttaatcaattttgagaaacttatgtaatcatgttgctactactacaatcgagatataggatatttctatcactggccgggtggctcacacttgtaatcccagcattttgggaggccaaggtgggtggatcacttgaagccaggagttcgagaccagcctggccaacatggtgaaacccagtctctactaaaactacaaaaaattagccaggtgtggtggcgggtacctgtaatcccacctattcaggaggctgaggcaggagaatcacttgaacctgggaggtggaggttgcagtgatccgagatcgtgccattgcactccatctagcttactgggcaacaagagcaaaactccatctcaaaaaaaaaaaaaaaaaaaaaaaagaatatttctgtcactcttgtgactgtttgtatcaatacctcttctaacctccagttcctggaaaccactcatcttatttcttttcctgtagtttcaaccttttcaaaataccatataaatggaatcatactgtatctatatctatatatccttttgagtctggcttcattcacttacataatgtcttagagattcatccatgttgctgcatgtatttgtagttccttttttattgctgaatagtattccattgtatggatatatgatatttatctattcaccaactgaggataattgggttgtttccagactttggtgagtagaataaagctgctataaatacttgcatacaagttttttatagacataggttttcatttctcttgggtaaataccttacaatgggattgctgggtcatacattgtgtgtttaactttataagaaactgccaaatcacctgtcaaagtagttgcagctttttgtatttctgtccacaatgcatgaaagttccagttgtcccacatctttgctagcatttggtatcttcagctatatttttctttagttattttcattgttgtgtagtatagatctcatttctgttttaattttatgactttgttttaaacctttgataaaatacaaggctgagttgtcaaccaggccactttagtctaatgaatattcatctgaaacttggaaggtgggctgtcaccttgctcacttgtccctactcccagcacagtgggcttgagaattcttaaccacctaaatcaaccattgaccagtaaccaaggaaggccacttgtcttctgtttatttggaaggaaaagaatatttttatggaacttatccgtattttcaaagcaaactagcagttactcgattttaatgaaaatatagcttaaaaatggtgtcttttctttgtatgtctaagaaatttgcaagtttttcttaagcttgccatatcaacatgaaatgatgtcaaatttctactgatttgcacaggaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcggggtaagtctcttttcataacactgcactttgatctgtaatgtttttggtggaactcattgaagatggtggtagcatccaataattcatattggggctgaaagtagcatacctttcacactccagagctggcaccagtcacttatgtttcagtcagtcggcctagtgtttggcttttgtctccggacttcaaagggagagaaaaccttcagctccttttcttagaccttcctgcatcctctaaagaaaaacctactatatataacccaaaggaaatatataaacatatatatataaataaaaccatcaaggcccaattagcaaaaaagagactgaaaattaatgctaagtgtctaacttaaaaatttagaaaagaacaataggataaacccaaggaagcagaaatatagccagagatttatacctgaattctgctgttttgggtcgatgctttgacttctttagaaataatctttgctaggtgactatgagctttgatccttttctgtaaaactgactgttggtttctaggtttgagacagtctctaagtcagttttttcaataattccctcaccaagttattttttttagggaatggtaagataaatcatatttcaagtataactcttttccctcctggttttatgttgttttaaaactgacgtctaattttataatttcatgtctaacaatcttttggttcctgatgtttcttcttatgcagttggaaaaccaaagaaccaggtgatcactgcttgtcgggatgcaattcgaagcaataacatcaacacactgttcaaaatcatgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgcttttgaagtattagggcttcagagtccaattttgcttatttatggtatataaatacatatttttttcttgaaattgcaattgagtttgtacttttcaaatagattatctactttttcattaaaatgtaaagatgttaaactttgtgttgattgattataaaatcaccaccaaatcagaattgcccatttgtattttgtagtagagaaaaacaaaaatgtgggctgggcacagggcttatgcctgtaatctagcactttgggaggccagggcgggcggatcataaggtcaggagatcgagaccatcctggctaacacggtgaaaccccgtctctactaaaaacacaaaaaattagctgggcatggtggcactcatctgtagtccaagctacttgggaggctgaggcaggagaattgcttgaacccgggtggcagaggttgcaatgagcctagattgcaccactgcactccagtctgggcgacagcaagactcccgtctaaaaaaaaaaaaaaaaaaaatatttgggctgagctcagtggctcacacctataatcctagcactttgggaggccaaggcgggtggatcccctgaggtcaggagtttgagaccagcctggccaacatgatgaaacctggtctctactaaaaatacaaaaaattagccaggtttggtggtggacacctacaatcccagctatgcaggaggctgaggcaggagaattgcttgaacccaggaggtggaggttgcagtgagcaagattgcaccactgcactccagcctgggtgacaagagcaaaactctgtctcaaaaaaaaaaaaaaatgtggatatttggatttgtgtgctttttaatcactgaaagatgggtgcaaacaacaaatttacattaaggaagagtcaatttagagtgattactttgttgggctaatgttagctgctgtaacaaatagacctcaaaatcataatgactcatttttcatttattatgtaaggatttctccatagttatgcagggacccaggttcctttaatcatgtggctctgtcatcccctaggacaaacttttctacctgagttcactaaaggactaagcctaaggaaaaaggtttgggtgactagtttcacattcagtacatacagtggagggaggtcttagggcagtggggctttattatctcacttggaacactatttgacaagggctgtcctagggccttgtggttatttacagccatgtaccagataatgaagtttaggtcaccataagattataatactgtatttttactgtacctttgtgtttagatatgtataattacacaaatacttagcattatgttacagtttcctacagtattcagtatagtaccatgctgtacagatttgtaggctgggaacaacaggctatactgtatagcctaggtgtggagtaggctataccatctaggtgtgtataagtgcacactgtacaatgttcacatgatgacaaagtagcctaacaatgcatttctcagactgtactgctgttgttagcagagcatgaccatatagctgagccggtagaagagagtaagagggaaacatgtcttcttcttttaaaagtgtggtctgaaagtagcacactatcatttccattcagaattccattgagtcacatgaccacatctgcaggggaggccgggagatggaatctagctgtgtgcctgtaggaacgctggtatttgtgccaatagctagcagtctcttccctaggaaaaatttcgccctaacgtagatttcaggactggtttaatgagtgaaacttcagttagttttaatatcttaatagctgtttaggggaagtggagcatttccctgaggttagtaaacattaattttattgattttgatgtggccactttacgatggcccctcctatatctgaaatttaagccttatggagtcctaattatgagaatatgctaatacttttgtttttcattttcaacctataaactcaagagataatccacatacactgtattattttcaatctccaaagtagtaaagtatcatcgtaaatctgcctcacacagaggttgctgtgagccgagatcatgccactgcactctagcctgggtgacagagggagactccatctccaaaacaaaaataaataaataaataaataaatgtgcctcacagaggaggaaactgaggcataaataacctccttttcaggtcacagagttagtgacctgtgtgacctgtctagtgactcaagaggaaacttgagtcctactgttgagtctttgttttaaccatagtctaatttataccatttgagattaaaatctctagttggtgctagttttaaattatataatgccattcatttttagggagtctaataacataatctcatcaaaggtcactctgttgttctttagctaaaaaacttccttcttagacctaaaaatactcatggccaggctagaaggcattgacctgcagcaagacatattaagttgttctgattcataggttattttcacagtaatttgatcctgttgatgttggtgtctgtttcacagatgaggctctgagctctaagacagagtgtcctgtacagggtcccacagctgggtaagccctggtgtgaaggaggtgttggaaacaagtagtcacggcctcttctactccaaacttcccaagcaagtaaagactggccgaagtgaaaacattcataaaacatgcaactaccttttttcccccaacttagaactcatcctgttcagcttaggagtgaggaaaaactggacaaggagagatgagtttatcagtaacttctctattttgttgccatatgtttctatcctgatagaatctgagtacttctagaagctacagcaaagctgtatttcactgctgaattacattgaagctttaagtgagcactgagctgtcatttaaaagctgactttgaggattttgatatctgagagaaagctttcagtaccataattcaggttctgaggatttttaagagtataatttgtattatttcccaccatgactgcctatccagtacctcaaagccccgctcaaatgctctctccttaggtgacctttcctctcccatgtctactccttaacccttattaaattctttacttaaatcttaatcccctgttaagcaagaatggtgtctgcatcttaaccagcgtcaccctcgccccagtgctgagccagtgccttgagcatagaatagcatctgccgctctgcttgggattgtctgtccttaatacgcctgtcagcagcttcagaaatcaaagaactaggaactttaaaactattatgcaaccctagaagtgttttacaagaaagattttcaacattgttattaatgtttcaaattttataattagcagttacagatctgccaatgcacagtcctgtcattatagaactaaattacctccaatttcatttggaaactcaagtacagtaagacacccattacagcctggtgtttcgcattttgcctcttttccatctggcccctgcccacactctatgctctagctctgaagtcatcttgtaatctgtacagtacagaatctgcttttcctaaaagtgatgtcacatggacagttcccaagtcgtttttaaattgtctttgtggactgattttgcatcagagagggaatcatcaggacacccatttccatgcaggctggagagccctcctctggcatcacttcactagatctcctcgacccttttcaacagggtttgtgcttcctcattgtttagtagtggttaagtatgtcatggtgttgaagcagtaatgcaccccaaaacttcttattcaagaaatactgccagaactttgggaggtcaaggcgggtgggtcacttgaggtcaggagtttgagaccagcctggccaacatggtgaaatcccatctctactaaaaatacaaaaattagccagtgtggtgttaggcacctgtaatcccagaattgcttgaacctgggaggcagaggttgcagtgagttgagatcatgccactgcactccagcctgggtgacagagactccgtctcaaaaaaaataaaaaataaaaaataaaaaatactggtctgggagaggtaacccaagctttgtttttttttttgtttttttttttttgtgtgtgtgtgtgtgagggggtgttctgtggggaagaaacccacattcagtggaattttgagaggcaatctttaaacagtagacaagcccagttcaaaactaacagattctttcttttggaaccctaactttccacattttaaagatgtggactttaaaattaaagatgtggacctaattttaaagattaaggactagtgttatttatagggtacttccttagacattttatttttcttcttattcaaagatgcaaatatgttcacaagttttgttaaaacgttcctaatttccagtatggttaacatataaagaagaagtagtgaagtagtctctgtaaggctgttctcttcctgtccaatgctggagcttgaagcccatagggcgggtagtcagaaaagatgtggagttggggagaacaagctgcaacccacaggcatgggctggagcccgtgaggatgctaaaatctgtccgttcttgttgcttctgaccttgatggtgtgggcattctgctgaaactgagacccttcacagaggagctgaaggaagatccatccaggggaaggtggagcggttgcaggcccaggcacaggtgtggttcacaccagcaaggtgtgccagctactcaagggctgctgctgcattgggccctgcagatctggcataggaatttgtggctcatcctaacctgagacatagggaagagagttctgggaaatgtagttcagtctagccaagttgatacatgacaaagctaccagtggctgtcataggatggtgggatttcaggtgatccttagatattacatgttattacctcacaatgagcatgtgttatttatatagtctgaaaaaacagaaagctattttttttgagacggattcttgttctgttgcccaggctggagtgcagtggtgcgatctcggctcactgcaacctctgcctccctcctgggttcaagcgattctcctgcctcagcctcccaagtacctgggattacaggcacgtgccagcacacccagctaatttttgtatttttagcagagatagggtttcaccatgttggccaggctggtctcccaactcctgacctcaggtaatctgccagcctcggggcctcccaaagtgctgggattacaggtgtgagccactatgccgggcccatagagctattttctttggggataaaaatgggagttataagaattggagactcactattaagaataaagagagaaaccatatattttacaggtgaacatcatagcttttatctgaaagaggtataaaaaagatgcccatgttctaattcttcttttgctacctaagagttgttgacattggccccaggccctaaaaagcaatcaagatgcaaaatgaagtactataaggaaaacaaacttcactatcactgtgtatctatcttcagtgcagaaacacaatcttttaagttacaccatccttcacaatctaagaggtgctgctgtagatgatgtaactgacagcaacatcagagttgggctcctagggattctctcccctcagacacccgagtccctttttgtagtgtataaaagatgattatgtgttgacagatcataaacacactgagataaaggagacactaaaaagcacattttaacacttgtgaggtattctaagattcagatttggctttccagaattggaaaattggccttggatggtgcctacagccatgagtctcaaactattttccaagcttggcacacatgacagtttcacctacccaagcacttttccctgggtcttcctgaagttatgccactgacaccctttcccctcaactcatgaaaacacatcagaaggcaagtgagtgagatgacctttagtcagctggaatatagaaaaggcaagctgtgacattaaccattagtaacagtattcgcaatcccacttgagtgttgctacactgtggttaaaaaattgtggtctccagcctggccaacatggtgaaaccctgtctctactaaaaatataaaaaaattagctgggtatggaggcaggtgcctgtaatcccagctacttaggaggctgaggcaggagaattgcttgaacccaggagacagaggtcacagtgagccgatatcatgccactgtactccagcctgggccacagagtgagactccatctcaaacgcaaaaaaaattgtggtctccaaaatagtatggtgtaaaatggttcgttaccatatgcataggggaagacaatgttagaactagttctagatatttctttttatctcatcatttaaaaattagtgttttataacagtaagttatagaaataatattactacatgtgtaaaatatataaatatccatatcaagggcatacctgctaaaacatttcttaactggctagggtgcagaattaaacctttttgaaactaaacctaaaagccaaagcgaaagtcattttcatttaaatgcaaacttcagaaaagaatgaatactcaaaagttttaggagatgaaagagaagagtagttaagaagtttaaaggcccagtgctttttctattaattagtaaaacccacactaaacactactgcaaaagctaaaaataaatgtaaaaaagagaaaggaaacagaagactctattgggatggaatgagaacagcatctttcatccacccatgcatacccacacacaggtaattatgatgtaactccctggaacagttcaagaaaaaaattaacaagatgcacagcctcttggcattctgatgtggttttagcattccgtctcttaaaataaaaagcaattagttatatagttgaccctacagtatttaggaaaacagaagcaacacgtgaggctaaaatcatttaattatacacaggccacaattgcaggatggaaaggcagtgggcacttggaagtgactacacatggcaataagcagcctatcttctttaccaaccagaagtttcttggggcatgtgatggtaggccagaccctttccaagggaataatactacactaagcctacactgtactgtgagagtcatggtggaacaaggccacaggcagtgggaggaaatgtgatgactcactgtgtcagaattctaaggcccagcatgatcaggatgtaaggctccataattttctaaaccagaaattatgagaagaacaaaattctgcaatcacttatgtttttttcttcttttttttttttgagacagagtttcactcttgttgcccaggctggagtgcagtggcacaatctcggctcactgcaacctccgcctcctgggttcaaccaattctcctgccccagcctcctgagtagctgggattacaggcatgtgccaccacgcccagctaattttgtatttttagtagagatggggtttctccatgtttgtcaggctggtctttaactcctgacctcaggtgatccgcctgccttggcctcccaagtgctgggattacaggcgtgagccaccatgcccggctgcaatcacgtatgagtttttctaaaaaaaccgaaacactggaaacatggatgcatcttaaagactttatgctaagtgaaaccagtcacaaaaggacaaatactgtatgattccacttacatgagaaatatgagtagtgaagttgatgatagagacaaaaggtatggctgttgctaggggaaggggaggtggggagttattgttcaatgggcacagaatttgggaagatggaaaacttctggagatggatgatggtgatggctggacaacaatgagaatgtacttaatccactgaattgcatatttaaaaatgggtaagctggtcagttttatgttataaatattttacctcaataaaaacaaattgaacttaaaaattcactgaagaagccaatatggaaaaaggactaaatgttaaaaaaaaaaaagccaactttttttttttaatcaagagataagtacttagctgcaagctcaaggtctcggttgaggacaatcattatgagtcctagtaaaagacaaccagttttaagaacactgtcaggcaagctaccatgtagttctccttgactccatgcttagctctttcagacttcccagtaattacgaagggtcacatttttgttcagctttgcccagtgctgtcattcataatagatgaatgaaaagtcccagaaacctgttctgtttgggaaggttttcttttgttccaggcttcggtggttaatatgcttgacaaatttcagagtctctctgtctctgtagaccaatgccaaagaattgctttctggattcactgttagcagctgaaaaagacaaatacagtgacacatcagaacacagaacttattctcaaatcttggatgattaaccatggaacagatggtttccatatcaagcacttaatctggggatagaggggtcctctgaatgaacacttactaggggtggctgtcaagccattttccaacaagccctattccagcatatacctagaaaggtacttacctattacatttatttcttactacattgtaagatttgtgggaatgcaccacatggctcttaatttggaatttctcaggagggtaaaataaatgcttactgagtatcctttagcatctttattccatcctgagtattttctactagaaattagaaccattgcctggcagagatttattagctaaagacactggtagaaggtcataaaaattgggtctttgaaaaatgaaagcattctcaataactaaaaatgatagtttgctatcagaagaaacttacctcttcatcttcacctttggcaatgtaagaagtaaaaccgccatattctggctcccagccttacaagagaaaaacaaacagcattcagaaagctcctattgaaagagtcgcaccatctacttaaatcactgatcccatgctgcttaacagtgggggatctgggagttcagcagtaactggttctatgacttatgagcttgaacttatcatctagtttatcatggattgccttcccctaaatgcctaatttcctgagacagctgaactgaaatgcagtcttatttcaataaactttgaatatgaaaattaagagagaattaaatgctaaatattcccagaagggcaattacataaaatctatagatctgggagcacacttaggggaaaattatggtgtggtccatctccccatttcctagtcacagatataaatcctattttgagctgggagactggaattcatgacccgtaaaatccctttgactttgagatcccatgatgtgagattctgaactaggcaaattacttatgaattggttcagctggaaagggtccctcagaagagactgcccctcctacggggaataatccaccgcttgctttcctccctcttaccttcacagccacagtacagaattaagtctagggcaaattcagccttgctatggtcatgaattaaagtgtagtgaccggtcttccaatgcctcagttccccttggcacatgggaacacttgattctaaggaaaaaaaaaaagatgagaaactttaaaaaataaccttgatagaactgttggattgcaagggaatcataattaggaatgatacagcaacacagggaaaccattcccacaaacctttgattgaagtgctattctaccaatccagccttataaaagattgttaggaattaccagctctattttggggtaaaaaagttgaattttgggccgggcatggtggctcatgcctgtaatcccaacactttgggaggctgaggtgggcagatcacctgaggtcgggagttcaagaccagcctgaccaacatggagaaaccccatctctactacaaatacaaaattagccaggcgtggtagtgcatgcctgtaatccagctacccgggaggcttaaggcaggagagttgcttgagcccgggtggcagaggttgtggtaagccgagattgtgccattacactccagcctgggcaacaagagtgaaactccatctcaaaaaaaaaaaaaaaaaaaagttgaattttgatttctctctataataataaatttcagatggaaaagaagtctagttgcaaaaaaataaaaaatacgacatgaatattattttatctaaccttaagagatttctcagcatgttattacctaaagtagaaacgaggaaaggcaaagatagacctgattactaaaatattttataaaatttaaaccatgctgaacaaaattaaaaaatgaactattacaatctgttaaacagaaggttagtactcctctgaggcaggcagatcacctgaggtcaggagttcaagaccagcctggccaatatggcaaaaccccgtttctactaaaaatacgaaaatattagctgagcatggtggcgtgtgcctgtaatcccagctacttaggaggctgaggcatgagaatcgcttgaacctgggaggcagaggttgcagtgagctgagatcacaccactgtactccagcctgggtgacagagcgagagtccacctcaaaaaaaaaaagaaggttaatactcctatatgtaactttttaaaattaactaataaaatgacaaaaagcccaaaggaaaaatacactgaggtaatgacaggcaactcatgaaaaaaaaaaatcaagtaaccaatagggaaaaatatacaaccacgcaccattagtcaatgataggcgaatgccatttccacctaaagaataagcaagttggaaaagaaaatataacagtttgctaggaagaatgaaaacatcatcatgtacaatgctggtgggagtgcagactgatacaagttttggggaggcaatttggcaactgccttaaaattttgagcagtctttgatgtatcacctgtacttctgagaagcattctgaagacacaatggatgtgtcgtttattatgacagtgaagaactggaaaaaatctaaatgctcaacacaggactggttaaggtcatctgatccaatagattgcaagcattaaaaagtatactagagaacggtgtttttcaaaacttaattgtggcatacattcttgaaataaaagcttctagaaatgcaatgttggaaagcagatacatgtaaaactgctttggtggccaggcgtggtggctcactcctgtaatcccagcactttgggaggccagggtgggcggatcatgaggtcaagagatggagaccatcctggctaacacggtgaaaccccgtctctactaaaaatacaaaacgttagccgggcgtggtggcatgcgcctgtagtcccagctactcgggaggctgaggcaggagaatcgcttgaacccggaagacggaggtagcagtgagccgagatcatgccactgcacttcagcctggcaacagagcgagactctgtctccaaaccaaaccaaaccaaaccaaaacaaaaaaagcaaaactgctttggtggaaggtttcctaagtgaggagggtgtgcaaacctgttctattgttataaaggatgtaaaaggatcagaaagaggtttatgaaatattaagtggaaaaaatacagaacaatatatatggtataatctcattaaaaatagatgtgtaaaaatataccccccatatgtgtatacatgtatatgtctacatagcaaaaaaacagtggaaggatatattccaaatgctaatatggccacttgtagattattattttcctttttcttgttttctaaacattctgaaattgacgtatttttattttttaaaatcatcttcaagttatcaggtctgtaatgttatctcactagatgtgccctagctatgccaatgtttagcactgctatcatatgcccagcaatttgatagcttttgccaagctttatagcttttcttcaagatggtaaacttcgtaaacagtgacttttctctttcacttttgtattccctactctgctttcacccaaggccccctgtatacagtaggtgctcaacaatggaataaagcatcttttggctgcccatatagattttatcctaagttgcaggttcccgtaaaaatgaaaccaaaaaaggaatagaactggacaagttttggccaggtgtgattggtcacgcttgtaatcactgcactttgggaggacaaggtaggaggattacttgagcctaggggtttgagaccagcctgggcaacatggcaagatcccatctttacaaaaaaaaaaaaatcaagaaaattagttgggtgtggtggcatatgcctgtgatcccagctacttgggatactgaggcagaaggatcgctcgagcctaggaggtcaaggctgcagtgagctgtgattgcaccactgcactccagcctgggtgacagtgcaagaccgtgtctcaaaacaaacaaacaaacaaacaaacagaagtggataagttttttaaaaaatccctttgagacagactccatggatactgactctggttcctcttagggtctaggcataaatgccagtatcaattaacatggaaaactaatctttcaaagaaaggctaccctgtgtattaagatagcacagaaaaagccacctgggtctggttttactaaatatctgcagtggccaaagtgactgttcagtcagttttggaaggccacagaatgagttatgttgctttcagttagcatctcaaaccactgattttgtttccacaagtatccaccccttgtctctgctctcctaactgcacagggttctcaagaaatttgagtggaagcagggaatggtaaactgggtgacagatgttctcactgacatagtagtaagtgctgaaacatctaagctgaatttgttgctactttttaatggtgccaatattttcacaggagtgttacctcttaaattcttaggctgttatattcagatctgagcttaaatggcgctcctcagagagacttttctaaatcatctattcgcctaagaggctactcagtcatttctttttttttttttttctttgagatgtagtctcgctctgttgcccaggctggagtgcaatggtgcaatctcgactcactgcaacctcctcctccccggttcaagtgattcttccacctcagcctcctgagtagcttggattacaggcgttcaccaccatgcctggcaaatttttttttttttttgtatttttagtagagacggggttttgccatgttggtcaggctggtctcgaactcctggcctcaggtgatcagactgcctccgcctccaaaagtgctgggattataggtgtaagccaccgcacctggcctactcagtcatttcttgtcatataaccctattacaatgttttgcatagcacttatcattacttgacgttttcttgttgttcatgtatacatttaatctctgtcttcttctactagaatgtaagctcccaaagaccagagaccttgtctgttttgtccttcagttcctgaaatagggcttagggcacagtagatgctcaataaatgtttgttgaatgaatacatgtttgaatggtgaatggttaatggtaagtaaggacaaatcctaacaacagcttacctttctttgtttcattttcctctggctctgggtctgtctgctcattgctctgttggctgttgttgctgatggccatctgattattctctggctcaggaggactatggctagtcccttcttcagtgatatcagtggtttctgcctcttttttatcattcatctcatcttcttccgaaggggccaagaaatgaagcttcaggcctgtgaagttggagagcagcaagaatagtgcctcagagcgaaataacttcatgcactccttcaatatctcaggaagcttactctcctcagctttctcataaaacctgaaaaacagcaatgtcaagttgttcatcaaagccacagatgtaaaatgactcacagaataaaagctgatcgttagctttgtacctctcttcctaaatcttggcacagcttactaaggcacaagttattacaatagtgagattttgttaggattttgttaggacatcctgctactggatgtccctgagaacaaaacatcattagggcaagtgtcctattattgggtgtgagccttggtgcatgattgtatattttttcctgttggttatttgattttctttcatgaactgcctgtcatcacctcagtctatttttcctttaggctttttgtcattttactagttataaaaaaatgttataggtgctgaatgtagaagcaaatatctcagatgacgggttctaccttttgttagggggacctcggctgctccattccacatgtccatgctccaaggcctcacagactttcgtgaatttctcaggctagaaaatgagcaaataaagaagcattcagcagatctccctattaccccgcactggtttggcaggtacagcagctctgccaaacatcaatctggctgattcctaaaaggtgcagttgactctcattcctttttttttttttttttttttttgagatggagtttcactcttgttgcccaggctggagtacaatggcgtgatctcggcccaccacaacctccacctcctgggttcaaacgattctcctgcctcagcctcccaagtagctgggattacagccatgcaccaccacgcctggctaattttgtatttttagtagagatggggtttctccatgttggctggtctcgaactcccgaccctcaggtgatctgtccaccttggattcccaaagggttgagattacagacatcagccactgcgcctggccgactctcactcctttcatacaagatcccctactcctcctgtggtaaagccagggtgaagactggatacatcattggcttgctttagccaagagacctgagtgccattgtggctcattctcttaagtagttatataccttacgtcaatctgctcaacctcccagactgctgcatttataaaatgaggatcataatacagaccataatacaactcacaagatgttttgaggataaaaaattaaactgcattacaatcaaggtcattaccgtgacaatctctgtataacaattccgattctctaggcccctaatttaataaccattctaaattcaaaaagttaggtacgacacaggaagctggttaatccattgaaatattctccacaagaggctttccatttatttgtttaatgcagtttcccaagcagtcctatcagttataaatgcatgaaaaaggaaagatcccatagcatggtttaggtaaactgaattgaatagggtattcagtttatttactataatacttctcaaaaccttaatatgctaatgtcagctataaaattgctagagagagacaggatgtagagtctcaaccttttttcatggaggaatagctcttgggaccatggctccatgggacccacagtcaactgtaaagtgccatgccagcaaaagttatcttattggccctcacaacaactctatgagaaagacaaggcaggtatgaatcccagtttaactgaagacaaaataaatacccagagtgatttagtgatctgcccaggttagtaaaaccacagagccagggcatgagaataagttttctgatttcttttttttttttttttgagacggagtctcgctctgtcacccaggctggagtgcaatggcgcaatctcagctcactgcaacctctgcatcccaggttcaagtgattctcctgtctcagcctcctgagtagctgggattacaggtgcatgccaccatgcccggctaatttttgttattttttctagtagagatggggtttcacaatgttggccaggctggtcttgaactcctgacctcagattatctggccacctcggcctcccaaagtactgggattacaggcatgagccactgtgcctggccagtcttctgatttctaatctctttccactataacaagcta
